United States Patent 11,446,398 (REGULATED BIOCIRCUIT SYSTEMS) - sequence listing, part 21

SEQ ID NO: 94637 - protein, 2792 aa, Homo sapiens
  Payload ID: 18870
  Gene Name: ubiquitin protein ligase E3 component n-recognin 5
  ENSP ID: ENSP00000427819
MTSIHFVVHPLPGTEDQLNDRLREVSEKLNKYNLNSHPPLNVLEQATIKQCVVGPNHAAFLLEDGRVCRIGFSVQPDRLELGKPDNNDGSKLNSNSGAGRTSRPGRTSDSPWFLSGSETLGRLAGNTLGSRWSSGVGGSGGGSSGRSSAGARDSRRQTRVIRTGRDRGSGLLGSQPQPVIPASVIPEELISQAQVVLQGKSRSVIIRELQRTNLDVNLAVNNLLSRDDEDGDDGDDTASESYLPGEDLMSLLDADIHSAHPSVIIDADAMFSEDISYFGYPSFRRSSLSRLGSSRERDSELLRERESVLRLRERRWLDGASFDNERGSTSKEGEPNLDKKNTPVQSPVSLGEDLQWWPDKDGTKFICIGALYSELLAVSSKGELYQWKWSESEPYRNAQNPSLHHPRATFLGLTNEKIVLLSANSIRATVATENNKVATWVDETLSSVASKLEHTAQTYSELQGERIVSLHCCALYTCAQLENSLYWWGVVPFSQRKKMLEKARAKNKKPKSSAGISSMPNITVGTQVCLRNNPLYHAGAVAFSISAGIPKVGVLMESVWNMNDSCRFQLRSPESLKNMEKASKTTEAKPESKQEPVKTEMGPPPSPASTCSDASSIASSASMPYKRRRSTPAPKEEEKVNEEQWSLREVVFVEDVKNVPVGKVLKVDGAYVAVKFPGTSSNTNCQNSSGPDADPSSLLQDCRLLRIDELQVVKTGGTPKVPDCFQRTPKKLCIPEKTEILAVNVDSKGVHAVLKTGNWVRYCIFDLATGKAEQENNFPTSSIAFLGQNERNVAIFTAGQESPIILRDGNGTIYPMAKDCMGGIRDPDWLDLPPISSLGMGVHSLINLPANSTIKKKAAVIIMAVEKQTLMQHILRCDYEACRQYLMNLEQAVVLEQNLQMLQTFISHRCDGNRNILHACVSVCFPTSNKETKEEEEAERSERNTFAERLSAVEAIANAISVVSSNGPGNRAGSSSSRSLRLREMMRRSLRAAGLGRHEAGASSSDHQDPVSPPIAPPSWVPDPPAMDPDGDIDFILAPAVGSLTTAATGTGQGPSTSTIPGPSTEPSVVESKDRKANAHFILKLLCDSVVLQPYLRELLSAKDARGMTPFMSAVSGRAYPAAITILETAQKIAKAEISSSEKEEDVFMGMVCPSGTNPDDSPLYVLCCNDTCSFTWTGAEHINQDIFECRTCGLLESLCCCTECARVCHKGHDCKLKRTSPTAYCDCWEKCKCKTLIAGQKSARLDLLYRLLTATNLVTLPNSRGEHLLLFLVQTVARQTVEHCQYRPPRIREDRNRKTASPEDSDMPDHDLEPPRFAQLALERVLQDWNALKSMIMFGSQENKDPLSASSRIGHLLPEEQVYLNQQSGTIRLDCFTHCLIVKCTADILLLDTLLGTLVKELQNKYTPGRREEAIAVTMRFLRSVARVFVILSVEMASSKKKNNFIPQPIGKCKRVFQALLPYAVEELCNVAESLIVPVRMGIARPTAPFTLASTSIDAMQGSEELFSVEPLPPRPSSDQSSSSSQSQSSYIIRNPQQRRISQSQPVRGRDEEQDDIVSADVEEVEVVEGVAGEEDHHDEQEEHGEENAEAEGQHDEHDEDGSDMELDLLAAAETESDSESNHSNQDNASGRRSVVTAATAGSEAGASSVPAFFSEDDSQSNDSSDSDSSSSQSDDIEQETFMLDEPLERTTNSSHANGAAQAPRSMQWAVRNTQHQRAASTAPSSTSTPAASSAGLIYIDPSNLRRSGTISTSAAAAAAALEASNASSYLTSASSLARAYSIVIRQISDLMGLIPKYNHLVYSQIPAAVKLTYQDAVNLQNYVEEKLIPTWNWMVSIMDSTEAQLRYGSALASAGDPGHPNHPLHASQNSARRERMTAREEASLRTLEGRRRATLLSARQGMMSARGDFLNYALSLMRSHNDEHSDVLPVLDVCSLKHVAYVFQALIYWIKAMNQQTTLDTPQLERKRTRELLELGIDNEDSEHENDDDTNQSATLNDKDDDSLPAETGQNHPFFRRSDSMTFLGCIPPNPFEVPLAEAIPLADQPHLLQPNARKEDLFGRPSQGLYSSSASSGKCLMEVTVDRNCLEVLPTKMSYAANLKNVMNMQNRQKKEGEEQPVLPEETESSKPGPSAHDLAAQLKSSLLAEIGLTESEGPPLTSFRPQCSFMGMVISHDMLLGRWRLSLELFGRVFMEDVGAEPGSILTELGGFEVKESKFRREMEKLRNQQSRDLSLEVDRDRDLLIQQTMRQLNNHFGRRCATTPMAVHRVKVTFKDEPGEGSGVARSFYTAIAQAFLSNEKLPNLECIQNANKGTHTSLMQRLRNRGERDREREREREMRRSSGLRAGSRRDRDRDFRRQLSIDTRPFRPASEGNPSDDPEPLPAHRQALGERLYPRVQAMQPAFASKITGMLLELSPAQLLLLLASEDSLRARVDEAMELIIAHGRENGADSILDLGLVDSSEKVQENRKRHGSSRSVVDMDLDDTDDGDDNAPLFYQPGKRGFYTPRPGKNTEARLNCFRNIGRILGLCLLQNELCPITLNRHVIKVLLGRKVNWHDFAFFDPVMYESLRQLILASQSSDADAVFSAMDLAFAIDLCKEEGGGQVELIPNGVNIPVTPQNVYEYVRKYAEHRMLVVAEQPLHAMRKGLLDVLPKNSLEDLTAEDFRLLVNGCGEVNVQMLISFTSFNDESGENAEKLLQFKRWFWSIVEKMSMTERQDLVYFWTSSPSLPASEEGFQPMPSITIRPPDDQHLPTANTCISRLYVPLYSSKQILKQKLLLAIKTKNFGFV

SEQ ID NO: 94638 - protein, 166 aa, Homo sapiens
  Payload ID: 18870
  Gene Name: ubiquitin protein ligase E3 component n-recognin 5
  ENSP ID: ENSP00000428062
MGMVISHDMLLGRWRLSLELFGRVFMEDVGAEPGSILTELGGFEVKESKFRREMEKLRNQQSRDLSLEVDRDRDLLIQQTMRQLNNHFGRRCATTPMAVHRVKVTFKDEPGEGSGVARSFYTAIAQAFLSNEKLPNLECIQNANKGTHTSLMQRLRNRGERDRERE

SEQ ID NO: 94639 - protein, 201 aa, Homo sapiens
  Payload ID: 18870
  Gene Name: ubiquitin protein ligase E3 component n-recognin 5
  ENSP ID: ENSP00000428138
  MOD_RES (1)..(1): Any amino acid
XEACRQYLMNLEQAVVLEQNLQMLQTFISHRCDGNRNILHACVSVCFPTSNKETKEEEEAERSERNTFAERLSAVEAIANAISVVSSNGPGNRAGSSSSRSLRLREMMRRSLRAAGLGRHEAGASSSDHQDPVSPPIAPPSWVPDPPAMDPAATGTGQGPSTSTIPGPSTEPSVVESKDRKANAHFILKLLCDSVVLQPYL

SEQ ID NO: 94640 - protein, 527 aa, Homo sapiens
  Payload ID: 18870
  Gene Name: ubiquitin protein ligase E3 component n-recognin 5
  ENSP ID: ENSP00000428693
MAVHRVKVTFKDEPGEGSGVARSFYTAIAQAFLSNEKLPNLECIQNANKGTHTSLMQRLRNRGERDREREREREMRRSSGLRAGSRRDRDRDFRRQLSIDTRPFRPASEGNPSDDPEPLPAHRQALGERLYPRVQAMQPAFASKITGMLLELSPAQLLLLLASEDSLRARVDEAMELIIAHGRENGADSILDLGLVDSSEKVQENRKRHGSSRSVVDMDLDDTDDGDDNAPLFYQPGKRGFYTPRPGKNTEARLNCFRNIGRILGLCLLQNELCPITLNRHVIKVLLGRKVNWHDFAFFDPVMYESLRQLILASQSSDADAVFSAMDLAFAIDLCKEEGGGQVELIPNGVNIPVTPQNVYEYVRKYAEHRMLVVAEQPLHAMRKGLLDVLPKNSLEDLTAEDFRLLVNGCGEVNVQMLISFTSFNDESGENAEKLLQFKRWFWSIVEKMSMTERQDLVYFWTSSPSLPASEEGFQPMPSITIRPPDDQHLPTANTCISRLYVPLYSSKQILKQKLLLAIKTKNFGFV

SEQ ID NO: 94641 - protein, 2799 aa, Homo sapiens
  Payload ID: 18870
  Gene Name: ubiquitin protein ligase E3 component n-recognin 5
  Uniprot ID: O95071
  ENSP ID: ENSP00000429084
MTSIHFVVHPLPGTEDQLNDRLREVSEKLNKYNLNSHPPLNVLEQATIKQCVVGPNHAAFLLEDGRVCRIGFSVQPDRLELGKPDNNDGSKLNSNSGAGRTSRPGRTSDSPWFLSGSETLGRLAGNTLGSRWSSGVGGSGGGSSGRSSAGARDSRRQTRVIRTGRDRGSGLLGSQPQPVIPASVIPEELISQAQVVLQGKSRSVIIRELQRTNLDVNLAVNNLLSRDDEDGDDGDDTASESYLPGEDLMSLLDADIHSAHPSVIIDADAMFSEDISYFGYPSFRRSSLSRLGSSRVLLLPLERDSELLRERESVLRLRERRWLDGASFDNERGSTSKEGEPNLDKKNTPVQSPVSLGEDLQWWPDKDGTKFICIGALYSELLAVSSKGELYQWKWSESEPYRNAQNPSLHHPRATFLGLTNEKIVLLSANSIRATVATENNKVATWVDETLSSVASKLEHTAQTYSELQGERIVSLHCCALYTCAQLENSLYWWGVVPFSQRKKMLEKARAKNKKPKSSAGISSMPNITVGTQVCLRNNPLYHAGAVAFSISAGIPKVGVLMESVWNMNDSCRFQLRSPESLKNMEKASKTTEAKPESKQEPVKTEMGPPPSPASTCSDASSIASSASMPYKRRRSTPAPKEEEKVNEEQWSLREVVFVEDVKNVPVGKVLKVDGAYVAVKFPGTSSNTNCQNSSGPDADPSSLLQDCRLLRIDELQVVKTGGTPKVPDCFQRTPKKLCIPEKTEILAVNVDSKGVHAVLKTGNWVRYCIFDLATGKAEQENNFPTSSIAFLGQNERNVAIFTAGQESPIILRDGNGTIYPMAKDCMGGIRDPDWLDLPPISSLGMGVHSLINLPANSTIKKKAAVIIMAVEKQTLMQHILRCDYEACRQYLMNLEQAVVLEQNLQMLQTFISHRCDGNRNILHACVSVCFPTSNKETKEEEEAERSERNTFAERLSAVEAIANAISVVSSNGPGNRAGSSSSRSLRLREMMRRSLRAAGLGRHEAGASSSDHQDPVSPPIAPPSWVPDPPAMDPDGDIDFILAPAVGSLTTAATGTGQGPSTSTIPGPSTEPSVVESKDRKANAHFILKLLCDSVVLQPYLRELLSAKDARGMTPFMSAVSGRAYPAAITILETAQKIAKAEISSSEKEEDVFMGMVCPSGTNPDDSPLYVLCCNDTCSFTWTGAEHINQDIFECRTCGLLESLCCCTECARVCHKGHDCKLKRTSPTAYCDCWEKCKCKTLIAGQKSARLDLLYRLLTATNLVTLPNSRGEHLLLFLVQTVARQTVEHCQYRPPRIREDRNRKTASPEDSDMPDHDLEPPRFAQLALERVLQDWNALKSMIMFGSQENKDPLSASSRIGHLLPEEQVYLNQQSGTIRLDCFTHCLIVKCTADILLLDTLLGTLVKELQNKYTPGRREEAIAVTMRFLRSVARVFVILSVEMASSKKKNNFIPQPIGKCKRVFQALLPYAVEELCNVAESLIVPVRMGIARPTAPFTLASTSIDAMQGSEELFSVEPLPPRPSSDQSSSSSQSQSSYIIRNPQQRRISQSQPVRGRDEEQDDIVSADVEEVEVVEGVAGEEDHHDEQEEHGEENAEAEGQHDEHDEDGSDMELDLLAAAETESDSESNHSNQDNASGRRSVVTAATAGSEAGASSVPAFFSEDDSQSNDSSDSDSSSSQSDDIEQETFMLDEPLERTTNSSHANGAAQAPRSMQWAVRNTQHQRAASTAPSSTSTPAASSAGLIYIDPSNLRRSGTISTSAAAAAAALEASNASSYLTSASSLARAYSIVIRQISDLMGLIPKYNHLVYSQIPAAVKLTYQDAVNLQNYVEEKLIPTWNWMVSIMDSTEAQLRYGSALASAGDPGHPNHPLHASQNSARRERMTAREEASLRTLEGRRRATLLSARQGMMSARGDFLNYALSLMRSHNDEHSDVLPVLDVCSLKHVAYVFQALIYWIKAMNQQTTLDTPQLERKRTRELLELGIDNEDSEHENDDDTNQSATLNDKDDDSLPAETGQNHPFFRRSDSMTFLGCIPPNPFEVPLAEAIPLADQPHLLQPNARKEDLFGRPSQGLYSSSASSGKCLMEVTVDRNCLEVLPTKMSYAANLKNVMNMQNRQKKEGEEQPVLPEETESSKPGPSAHDLAAQLKSSLLAEIGLTESEGPPLTSFRPQCSFMGMVISHDMLLGRWRLSLELFGRVFMEDVGAEPGSILTELGGFEVKESKFRREMEKLRNQQSRDLSLEVDRDRDLLIQQTMRQLNNHFGRRCATTPMAVHRVKVTFKDEPGEGSGVARSFYTAIAQAFLSNEKLPNLECIQNANKGTHTSLMQRLRNRGERDREREREREMRRSSGLRAGSRRDRDRDFRRQLSIDTRPFRPASEGNPSDDPEPLPAHRQALGERLYPRVQAMQPAFASKITGMLLELSPAQLLLLLASEDSLRARVDEAMELIIAHGRENGADSILDLGLVDSSEKVQQENRKRHGSSRSVVDMDLDDTDDGDDNAPLFYQPGKRGFYTPRPGKNTEARLNCFRNIGRILGLCLLQNELCPITLNRHVIKVLLGRKVNWHDFAFFDPVMYESLRQLILASQSSDADAVFSAMDLAFAIDLCKEEGGGQVELIPNGVNIPVTPQNVYEYVRKYAEHRMLVVAEQPLHAMRKGLLDVLPKNSLEDLTAEDFRLLVNGCGEVNVQMLISFTSFNDESGENAEKLLQFKRWFWSIVEKMSMTERQDLVYFWTSSPSLPASEEGFQPMPSITIRPPDDQHLPTANTCISRLYVPLYSSKQILKQKLLLAIKTKNFGFV

SEQ ID NO: 94642 - protein, 194 aa, Homo sapiens
  Payload ID: 18870
  Gene Name: ubiquitin protein ligase E3 component n-recognin 5
  ENSP ID: ENSP00000429127
  MOD_RES (1)..(1): Any amino acid
XFISHRCDGNRNILHACVSVCFPTSNKETKEEEAERSERNTFAERLSAVEAIANAISVVSSNGPGNRAGSSSSRSLRLREMMRRSLRAAGLGRHEAGASSSDHQDPVSPPIAPPSWVPDPPAMDPDGDIDFILAPAVGSLTTAATGTGQGPSTSTIPGPSTEPSVVESKDRKANAHFILKLLCDSVVLQPYLRE

SEQ ID NO: 94643 - protein, 425 aa, Homo sapiens
  Payload ID: 18871
  Gene Name: ubiquitin protein ligase E3 component n-recognin 7 (putative)
  Uniprot ID: Q8N806
  ENSP ID: ENSP00000013070
MAGAEGAAGRQSELEPVVSLVDVLEEDEELENEACAVLGGSDSEKCSYSQGSVKRQALYACSTCTPEGEEPAGICLACSYECHGSHKLFELYTKRNFRCDCGNSKFKNLECKLLPDKAKVNSGNKYNDNFFGLYCICKRPYPDPEDEIPDEMIQCVVCEDWFHGRHLGAIPPESGDFQEMVCQACMKRCSFLWAYAAQLAVTKISTEDDGLVRNIDGIGDQEVIKPENGEHQDSTLKEDVPEQGKDDVREVKVEQNSEPCAGSSSESDLQTVFKNESLNAESKSGCKLQELKAKQLIKKDTATYWPLNWRSKLCTCQDCMKMYGDLDVLFLTDEYDTVLAYENKGKIAQATDRSDPLMDTLSSMNRVQQVELICEYNDLKTELKDYLKRFADEGTVVKREDIQQFFEEFQSKKRRRVDGMQYYCS

SEQ ID NO: 94644 - protein, 360 aa, Homo sapiens
  Payload ID: 18871
  Gene Name: ubiquitin protein ligase E3 component n-recognin 7 (putative)
  ENSP ID: ENSP00000391706
MRRALSWAAATPRSAPTLRNFRCDCGNSKFKNLECKLLPDKAKVNSGNKYNDNFFGLYCICKRPYPDPEDEIPDEMIQCVVCEDWFHGRHLGAIPPESGDFQEMVCQACMKRCSFLWAYAAQLAVTKISTEDDGLVRNIDGIGDQEVIKPENGEHQDSTLKEDVPEQGKDDVREVKVEQNSEPCAGSSSESDLQTVFKNESLNAESKSGCKLQELKAKQLIKKDTATYWPLNWRSKLCTCQDCMKMYGDLDVLFLTDEYDTVLAYENKGKIAQATDRSDPLMDTLSSMNRVQQVELICEYNDLKTELKDYLKRFADEGTVVKREDIQQFFEEFQKKEKKSGWDAVLLQLEWSMKLSHSSQ

SEQ ID NO: 94645 - protein, 54 aa, Homo sapiens
  Payload ID: 18871
  Gene Name: ubiquitin protein ligase E3 component n-recognin 7 (putative)
  ENSP ID: ENSP00000450470
MAGAEGAAGRQSELEPVVSLVDVLEEDEELENEACAVLGGSDSEKCSYSQKFSL

SEQ ID NO: 94646 - protein, 178 aa, Homo sapiens
  Payload ID: 18871
  Gene Name: ubiquitin protein ligase E3 component n-recognin 7 (putative)
  ENSP ID: ENSP00000450645
MAGAEGAAGRQSELEPVVSLVDVLEEDEELENEACAVLGGSDSEKCSYSQGSVKRQALYACSTCTPEGEEPAGICLACSYECHGSHKLFELYTKRNFRCDCGNSKFKNLECKLLPIPDEMIQCVVCEDWFHGRHLGAIPPESGDFQEMVCQACMKRCSFLWAYAAQLAVTKISTEDDG

SEQ ID NO: 94647 - protein, 152 aa, Homo sapiens
  Payload ID: 18871
  Gene Name: ubiquitin protein ligase E3 component n-recognin 7 (putative)
  ENSP ID: ENSP00000451022
MAGAEGAAGRQSELEPVVSLVDVLEEDEELENEACAVLGGSDSEKCSYSQIPDEMIQCVVCEDWFHGRHLGAIPPESGDFQEMVCQACMKRCSFLWAYAAQLAVTKISTEDDGLVRNIDGIGDQEVIKPENGEHQDSTLKEDVPEQGKDDVR

SEQ ID NO: 94648 - protein, 164 aa, Homo sapiens
  Payload ID: 18871
  Gene Name: ubiquitin protein ligase E3 component n-recognin 7 (putative)
  ENSP ID: ENSP00000451051
  MOD_RES (1)..(1): Any amino acid
XAGAEGAAGRQSELEPVVSLVDVLEEDEELENEACAVLGGSDSEKCSYSQGSVKRQALYACSTCTPEGEEPAGICLACSYECHGSHKLFELYTKSKFKNLECKLLPDKAKVNSGNKYNDNFFGLYCICKRPYPDPEDEIPDEMIQCVVCEDWFHGRHLGAIPPE

SEQ ID NO: 94649 - protein, 174 aa, Homo sapiens
  Payload ID: 18871
  Gene Name: ubiquitin protein ligase E3 component n-recognin 7 (putative)
  ENSP ID: ENSP00000451785
  MOD_RES (1)..(1): Any amino acid
XLACSYECHGSHKLFELYTKRNFRCDCGNSKFKNLECKLLPDKAKVNSGNKYNDNFFGLYCICKRPYPDPEDEIPDEMIQCVVCEDWFHGRHLGAIPPESGDFQEMVCQACMKRCSFLWAYAAQLAEYNDLKTELKDYLKRFADEGTVVKREDIQQFFEEFQSKKRRRVDGMQY

SEQ ID NO: 94650 - protein, 124 aa, Homo sapiens
  Payload ID: 18871
  Gene Name: ubiquitin protein ligase E3 component n-recognin 7 (putative)
  ENSP ID: ENSP00000452488
  MOD_RES (1)..(1): Any amino acid
XVEQNSEPCAGSSSESDLQKMYGDLDVLFLTDEYDTVLAYENKGKIAQATDRSDPLMDTLSSMNRVQQVELICEYNDLKTELKDYLKRFADEGTVVKREDIQQFFEEFQSKKRRRVDGMQYYCS

SEQ ID NO: 94651 - protein, 360 aa, Homo sapiens; identical to SEQ ID NO: 94644
  Payload ID: 18871
  Gene Name: ubiquitin protein ligase E3 component n-recognin 7 (putative)
  ENSP ID: ENSP00000479570

SEQ ID NO: 94652 - protein, 425 aa, Homo sapiens; identical to SEQ ID NO: 94643
  Payload ID: 18871
  Gene Name: ubiquitin protein ligase E3 component n-recognin 7 (putative)
  Uniprot ID: Q8N806
  ENSP ID: ENSP00000483908

SEQ ID NO: 94653 - protein, 164 aa, Homo sapiens; identical to SEQ ID NO: 94648
  Payload ID: 18871
  Gene Name: ubiquitin protein ligase E3 component n-recognin 7 (putative)
  ENSP ID: ENSP00000485686
  MOD_RES (1)..(1): Any amino acid

SEQ ID NO: 94654 - protein, 174 aa, Homo sapiens; identical to SEQ ID NO: 94649
  Payload ID: 18871
  Gene Name: ubiquitin protein ligase E3 component n-recognin 7 (putative)
  ENSP ID: ENSP00000485983
  MOD_RES (1)..(1): Any amino acid

SEQ ID NO: 94655 - protein, 124 aa, Homo sapiens; identical to SEQ ID NO: 94650
  Payload ID: 18871
  Gene Name: ubiquitin protein ligase E3 component n-recognin 7 (putative)
  ENSP ID: ENSP00000486093
  MOD_RES (1)..(1): Any amino acid

SEQ ID NO: 94656 - protein, 152 aa, Homo sapiens; identical to SEQ ID NO: 94647
  Payload ID: 18871
  Gene Name: ubiquitin protein ligase E3 component n-recognin 7 (putative)
  ENSP ID: ENSP00000486462

SEQ ID NO: 94657 - protein, 178 aa, Homo sapiens; identical to SEQ ID NO: 94646
  Payload ID: 18871
  Gene Name: ubiquitin protein ligase E3 component n-recognin 7 (putative)
  ENSP ID: ENSP00000486939

SEQ ID NO: 94658 - protein, 852 aa, Homo sapiens
  Payload ID: 18872
  Gene Name: ubiquitin protein ligase E3A
  Uniprot ID: Q05086
  ENSP ID: ENSP00000232165
MKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVSVDIDAIRRVYTRLLSNEKIETAFLNALVYLSPNVECDLTYHNVYSRDPNYLNLFIIVMENRNLHSPEYLEMALPLFCKAMSKLPLAAQGKLIRLWSKYNADQIRRMMETFQQLITYKVISNEFNSRNLVNDDDAIVAASKCLKMVYYANVVGGEVDTNHNEEDDEEPIPESSELTLQELLGEERRNKKGPRVDPLETELGVKTLDCRKPLIPFEEFINEPLNEVLEMDKDYTFFKVETENKFSFMTCPFILNAVTKNLGLYYDNRIRMYSERRITVLYSLVQGQQLNPYLRLKVRRDHIIDDALVRLEMIAMENPADLKKQLYVEFEGEQGVDEGGVSKEFFQLVVEEIFNPDIGMFTYDESTKLFWFNPSSFETEGQFTLIGIVLGLAIYNNCILDVHFPMVVYRKLMGKKGTFRDLGDSHPVLYQSLKDLLEYEGNVEDDMMITFQISQTDLFGNPMMYDLKENGDKIPITNENRKEFVNLYSDYILNKSVEKQFKAFRRGFHMVTNESPLKYLFRPEEIELLICGSRNLDFQALEETTEYDGGYTRDSVLIREFWEIVHSFTDEQKRLFLQFTTGTDRAPVGGLGKLKMIIAKNGPDTERLPTSHTCFNVLLLPEYSSKEKLKERLLKAITYAKGFGML

SEQ ID NO: 94659 - protein, 875 aa, Homo sapiens
  Payload ID: 18872
  Gene Name: ubiquitin protein ligase E3A
  Uniprot ID: Q05086
  ENSP ID: ENSP00000381045
MEKLHQCYWKSGEPQSDDIEASRMKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVSVDIDAIRRVYTRLLSNEKIETAFLNALVYLSPNVECDLTYHNVYSRDPNYLNLFIIVMENRNLHSPEYLEMALPLFCKAMSKLPLAAQGKLIRLWSKYNADQIRRMMETFQQLITYKVISNEFNSRNLVNDDDAIVAASKCLKMVYYANVVGGEVDTNHNEEDDEEPIPESSELTLQELLGEERRNKKGPRVDPLETELGVKTLDCRKPLIPFEEFINEPLNEVLEMDKDYTFFKVETENKFSFMTCPFILNAVTKNLGLYYDNRIRMYSERRITVLYSLVQGQQLNPYLRLKVRRDHIIDDALVRLEMIAMENPADLKKQLYVEFEGEQGVDEGGVSKEFFQLVVEEIFNPDIGMFTYDESTKLFWFNPSSFETEGQFTLIGIVLGLAIYNNCILDVHFPMVVYRKLMGKKGTFRDLGDSHPVLYQSLKDLLEYEGNVEDDMMITFQISQTDLFGNPMMYDLKENGDKIPITNENRKEFVNLYSDYILNKSVEKQFKAFRRGFHMVTNESPLKYLFRPEEIELLICGSRNLDFQALEETTEYDGGYTRDSVLIREFWEIVHSFTDEQKRLFLQFTTGTDRAPVGGLGKLKMIIAKNGPDTERLPTSHTCFNVLLLPEYSSKEKLKERLLKAITYAKGFGML

SEQ ID NO: 94660 - protein, 852 aa, Homo sapiens; identical to SEQ ID NO: 94658
  Payload ID: 18872
  Gene Name: ubiquitin protein ligase E3A
  Uniprot ID: Q05086
  ENSP ID: ENSP00000401265

SEQ ID NO: 94661 - protein, 852 aa, Homo sapiens; identical to SEQ ID NO: 94658
  Payload ID: 18872
  Gene Name: ubiquitin protein ligase E3A
  Uniprot ID: Q05086
  ENSP ID: ENSP00000411258

SEQ ID NO: 94662 - protein, 852 aa, Homo sapiens; identical to SEQ ID NO: 94658
  Payload ID: 18872
  Gene Name: ubiquitin protein ligase E3A
  Uniprot ID: Q05086
  ENSP ID: ENSP00000457771

SEQ ID NO: 94663 - protein, 189 aa, Homo sapiens
  Payload ID: 18872
  Gene Name: ubiquitin protein ligase E3A
  ENSP ID: ENSP00000473822
HFPMVVYRKLMGKKGTFRDLGDSHPEFVNLYSDYILNKSVEKQFKAFRRGFHMVTNESPLKYLFRPEEIELLICGSRNLDFQALEETTEYDGGYTRDSVLIREFWEIVHSFTDEQKRLFLQFTTGTDRAPVGGLGKLKMIIAKNGPDTERLPTSHTCFNVLLLPEYSSKEKLKERLLKAITYAKGFGML

SEQ ID NO: 94664 - protein, 872 aa, Homo sapiens
  Payload ID: 18872
  Gene Name: ubiquitin protein ligase E3A
  Uniprot ID: Q05086
  ENSP ID: ENSP00000481796
MATACKRSGEPQSDDIEASRMKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVSVDIDAIRRVYTRLLSNEKIETAFLNALVYLSPNVECDLTYHNVYSRDPNYLNLFIIVMENRNLHSPEYLEMALPLFCKAMSKLPLAAQGKLIRLWSKYNADQIRRMMETFQQLITYKVISNEFNSRNLVNDDDAIVAASKCLKMVYYANVVGGEVDTNHNEEDDEEPIPESSELTLQELLGEERRNKKGPRVDPLETELGVKTLDCRKPLIPFEEFINEPLNEVLEMDKDYTFFKVETENKFSFMTCPFILNAVTKNLGLYYDNRIRMYSERRITVLYSLVQGQQLNPYLRLKVRRDHIIDDALVRLEMIAMENPADLKKQLYVEFEGEQGVDEGGVSKEFFQLVVEEIFNPDIGMFTYDESTKLFWFNPSSFETEGQFTLIGIVLGLAIYNNCILDVHFPMVVYRKLMGKKGTFRDLGDSHPVLYQSLKDLLEYEGNVEDDMMITFQISQTDLFGNPMMYDLKENGDKIPITNENRKEFVNLYSDYILNKSVEKQFKAFRRGFHMVTNESPLKYLFRPEEIELLICGSRNLDFQALEETTEYDGGYTRDSVLIREFWEIVHSFTDEQKRLFLQFTTGTDRAPVGGLGKLKMIIAKNGPDTERLPTSHTCFNVLLLPEYSSKEKLKERLLKAITYAKGFGML

SEQ ID NO: 94665 - protein, 39 aa, Homo sapiens
  Payload ID: 18872
  Gene Name: ubiquitin protein ligase E3A
  ENSP ID: ENSP00000485732
MATACKRSGEPQSDDIEASRMKRAAAKHLIERYYHQLTE

SEQ ID NO: 94666 - protein, 148 aa, Homo sapiens
  Payload ID: 18872
  Gene Name: ubiquitin protein ligase E3A
  ENSP ID: ENSP00000485958
MATACKRSGEPQSDDIEASRMKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIR

SEQ ID NO: 94667 - protein, 8 aa, Homo sapiens
  Payload ID: 18872
  Gene Name: ubiquitin protein ligase E3A
  ENSP ID: ENSP00000486066
MATACKRS

SEQ ID NO: 94668 - protein, 852 aa, Homo sapiens; identical to SEQ ID NO: 94658
  Payload ID: 18872
  Gene Name: ubiquitin protein ligase E3A
  Uniprot ID: Q05086
  ENSP ID: ENSP00000486349

SEQ ID NO: 94669 - protein, 187 aa, Homo sapiens
  Payload ID: 18872
  Gene Name: ubiquitin protein ligase E3A
  ENSP ID: ENSP00000486388
MATACKRSGEPQSDDIEASRMKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDE

SEQ ID NO: 94670 - protein, 14 aa, Homo sapiens
  Payload ID: 18872
  Gene Name: ubiquitin protein ligase E3A
  ENSP ID: ENSP00000486601
MATACKRSGEPQSD

SEQ ID NO: 94671 - protein, 49 aa, Homo sapiens
  Payload ID: 18872
  Gene Name: ubiquitin protein ligase E3A
  ENSP ID: ENSP00000486900
MKRAAAKHLIERYYHQLTEGCGNEACTNEFCASCPTFLRMDNNAAAIKA

SEQ ID NO: 94672 - protein, 77 aa, Homo sapiens
  Payload ID: 18872
  Gene Name: ubiquitin protein ligase E3A
  ENSP ID: ENSP00000487148
MATACKRSGEPQSDDIEASRMKRAAAKHLIERYYHQLTEGCGNEACTNEFCASCPTFLRMDNNAAAIKALELYKINA

SEQ ID NO: 94673 - protein, 143 aa, Homo sapiens
  Payload ID: 18872
  Gene Name: ubiquitin protein ligase E3A
  ENSP ID: ENSP00000487178
  MOD_RES (1)..(1): Any amino acid
XISQTDLFGNPMMYDLKENGDKIPITNENRKNLDFQALEETTEYDGGYTRDSVLIREFWEIVHSFTDEQKRLFLQFTTGTDRAPVGGLGKLKMIIAKNGPDTERLPTSHTCFNVLLLPEYSSKEKLKERLLKAITYAKGFGML

SEQ ID NO: 94674 - protein, 765 aa, Homo sapiens
  Payload ID: 18872
  Gene Name: ubiquitin protein ligase E3A
  ENSP ID: ENSP00000487217
MKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVSVDIDAIRRVYTRLLSNEKIETAFLNALVYLSPNVECDLTYHNVYSRDPNYLNLFIIVMENRNLHSPEYLEMALPLFCKAMSKLPLAAQGKLIRLWSKYNADQIRRMMETFQQLITYKVISNEFNSRNLVNDDDAIVAASKCLKMVYYANVVGGEVDTNHNEEDDEEPIPESSELTLQELLGEERRNKKGPRVDPLETELGVKTLDCRKPLIPFEEFINEPLNEVLEMDKDYTFFKVETENKFSFMTCPFILNAVTKNLGLYYDNRIRMYSERRITVLYSLVQGQQLNPYLRLKVRRDHIIDDALVRLEMIAMENPADLKKQLYVEFEGEQGVDEGGVSKEFFQLVVEEIFNPDIGMFTYDESTKLFWFNPSSFETEGQFTLIGIVLGLAIYNNCILDVHFPMVVYRKLMGKKGTFRDLGDSHPVLYQSLKDLLEYEGNVEDDMMITFQISQTDLFGNPMMYDLKENGDKIPITNENRKEFVNLYSDYILNKSVEKQFKAFRRGFHMVTNESPLKYLFRPEEIELLICGSRNLDFQALEETTEYDGGYTRDSVLIR

SEQ ID NO: 94675 - protein, 237 aa, Homo sapiens
  Payload ID: 18872
  Gene Name: ubiquitin protein ligase E3A
  ENSP ID: ENSP00000487534
MEYFANCFSIAFYRSGEPQSDDIEASRMKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVS

SEQ ID NO: 94676 - protein, 62 aa, Homo sapiens
  Payload ID: 18872
  Gene Name: ubiquitin protein ligase E3A
  ENSP ID: ENSP00000487550
MKRAAAKHLIERYYHQLTEGCGNEACTNEFCASCPTFLRMDNNAAAIKALELYKINAKLCDP

SEQ ID NO: 94677 - protein, 49 aa, Homo sapiens; identical to SEQ ID NO: 94671
  Payload ID: 18872
  Gene Name: ubiquitin protein ligase E3A
  ENSP ID: ENSP00000487552

SEQ ID NO: 94678 - protein, 1068 aa, Homo sapiens
  Payload ID: 18873
  Gene Name: ubiquitin protein ligase E3B
  Uniprot ID: Q7Z3V4
  ENSP ID: ENSP00000340596
MFTLSQTSRAWFIDRARQAREERLVQKERERAAVVIQAHVRSFLCRSRLQRDIRREIDDFFKADDPESTKRSALCIFKIARKLLFLFRIKEDNERFEKLCRSILSSMDAENEPKVWYVSLACSKDLTLLWIQQIKNILWYCCDFLKQLKPEILQDSRLITLYLTMLVTFTDTSTWKILRGKGESLRPAMNHICANIMGHLNQHGFYSVLQILLTRGLARPRPCLSKGTLTAAFSLALRPVIAAQFSDNLIRPFLIHIMSVPALVTHLSTVTPERLTVLESHDMLRKFIIFLRDQDRCRDVCESLEGCHTLCLMGNLLHLGSLSPRVLEEETDGFVSLLTQTLCYCRKYVSQKKSNLTHWHPVLGWFSQSVDYGLNESMHLITKQLQFLWGVPLIRIFFCDILSKKLLESQEPAHAQPASPQNVLPVKSLLKRAFQKSASVRNILRPVGGKRVDSAEVQKVCNICVLYQTSLTTLTQIRLQILTGLTYLDDLLPKLWAFICELGPHGGLKLFLECLNNDTEESKQLLAMLMLFCDCSRHLITILDDIEVYEEQISFKLEELVTISSFLNSFVFKMIWDGIVENAKGETLELFQSVHGWLMVLYERDCRRRFTPEDHWLRKDLKPSVLFQELDRDRKRAQLILQYIPHVIPHKNRVLLFRTMVTKEKEKLGLVETSSASPHVTHITIRRSRMLEDGYEQLRQLSQHAMKGVIRVKFVNDLGVDEAGIDQDGVFKEFLEEIIKRVFDPALNLFKTTSGDERLYPSPTSYIHENYLQLFEFVGKMLGKAVYEGIVVDVPFASFFLSQLLGHHHSVFYSSVDELPSLDSEFYKNLTSIKRYDGDITDLGLTLSYDEDVMGQLVCHELIPGGKTIPVTNENKISYIHLMAHFRMHTQIKNQTAALISGFRSIIKPEWIRMFSTPELQRLISGDNAEIDLEDLKKHTVYYGGFHGSHRVIIWLWDILASDFTPDERAMFLKFVTSCSRPPLLGFAYLKPPFSIRCVEVSDDQDTGDTLGSVLRGFFTIRKREPGGRLPTSSTCFNLLKLPNYSKKSVLREKLRYAISMNTGFELS

SEQ ID NO: 94679 - protein, 244 aa, Homo sapiens
  Payload ID: 18873
  Gene Name: ubiquitin protein ligase E3B
  Uniprot ID: Q7Z3V4
  ENSP ID: ENSP00000342614
MFTLSQTSRAWFIDRARQAREERLVQKERERAAVVIQAHVRSFLCRSRLQRDIRREIDDFFKADDPESTKRSALCIFKIARKLLFLFRIKEDNERFEKLCRSILSSMDAENEPKVWYVSLACSKDLTLLWIQQIKNILWYCCDFLKQLKPEILQDSRLITLYLTMLVTFTDTSTWKILRGKGESLRPAMNHICANIMGHLNQHGFYSVLQCCDGLFPDLVSYAPHNNPVRWSVGRSWYDWQLSR

SEQ ID NO: 94680 - protein, 1068 aa, Homo sapiens; identical to SEQ ID NO: 94678
  Payload ID: 18873
  Gene Name: ubiquitin protein ligase E3B
  Uniprot ID: Q7Z3V4
  ENSP ID: ENSP00000391529

SEQ ID NO: 94681 - protein, 708 aa, Homo sapiens
  Payload ID: 18873
  Gene Name: ubiquitin protein ligase E3B
  Uniprot ID: Q7Z3V4
  ENSP ID: ENSP00000395802
MFTLSQTSRAWFIDRARQAREERLVQKERERAAVVIQAHVRSFLCRSRLQRDIRREIDDFFKADDPESTKRSALCIFKIARKLLFLFRIKEDNERFEKLCRSILSSMDAENEPKVWYVSLACSKDLTLLWIQQIKNILWYCCDFLKQLKPEILQDSRLITLYLTMLVTFTDTSTWKILRGKGESLRPAMNHICANIMGHLNQHGFYSVLQILLTRGLARPRPCLSKGTLTAAFSLALRPVIAAQFSDNLIRPFLIHIMSVPALVTHLSTVTPERLTVLESHDMLRKFIIFLRDQDRCRDVCESLEGCHTLCLMGNLLHLGSLSPRVLEEETDGFVSLLTQTLCYCRKYVSQKKSNLTHWHPVLGWFSQSVDYGLNESMHLITKQLQFLWGVPLIRIFFCDILSKKLLESQEPAHAQPASPQNVLPVKSLLKRAFQKSASVRNILRPVGGKRVDSAEVQKVCNICVLYQTSLTTLTQIRLQILTGLTYLDDLLPKLWAFICELGPHGGLKLFLECLNNDTEESKQLLAMLMLFCDCSRHLITILDDIEVYEEQISFKLEELVTISSFLNSFVFKMIWDGIVENAKGETLELFQSVHGWLMVLYERDCRRRFTPEDHWLRKDLKPSVLFQELDRDRKRAQLILQYIPHVIPHKNRVLLFRTMVTKEKEKLGLVETSSASPHVTHITIRRSRMLESLFECPWPLVINAESC

SEQ ID NO: 94682 - protein, 247 aa, Homo sapiens
  Payload ID: 18873
  Gene Name: ubiquitin protein ligase E3B
  ENSP ID: ENSP00000437694
MFTLSQTSRAWFIDRARQAREERLVQKERERAAVVIQAHVRSFLCRSRLQRDIRREIDDFFKADDPESTKRSALCIFKIARKLLFLFRIKEDNERFEKLCRSILSSMDAENEPKVWYVSLACSKDLTLLWIQQIKNILWYCCDFLKQLKPEILQDSRLITLYLTMLVTFTDTSTWKILRGKGESLRPAMNHICANIMGHLNQHGFYSVLQVCDSCPPVCNFSTLQHLHLDFYICIQHTWCPPQKHFS

SEQ ID NO: 94683 - protein, 244 aa, Homo sapiens; identical to SEQ ID NO: 94679
  Payload ID: 18873
  Gene Name: ubiquitin protein ligase E3B
  Uniprot ID: Q7Z3V4
  ENSP ID: ENSP00000440585

SEQ ID NO: 94684 - protein, 871 aa, Homo sapiens
  Payload ID: 18873
  Gene Name: ubiquitin protein ligase E3B
  ENSP ID: ENSP00000443131
MFTLSQTSRAWFIDRARQAREERLVQKERERAAVVIQAHVRSFLCRSRLQRDIRREIDDFFKADDPESTKRSALCIFKIARKLLFLFRIKEDNERFEKLCRSILSSMDAENEPKVWYVSLACSKDLTLLWIQQIKNILWYCCDFLKQLKPEILQDSRLITLYLTMLVTFTDTSTWKILRGKGESLRPAMNHICANIMGHLNQHGFYSVLQILLTRGLARPRPCLSKGTLTAAFSLALRPVIAAQFSDNLIRPFLIHIMSVPALVTHLSTVTPERLTVLESHDMLRKFIIFLRDQDRCRDVCESLEGCHTLCLMGNLLHLGSLSPRVLEEETDGFVSLLTQTLCYCRKYVSQKKSNLTHWHPVLGWFSQSVDYGLNESMHLITKQLQFLWGVPLIRIFFCDILSKKLLESQEPAHAQPASPQNVLPVKSLLKRAFQKSASVRNILRPVGGKRVDSAEVQKVCNICVLYQTSLTTLTQIRLQILTGLTYLDDLLPKLWAFICELGPHGGLKLFLECLNNDTEESKQLLAMLMLFCDCSRHLITILDDIEVYEEQISFKLEELVTISSFLNSFVFKMIWDGIVENAKGETLELFQSVHGWLMVLYERDCRRRFTPEDHWLRKDLKPSVLFQELDRDRKRAQLILQYIPHVIPHKNRVLLFRTMVTKEKEKLGLVETSSASPHVTHITIRRSRMLEDGYEQLRQLSQHAMKGVIRVKFVNDLGVDEAGIDQDGVFKEFLEEIIKRVFDPALNLFKTTSGDERLYPSPTSYIHENYLQLFEFVGKMLGKAVYEGIVVDVPFASFFLSQLLGHHHSVFYSSVDELPSLDSEFYKNLTSIKRYDGDITDLGLTLSYDEDVMGQLVCHELIPGGKTIPV

SEQ ID NO: 94685 - protein, 244 aa, Homo sapiens; identical to SEQ ID NO: 94679
  Payload ID: 18873
  Gene Name: ubiquitin protein ligase E3B
  Uniprot ID: Q7Z3V4
  ENSP ID: ENSP00000443565

SEQ ID NO: 94686 - protein, 175 aa, Homo sapiens
  Payload ID: 18873
  Gene Name: ubiquitin protein ligase E3B
  ENSP ID: ENSP00000474360
TQIKNQTAALISGFRSIIKPEWIRMFSTPELQRLISGDNAEIDLEDLKKHTVYYGGFHGSHRVIIWLWDILASDFTPDERAMFLKFVTSCSRPPLLGFAYLKPPFSIRCVEVSDDQQGRQLDPSEPSEEGPTVLTAGEPASPRETAHGLSPLSAAPFSFLPQGRVPGVGVGTCCF

SEQ ID NO: 94687 - protein, 1083 aa, Homo sapiens
  Payload ID: 18874
  Gene Name: ubiquitin protein ligase E3C
  Uniprot ID: Q15386
  ENSP ID: ENSP00000309198
MFSFEGDFKTRPKVSLGGASRKEEKASLLHRTQEERRKREEERRRLKNAIIIQSFIRGYRDRKQQYSIQRSAFDRCATLSQSGGAFPIANGPNLTLLVRQLLFFYKQNEDSKRLIWLYQNLIKHSSLFVKQLDGSERLTCLFQIKRLMSLCCRLLQNCNDDSLNVALPMRMLEVFSSENTYLPVLQDASYVVSVIEQILHYMIHNGYYRSLYLLINSKLPSSIEYSDLSRVPIAKILLENVLKPLHFTYNSCPEGARQQVFTAFTEEFLAAPFTDQIFHFIIPALADAQTVFPYEPFLNALLLIESRCSRKSGGAPWLFYFVLTVGENYLGALSEEGLLVYLRVLQTFLSQLPVSPASASCHDSASDSEEESEEADKPSSPEDGRLSVSYITEECLKKLDTKQQTNTLLNLVWRDSASEEVFTTMASVCHTLMVQHRMMVPKVRLLYSLAFNARFLRHLWFLISSMSTRMITGSMVPLLQVISRGSPMSFEDSSRIIPLFYLFSSLFSHSLISIHDNEFFGDPIEVVGQRQSSMMPFTLEELIMLSRCLRDACLGIIKLAYPETKPEVREEYITAFQSIGVTTSSEMQQCIQMEQKRWIQLFKVITNLVKMLKSRDTRRNFCPPNHWLSEQEDIKADKVTQLYVPASRHVWRFRRMGRIGPLQSTLDVGLESPPLSVSEERQLAVLTELPFVVPFEERVKIFQRLIYADKQEVQGDGPFLDGINVTIRRNYIYEDAYDKLSPENEPDLKKRIRVHLLNAHGLDEAGIDGGGIFREFLNELLKSGFNPNQGFFKTTNEGLLYPNPAAQMLVGDSFARHYYFLGRMLGKALYENMLVELPFAGFFLSKLLGTSADVDIHHLASLDPEVYKNLLFLKSYEDDVEELGLNFTVVNNDLGEAQVVELKFGGKDIPVTSANRIAYIHLVADYRLNRQIRQHCLAFRQGLANVVSLEWLRMFDQQEIQVLISGAQVPISLEDLKSFTNYSGGYSADHPVIKVFWRVVEGFTDEEKRKLLKFVTSCSRPPLLGFKELYPAFCIHNGGSDLERLPTASTCMNLLKLPEFYDETLLRSKLLYAIECAAGFELS

SEQ ID NO: 94688 - protein, 404 aa, Homo sapiens
  Payload ID: 18874
  Gene Name: ubiquitin protein ligase E3C
  Uniprot ID: Q15386
  ENSP ID: ENSP00000373755
MFSFEGDFKTRPKVSLGGASRKYSIQRSAFDRCATLSQSGGAFPIANGPNLTLLVRQLLFFYKQNEDSKRLIWLYQNLIKHSSLFVKQLDGSERLTCLFQIKRLMSLCCRLLQNCNDDSLNVALPMRMLEVFSSENTYLPVLQDASYVVSVIEQILHYMIHNGYYRSLYLLINSKLPSSIEYSDLSRVPIAKILLENVLKPLHFTYNSCPEGARQQVFTAFTEEFLAAPFTDQIFHFIIPALADAQTVFPYEPFLNALLLIESRCSRKSGGAPWLFYFVLTVGENYLGALSEEGLLVYLRVLQTFLSQLPVSPASASCHDSASDSEEESEEADKPSSPEDGRLSVSYITEECLKKLDTKQQTNTLLNLVWRDSASEEVFTTMASVCHTLMVQHRMMVPKVRVYK

SEQ ID NO: 94689 - protein, 56 aa, Homo sapiens
  Payload ID: 18874
  Gene Name: ubiquitin protein ligase E3C
  ENSP ID: ENSP00000397432
SFEGDFKTRPKVSLGGASRKEEKASLLHRTQEERRKRECWDYRRELPRLADDVDVS

SEQ ID NO: 94690 - protein, 404 aa, Homo sapiens; identical to SEQ ID NO: 94688
  Payload ID: 18874
  Gene Name: ubiquitin protein ligase E3C
  Uniprot ID: Q15386
  ENSP ID: ENSP00000481584

SEQ ID NO: 94691 - protein, 36 aa, Homo sapiens
  Payload ID: 18875
  Gene Name: ubiquitin protein ligase E3D
  ENSP ID: ENSP00000237186
MAASAAETRVFLERTERRRYAHEYFHNAIFTPDENP

SEQ ID NO: 94692 - protein, 183 aa, Homo sapiens
  Payload ID: 18875
  Gene Name: ubiquitin protein ligase E3D
  ENSP ID: ENSP00000358761
  MOD_RES (1)..(1): Any amino acid
XQMKTPEGCTEIQLPAEVRLVPSSCRGLQFVVGDGLHLRLQTQAKLGTKLISMFNQSSQTQECCTFYCQSCGEVIIKDRKLLRVLPLPSENWGALVGEWCCHPDPFANKSLHPQENDCFIGDSFFLVNLRTSLWQQRPELSPVEMCCVSSDNHCKLEPKANTKVICKRCKVMLGETVSSARSC

SEQ ID NO: 94693 - protein, 389 aa, Homo sapiens
  Payload ID: 18875
  Gene Name: ubiquitin protein ligase E3D
  Uniprot ID: Q7Z6J8
  ENSP ID: ENSP00000358762
MAASAAETRVFLEVRGQLQSALLILGEPKEGGMPMNISIMPSSLQMKTPEGCTEIQLPAEVRLVPSSCRGLQFVVGDGLHLRLQTQAKLGTKLISMFNQSSQTQECCTFYCQSCGEVIIKDRKLLRVLPLPSENWGALVGEWCCHPDPFANKSLHPQENDCFIGDSFFLVNLRTSLWQQRPELSPVEMCCVSSDNHCKLEPKANTKVICKRCKVMLGETVSSETTKFYMTEIIIQSSERSFPIIPRSWFVQSVIAQCLVQLSSARSTFRFTIQGQDDKVYILLWLLNSDSLVIESLRNSKYIKKFPLLENTFKADSSSAWSAVKVLYQPCIKSRNEKLVSLWESDISVHPLTLPSATCLELLLILSKSNANLPSSLRRVNSFQVAFLKM

SEQ ID NO: 94694 - protein, 122 aa, Homo sapiens
  Payload ID: 18875
  Gene Name: ubiquitin protein ligase E3D
  ENSP ID: ENSP00000394749
MAASAAETRVFLEVRGQLQSALLILGEPKEGGMPMNISIMPSSLQMKTPEGCTEIQLPAEVRLVPSSCRGLQFVVGDGLHLRLQTQAKLGTKLISMFNQSSQTQECCTFYCQSCGEVIIKDR

SEQ ID NO: 94695 - protein, 37 aa, Homo sapiens
  Payload ID: 18875
  Gene Name: ubiquitin protein ligase E3D
  ENSP ID: ENSP00000422755
MAASAAETRVFLEVRGQLQSALLILGDRVSPYCPCWS

SEQ ID NO: 94696 - protein, 284 aa, Homo sapiens
  Payload ID: 18875
  Gene Name: ubiquitin protein ligase E3D
  ENSP ID: ENSP00000427101
MAASAAETRVFLEVRGQLQSALLILGEPKEGGMPMNISIMPSSLQMKTPEGCTEIQLPAEVRLVPSSCRGLQFVVGDGLHLRLQTQAKLGTKLISMFNQSSQTQECCTFYCQSCGEVIIKDRKLLRVLPLPSENWGALVGEWCCHPDPFANKSLHPQENDCFIGDSFFLVNLRTSLWQQRPELSPVEMCCVSSDNHCKLEPKANTKVICKRCKVMLGETVSSETTKFYMTEIIIQSSERSFPIIPRSWFVQSVIAQCLVQLSSARSTFRFTIQAMAFKFRQFGD

SEQ ID NO: 94697 - protein, 37 aa, Homo sapiens; identical to SEQ ID NO: 94695
  Payload ID: 18875
  Gene Name: ubiquitin protein ligase E3D
  ENSP ID: ENSP00000487457

SEQ ID NO: 94698 - protein, 63 aa, Homo sapiens
  Payload ID: 18876
  Gene Name: ubiquitin related modifier 1
  ENSP ID: ENSP00000361938
MAAPLSVEVEFGSSPGCLFLWSSFAEVVRSSCLTVLRNIESLCLDRRNPGTSGTCSSGSRRIC

SEQ ID NO: 94699 - protein, 63 aa, Homo sapiens
  Payload ID: 18876
  Gene Name: ubiquitin related modifier 1
  Uniprot ID: Q9BTM9
  ENSP ID: ENSP00000361941
MAAPLSVEVEFGGGAELLFDGIKKHRVTLPGQEEPWDIRNLLIWIKKNLLKERPELFIQGDSV

SEQ ID NO: 94700 - protein, 101 aa, Homo sapiens
  Payload ID: 18876
  Gene Name: ubiquitin related modifier 1
  Uniprot ID: Q9BTM9
  ENSP ID: ENSP00000361944
MAAPLSVEVEFGGGAELLFDGIKKHRVTLPGQEEPWDIRNLLIWIKKNLLKERPELFIQGDSVRPGILVLINDADWELLGELDYQLQDQDSVLFISTLHGG

SEQ ID NO: 94701 - protein, 146 aa, Homo sapiens
  Payload ID: 18876
  Gene Name: ubiquitin related modifier 1
  Uniprot ID: Q9BTM9
  ENSP ID: ENSP00000412922
MAAPLSVEVEFGGGAELLFDGIKKHRVTLPGQEEPWDIRNLLIWIKKNLLKERPELFIQGDSVRPGILVLINDADWELLVSTLGDIPPPAPALAASVGKRWASPQAHIEWLGNPPPHSSPTLRLLESPTPGEEGMGSWGHGSTPPS

SEQ ID NO: 94702 - protein, 63 aa, Homo sapiens; identical to SEQ ID NO: 94698
  Payload ID: 18876
  Gene Name: ubiquitin related modifier 1
  ENSP ID: ENSP00000435186

SEQ ID NO: 94703 - protein, 785 aa, Homo sapiens
  Payload ID: 18877
  Gene Name: ubiquitin specific peptidase 1
  Uniprot ID: O94782
  ENSP ID: ENSP00000343526
MPGVIPSESNGLSRGSPSKKNRLSLKFFQKKETKRALDFTDSQENEEKASEYRASEIDQVVPAAQSSPINCEKRENLLPFVGLNNLGNTCYLNSILQVLYFCPGFKSGVKHLFNIISRKKEALKDEANQKDKGNCKEDSLASYELICSLQSLIISVEQLQASFLLNPEKYTDELATQPRRLLNTLRELNPMYEGYLQHDAQEVLQCILGNIQETCQLLKKEEVKNVAELPTKVEEIPHPKEEMNGINSIEMDSMRHSEDFKEKLPKGNGKRKSDTEFGNMKKKVKLSKEHQSLEENQRQTRSKRKATSDTLESPPKIIPKYISENESPRPSQKKSRVKINWLKSATKQPSILSKFCSLGKITTNQGVKGQSKENECDPEEDLGKCESDNTTNGCGLESPGNTVTPVNVNEVKPINKGEEQIGFELVEKLFQGQLVLRTRCLECESLTERREDFQDISVPVQEDELSKVEESSEISPEPKTEMKTLRWAISQFASVERIVGEDKYFCENCHHYTEAERSLLFDKMPEVITIHLKCFAASGLEFDCYGGGLSKINTPLLTPLKLSLEEWSTKPTNDSYGLFAVVMHSGITISSGHYTASVKVTDLNSLELDKGNFVVDQMCEIGKPEPLNEEEARGVVENYNDEEVSIRVGGNTQPSKVLNKKNVEAIGLLGGQKSKADYELYNKASNPDKVASTAFAENRNSETSDTTGTHESDRNKESSDQTGINISGFENKISYVVQSLKEYEGKWLLFDDSEVKVTEEKDFLNSLSPSTSPTSTPYLLFYKKL

SEQ ID NO: 94704 - protein, 785 aa, Homo sapiens; identical to SEQ ID NO: 94703
  Payload ID: 18877
  Gene Name: ubiquitin specific peptidase 1
  Uniprot ID: O94782
  ENSP ID: ENSP00000360188

SEQ ID NO: 94705 - protein, 87 aa, Homo sapiens
  Payload ID: 18877
  Gene Name: ubiquitin specific peptidase 1
  ENSP ID: ENSP00000387986
MPGVIPSESNGLSRGSPSKKNRLSLKFFQKKETKRALDFTDSQENEEKASEYRASEIDQVVPAAQSSPINCEKRENLLPFVGLNNLG

SEQ ID NO: 94706 - protein, 186 aa, Homo sapiens
  Payload ID: 18877
  Gene Name: ubiquitin specific peptidase 1
  ENSP ID: ENSP00000403662
MPGVIPSESNGLSRGSPSKKNRLSLKFFQKKETKRALDFTDSQENEEKASEYRASEIDQVVPAAQSSPINCEKRENLLPFVGLNNLGNTCYLNSILQVLYFCPGFKSGVKHLFNIISRKKEALKDEANQKDKGNCKEDSLASYELICSLQSLIISVEQLQASFLLNPEKYTDELATQPRRLLNTLR

SEQ ID NO: 94707 - protein, 798 aa, Homo sapiens
  Payload ID: 18878
  Gene Name: ubiquitin specific peptidase 10
  Uniprot ID: Q14694
  ENSP ID: ENSP00000219473
MALHSPQYIFGDFSPDEFNQFFVTPRSSVELPPYSGTVLCGTQAVDKLPDGQEYQRIEFGVDEVIEPSDTLPRTPSYSISSTLNPQAPEFILGCTASKITPDGITKEASYGSIDCQYPGSALALDGSSNVEAEVLENDGVSGGLGQRERKKKKKRPPGYYSYLKDGGDDSISTEALVNGHANSAVPNSVSAEDAEFMGDMPPSVTPRTCNSPQNSTDSVSDIVPDSPFPGALGSDTRTAGQPEGGPGADFGQSCFPAEAGRDTLSRTAGAQPCVGTDTTENLGVANGQILESSGEGTATNGVELHTTESIDLDPTKPESASPPADGTGSASGTLPVSQPKSWASLFHDSKPSSSSPVAYVETKYSPPAISPLVSEKQVEVKEGLVPVSEDPVAIKIAELLENVTLIHKPVSLQPRGLINKGNWCYINATLQALVACPPMYHLMKFIPLYSKVQRPCTSTPMIDSFVRLMNEFTNMPVPPKPRQALGDKIVRDIRPGAAFEPTYIYRLLTVNKSSLSEKGRQEDAEEYLGFILNGLHEEMLNLKKLLSPSNEKLTISNGPKNHSVNEEEQEEQGEGSEDEWEQVGPRNKTSVTRQADFVQTPITGIFGGHIRSVVYQQSSKESATLQPFFTLQLDIQSDKIRTVQDALESLVARESVQGYTTKTKQEVEISRRVTLEKLPPVLVLHLKRFVYEKTGGCQKLIKNIEYPVDLEISKELLSPGVKNKNFKCHRTYRLFAVVYHHGNSATGGHYTTDVFQIGLNGWLRIDDQTVKVINQYQVVKPTAERTAYLLYYRRVDLL

SEQ ID NO: 94708 - protein, 62 aa, Homo sapiens
  Payload ID: 18878
  Gene Name: ubiquitin specific peptidase 10
  ENSP ID: ENSP00000445589
MALHSPQYIFGDFSPDEFNQFFVTPRSSVEDKNIRELSLVSMKSLNPVTLCREPPATVFQAH

SEQ ID NO: 94709 - protein, 150 aa, Homo sapiens
  Payload ID: 18878
  Gene Name: ubiquitin specific peptidase 10
  ENSP ID: ENSP00000454751
MALHSPQYIFGDFSPDEFNQFFVTPRSSVEGRQEDAEEYLGFILNGLHEEMLNLKKLLSPSNEKLTISNGPKNHSVNEEEQEEQGEGSEDEWEQVGPRNKTSVTRQADFVQTPITGIFGGHIRSVVYQQSSKESATLQPFFTLQLDIQSD

SEQ ID NO: 94710 - protein, 35 aa, Homo sapiens
  Payload ID: 18878
  Gene Name: ubiquitin specific peptidase 10
  ENSP ID: ENSP00000454902
MALHSPQYIFGDFSPDEFNQFFVTPRSSVESCWRM

SEQ ID NO: 94711 - protein, 63 aa, Homo sapiens
  Payload ID: 18878
  Gene Name: ubiquitin specific peptidase 10
  ENSP ID: ENSP00000454943
MALHSPQMESGSVAPAGVRWRDLSSLQPRPPWFKQFSWLSLPSSRDYSIFLEILALMNSINSL

SEQ ID NO: 94712 - protein, 76 aa, Homo sapiens
  Payload ID: 18878
  Gene Name: ubiquitin specific peptidase 10
  ENSP ID: ENSP00000454987
  MOD_RES (1)..(1): Any amino acid
XQSDKIRTVQDALESLVARESVQGYTTKTKQENCFLQGLKIRILNATEPIGSLQWSTITATVRRAAITLQTSSRSV

SEQ ID NO: 94713 - protein, 141 aa, Homo sapiens
  Payload ID: 18878
  Gene Name: ubiquitin specific peptidase 10
  ENSP ID: ENSP00000455712
MSQQKDFSPDEFNQFFVTPRSSVELPPYSGTVLCGTQAVDKLPDGQEYQRIEFGVDEVIEPSDTLPRTPSYSISSTLNPQAPEFILGCTASKITPDGITKEASYGSIDCQYPGSALALDGSSNVEAEVLENDGVSGGLGQR

SEQ ID NO: 94714 - protein, 110 aa, Homo sapiens
  Payload ID: 18878
  Gene Name: ubiquitin specific peptidase 10
  ENSP ID: ENSP00000455865
  MOD_RES (1)..(1): Any amino acid
XSDKIRTVQDALESLVARESVQGYTTKTKQEVEISRRVTLEKLPPVLVLHLKRFVYEKTGGCQKLIKNIEYPVDLEISKVVYHHGNSATGGHYTTDVFQIGLNGWLRIDD

SEQ ID NO: 94715 - protein, 802 aa, Homo sapiens
  Payload ID: 18878
  Gene Name: ubiquitin specific peptidase 10
  Uniprot ID: Q14694
  ENSP ID: ENSP00000457411
MPWLPSPGIGQYIFGDFSPDEFNQFFVTPRSSVELPPYSGTVLCGTQAVDKLPDGQEYQRIEFGVDEVIEPSDTLPRTPSYSISSTLNPQAPEFILGCTASKITPDGITKEASYGSIDCQYPGSALALDGSSNVEAEVLENDGVSGGLGQRERKKKKKRPPGYYSYLKDGGDDSISTEALVNGHANSAVPNSVSAEDAEFMGDMPPSVTPRTCNSPQNSTDSVSDIVPDSPFPGALGSDTRTAGQPEGGPGADFGQSCFPAEAGRDTLSRTAGAQPCVGTDTTENLGVANGQILESSGEGTATNGVELHTTESIDLDPTKPESASPPADGTGSASGTLPVSQPKSWASLFHDSKPSSSSPVAYVETKYSPPAISPLVSEKQVEVKEGLVPVSEDPVAIKIAELLENVTLIHKPVSLQPRGLINKGNWCYINATLQALVACPPMYHLMKFIPLYSKVQRPCTSTPMIDSFVRLMNEFTNMPVPPKPRQALGDKIVRDIRPGAAFEPTYIYRLLTVNKSSLSEKGRQEDAEEYLGFILNGLHEEMLNLKKLLSPSNEKLTISNGPKNHSVNEEEQEEQGEGSEDEWEQVGPRNKTSVTRQADFVQTPITGIFGGHIRSVVYQQSSKESATLQPFFTLQLDIQSDKIRTVQDALESLVARESVQGYTTKTKQEVEISRRVTLEKLPPVLVLHLKRFVYEKTGGCQKLIKNIEYPVDLEISKELLSPGVKNKNFKCHRTYRLFAVVYHHGNSATGGHYTTDVFQIGLNGWLRIDDQTVKVINQYQVVKPTAERTAYLLYYRRVDLL

SEQ ID NO: 94716 - protein, 158 aa, Homo sapiens
  Payload ID: 18878
  Gene Name: ubiquitin specific peptidase 10
  ENSP ID: ENSP00000458089
MALHSPQYIFGDFSPDEFNQFFVTPRSSVELPPYSGTVLCGTQAVDKLPDELLENVTLIHKPVSLQPRGLINKGNWCYINATLQALVACPPMYHLMKFIPLYSKVQRPCTSTPMIDSFVRLMNEFTNMPVPPKPRQALGDKIVRDIRPGAAFEPTYIY

SEQ ID NO: 94717 - protein, 208 aa, Homo sapiens
  Payload ID: 18878
  Gene Name: ubiquitin specific peptidase 10
  ENSP ID: ENSP00000462762
MEVEVKEGLVPVSEDPVAIKIAELLENVTLIHKPVSLQPRGLINKGNWCYINATLQALVACPPMYHLMKFIPLYSKVQRPCTSTPMIDSFVRLMNEFTNMPVPPKPRQALGDKIVRDIRPGAAFEPTYIYRLLTVNKSSLSEKGRQEDAEEYLGFILNGLHEEMLNLKKLLSPSNEKLTISNGPKNHSVNEEEQEEQAIFHVAVGYPV

SEQ ID NO: 94718 - protein, 963 aa, Homo sapiens
  Payload ID: 18879
  Gene Name: ubiquitin specific peptidase 11
  Uniprot ID: P51784
  ENSP ID: ENSP00000218348
MAVAPRLFGGLCFRFRDQNPEVAVEGRLPISHSCVGCRRERTAMATVAANPAAAAAAVAAAAAVTEDREPQHEELPGLDSQWRQIENGESGRERPLRAGESWFLVEKHWYKQWEAYVQGGDQDSSTFPGCINNATLFQDEINWRLKEGLVEGEDYVLLPAAAWHYLVSWYGLEHGQPPIERKVIELPNIQKVEVYPVELLLVRHNDLGKSHTVQFSHTDSIGLVLRTARERFLVEPQEDTRLWAKNSEGSLDRLYDTHITVLDAALETGQLIIMETRKKDGTWPSAQLHVMNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 94719 - protein, 140 aa, Homo sapiens
  Payload ID: 18879
  Gene Name: ubiquitin specific peptidase 11
  ENSP ID: ENSP00000366279
METRKKDGTWPSAQLHVMNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLH

SEQ ID NO: 94720 - protein, 49 aa, Homo sapiens
  Payload ID: 18879
  Gene Name: ubiquitin specific peptidase 11
  ENSP ID: ENSP00000366282
METRKKDGTWPSAQLHVMNNNMSEEDEDFKGQPGICGLTNLGNTCFMNS

SEQ ID NO: 94721 - protein, 920 aa, Homo sapiens
  Payload ID: 18879
  Gene Name: ubiquitin specific peptidase 11
  ENSP ID: ENSP00000366311
MATVAANPAAAAAAVAAAAAVTEDREPQHEELPGLDSQWRQIENGESGRERPLRAGESWFLVEKHWYKQWEAYVQGGDQDSSTFPGCINNATLFQDEINWRLKEGLVEGEDYVLLPAAAWHYLVSWYGLEHGQPPIERKVIELPNIQKVEVYPVELLLVRHNDLGKSHTVQFSHTDSIGLVLRTARERFLVEPQEDTRLWAKNSEGSLDRLYDTHITVLDAALETGQLIIMETRKKDGTWPSAQLHVMNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 94722 - protein, 370 aa, Homo sapiens
  Payload ID: 18880
  Gene Name: ubiquitin specific peptidase 12
  Uniprot ID: O75317
  ENSP ID: ENSP00000282344
MEILMTVSKFASICTMGANASALEKEIGPEQFPVNEHYFGLVNFGNTCYCNSVLQALYFCRPFREKVLAYKSQPRKKESLLTCLADLFHSIATQKKKVGVIPPKKFITRLRKENELFDNYMQQDAHEFLNYLLNTIADILQEERKQEKQNGRLPNGNIDNENNNSTPDPTWVHEIFQGTLTNETRCLTCETISSKDEDFLDLSVDVEQNTSITHCLRGFSNTETLCSEYKYYCEECRSKQEAHKRMKVKKLPMILALHLKRFKYMDQLHRYTKLSYRVVFPLELRLFNTSGDATNPDRMYDLVAVVVHCGSGPNRGHYIAIVKSHDFWLLFDDDIVEKIDAQAIEEFYGLTSDISKNSESGYILFYQSRD

SEQ ID NO: 94723 - protein, 18 aa, Homo sapiens
  Payload ID: 18880
  Gene Name: ubiquitin specific peptidase 12
  ENSP ID: ENSP00000478929
MEILMTVSKFASICTMEW

SEQ ID NO: 94724 - protein, 90 aa, Homo sapiens
  Payload ID: 18880
  Gene Name: ubiquitin specific peptidase 12
  ENSP ID: ENSP00000480395
  MOD_RES (1)..(1): Any amino acid
XNIDNENNNSTPDPTWVHEIFQGTLTNETRCLTCETISSKDEDFLDLSVDVEQNTSITHCLRGFSNTETLCSEYKYYCEECRSKQEAHKR

SEQ ID NO: 94725 - protein, 863 aa, Homo sapiens
  Payload ID: 18881
  Gene Name: ubiquitin specific peptidase 13 (isopeptidase T-3)
  Uniprot ID: Q92995
  ENSP ID: ENSP00000263966
MQRRGALFGMPGGSGGRKMAAGDIGELLVPHMPTIRVPRSGDRVYKNECAFSYDSPNSEGGLYVCMNTFLAFGREHVERHFRKTGQSVYMHLKRHVREKVRGASGGALPKRRNSKIFLDLDTDDDLNSDDYEYEDEAKLVIFPDHYEIALPNIEELPALVTIACDAVLSSKSPYRKQDPDTWENELPVSKYANNLTQLDNGVRIPPSGWKCARCDLRENLWLNLTDGSVLCGKWFFDSSGGNGHALEHYRDMGYPLAVKLGTITPDGADVYSFQEEEPVLDPHLAKHLAHFGIDMLHMHGTENGLQDNDIKLRVSEWEVIQESGTKLKPMYGPGYTGLKNLGNSCYLSSVMQAIFSIPEFQRAYVGNLPRIFDYSPLDPTQDFNTQMTKLGHGLLSGQYSKPPVKSELIEQVMKEEHKPQQNGISPRMFKAFVSKSHPEFSSNRQQDAQEFFLHLVNLVERNRIGSENPSDVFRFLVEERIQCCQTRKVRYTERVDYLMQLPVAMEAATNKDELIAYELTRREAEANRRPLPELVRAKIPFSACLQAFSEPENVDDFWSSALQAKSAGVKTSRFASFPEYLVVQIKKFTFGLDWVPKKFDVSIDMPDLLDINHLRARGLQPGEEELPDISPPIVIPDDSKDRLMNQLIDPSDIDESSVMQLAEMGFPLEACRKAVYFTGNMGAEVAFNWIIVHMEEPDFAEPLTMPGYGGAASAGASVFGASGLDNQPPEEIVAIITSMGFQRNQAIQALRATNNNLERALDWIFSHPEFEEDSDFVIEMENNANANIISEAKPEGPRVKDGSGTYELFAFISHMGTSTMSGHYICHIKKEGRWVIYNDHKVCASERPPKDLGYMYFYRRIPS

SEQ ID NO: 94726 - protein, 798 aa, Homo sapiens
  Payload ID: 18881
  Gene Name: ubiquitin specific peptidase 13 (isopeptidase T-3)
  Uniprot ID: Q92995
  ENSP ID: ENSP00000417146
MNTFLAFGREHVERHFRKTGQSVYMHLKRHVREKVRGASGGALPKRRNSKIFLDLDTDDDLNSDDYEYEDEAKLVIFPDHYEIALPNIEELPALVTIACDAVLSSKSPYRKQDPDTWENELPVSKYANNLTQLDNGVRIPPSGWKCARCDLRENLWLNLTDGSVLCGKWFFDSSGGNGHALEHYRDMGYPLAVKLGTITPDGADVYSFQEEEPVLDPHLAKHLAHFGIDMLHMHGTENGLQDNDIKLRVSEWEVIQESGTKLKPMYGPGYTGLKNLGNSCYLSSVMQAIFSIPEFQRAYVGNLPRIFDYSPLDPTQDFNTQMTKLGHGLLSGQYSKPPVKSELIEQVMKEEHKPQQNGISPRMFKAFVSKSHPEFSSNRQQDAQEFFLHLVNLVERNRIGSENPSDVFRFLVEERIQCCQTRKVRYTERVDYLMQLPVAMEAATNKDELIAYELTRREAEANRRPLPELVRAKIPFSACLQAFSEPENVDDFWSSALQAKSAGVKTSRFASFPEYLVVQIKKFTFGLDWVPKKFDVSIDMPDLLDINHLRARGLQPGEEELPDISPPIVIPDDSKDRLMNQLIDPSDIDESSVMQLAEMGFPLEACRKAVYFTGNMGAEVAFNWIIVHMEEPDFAEPLTMPGYGGAASAGASVFGASGLDNQPPEEIVAIITSMGFQRNQAIQALRATNNNLERALDWIFSHPEFEEDSDFVIEMENNANANIISEAKPEGPRVKDGSGTYELFAFISHMGTSTMSGHYICHIKKEGRWVIYNDHKVCASERPPKDLGYMYFYRRIPS

SEQ ID NO: 94727 - protein, 75 aa, Homo sapiens
  Payload ID: 18881
  Gene Name: ubiquitin specific peptidase 13 (isopeptidase T-3)
  ENSP ID: ENSP00000418651
GELLVPHMPTIRVPRSGDRVYKNECAFSYDSPNSEGGLYVCMNTFLAFGREHVERHFRKTGQSVYMHLKRHVREI

SEQ ID NO: 94728 - protein, 299 aa, Homo sapiens
  Payload ID: 18881
  Gene Name: ubiquitin specific peptidase 13 (isopeptidase T-3)
  ENSP ID: ENSP00000420057
FSIPEFQRAYVGNLPRIFDYSPLDPTQDFNTQMTKLGHGLLSGQYSKPPVKSELIEQVMKEEHKPQQNGISPRMFKAFVSKSHPEFSSNRQQDAQEFFLHLVNLVERNRIGSENPSDVFRFLVEERIQCCQTRKVRYTERVDYLMQLPVAMEAATNKDELIAYELTRREAEANRRPLPELVRAKIPFSACLQAFSEPENVDDFWSSALQAKSAGVKTSRFASFPEYLVVQIKKFTFGLDWVPKKFDVSIDMPDLLDINHLRARGLQPGEEELPDISPPIVIPDDSKASDIDESSVMQLA

SEQ ID NO: 94729 - protein, 494 aa, Homo sapiens
  Payload ID: 18882
  Gene Name: ubiquitin specific peptidase 14 (tRNA-guanine transglycosylase)
  Uniprot ID: P54578
  ENSP ID: ENSP00000261601
MPLYSVTVKWGKEKFEGVELNTDEPPMVFKAQLFALTGVQPARQKVMVKGGTLKDDDWGNIKIKNGMTLLMMGSADALPEEPSAKTVFVEDMTEEQLASAMELPCGLTNLGNTCYMNATVQCIRSVPELKDALKRYAGALRASGEMASAQYITAALRDLFDSMDKTSSSIPPIILLQFLHMAFPQFAEKGEQGQYLQQDANECWIQMMRVLQQKLEAIEDDSVKETDSSSASAATPSKKKSLIDQFFGVEFETTMKCTESEEEEVTKGKENQLQLSCFINQEVKYLFTGLKLRLQEEITKQSPTLQRNALYIKSSKISRLPAYLTIQMVRFFYKEKESVNAKVLKDVKFPLMLDMYELCTPELQEKMVSFRSKFKDLEDKKVNQQPNTSDKKSSPQKEVKYEPFSFADDIGSNNCGYYDLQAVLTHQGRSSSSGHYVSWVKRKQDEWIKFDDDKVSIVTPEDILRLSGGGDWHIAYVLLYGPRRVEIMEEESEQ

SEQ ID NO: 94730 - protein, 448 aa, Homo sapiens
  Payload ID: 18882
  Gene Name: ubiquitin specific peptidase 14 (tRNA-guanine transglycosylase)
  ENSP ID: ENSP00000373083
MPLYSVTVKWGKEKFEGVELNTDEPPMVFKAQLFALTGVQPARQKVMVKGGTLKMELPCGLTNLGNTCYMNATVQCIRSVPELKDALKRYAGALRASGEMASAQYITAALRDLFDSMDKTSSSIPPIILLQFLHMAFPQFAEKGEQGQYLQQDANECWIQMMRVLQQKLEAIEDDSVKETDSSSASAATPSKKKSLIDQFFGVEFETTMKCTESEEEEVTKGKENQLQLSCFINQEVKYLFTGLKLRLQEEITKQSPTLQRNALYIKSSKISRLPAYLTIQMVRFFYKEKESVNAKVLKDVKFPLMLDMYELCTPELQEKMVSFRSKFKDLEDKKVNQQPNTSDKKSSPQKEVKYEPFSFADDIGSNNCGYYDLQAVLTHQGRSSSSGHYVSWVKRKQDEWIKFDDDKVSIVTPEDILRLSGGGDWHIAYVLLYGPRRVEIMEEESEQ

SEQ ID NO: 94731 - protein, 483 aa, Homo sapiens
  Payload ID: 18882
  Gene Name: ubiquitin specific peptidase 14 (tRNA-guanine transglycosylase)
  Uniprot ID: P54578
  ENSP ID: ENSP00000383125
MPLYSVTVKWGKEKFEGVELNTDEPPMVFKAQLFALTGVQPARQKVMVKGGTLKGMTLLMMGSADALPEEPSAKTVFVEDMTEEQLASAMELPCGLTNLGNTCYMNATVQCIRSVPELKDALKRYAGALRASGEMASAQYITAALRDLFDSMDKTSSSIPPIILLQFLHMAFPQFAEKGEQGQYLQQDANECWIQMMRVLQQKLEAIEDDSVKETDSSSASAATPSKKKSLIDQFFGVEFETTMKCTESEEEEVTKGKENQLQLSCFINQEVKYLFTGLKLRLQEEITKQSPTLQRNALYIKSSKISRLPAYLTIQMVRFFYKEKESVNAKVLKDVKFPLMLDMYELCTPELQEKMVSFRSKFKDLEDKKVNQQPNTSDKKSSPQKEVKYEPFSFADDIGSNNCGYYDLQAVLTHQGRSSSSGHYVSWVKRKQDEWIKFDDDKVSIVTPEDILRLSGGGDWHIAYVLLYGPRRVEIMEEESEQ

SEQ ID NO: 94732 - protein, 28 aa, Homo sapiens
  Payload ID: 18882
  Gene Name: ubiquitin specific peptidase 14 (tRNA-guanine transglycosylase)
  ENSP ID: ENSP00000462315
MVFKAQLFALTGVQPARQKVMVKGGTLK

SEQ ID NO: 94733 - protein, 20 aa, Homo sapiens
  Payload ID: 18882
  Gene Name: ubiquitin specific peptidase 14 (tRNA-guanine transglycosylase)
  ENSP ID: ENSP00000463891
MVFKAQLFALTGVQPARQKV

SEQ ID NO: 94734 - protein, 459 aa, Homo sapiens
  Payload ID: 18882
  Gene Name: ubiquitin specific peptidase 14 (tRNA-guanine transglycosylase)
  Uniprot ID: P54578
  ENSP ID: ENSP00000464447
MPLYSVTVKWGKEKFEGVELNTDEPPMVFKAQLFALTGVQPARQKVMVKGGTLKDDDWGNIKIKNMELPCGLTNLGNTCYMNATVQCIRSVPELKDALKRYAGALRASGEMASAQYITAALRDLFDSMDKTSSSIPPIILLQFLHMAFPQFAEKGEQGQYLQQDANECWIQMMRVLQQKLEAIEDDSVKETDSSSASAATPSKKKSLIDQFFGVEFETTMKCTESEEEEVTKGKENQLQLSCFINQEVKYLFTGLKLRLQEEITKQSPTLQRNALYIKSSKISRLPAYLTIQMVRFFYKEKESVNAKVLKDVKFPLMLDMYELCTPELQEKMVSFRSKFKDLEDKKVNQQPNTSDKKSSPQKEVKYEPFSFADDIGSNNCGYYDLQAVLTHQGRSSSSGHYVSWVKRKQDEWIKFDDDKVSIVTPEDILRLSGGGDWHIAYVLLYGPRRVEIMEEESEQ

SEQ ID NO: 94735 - protein, 33 aa, Homo sapiens
  Payload ID: 18882
  Gene Name: ubiquitin specific peptidase 14 (tRNA-guanine transglycosylase)
  ENSP ID: ENSP00000473563
  MOD_RES (1)..(1): Any amino acid
XALTGVQPARQKVMVKGGTLKDFHEITFFKNRE

SEQ ID NO: 94736 - protein, 952 aa, Homo sapiens
  Payload ID: 18883
  Gene Name: ubiquitin specific peptidase 15
  Uniprot ID: Q9Y4E8
  ENSP ID: ENSP00000258123
MAEGGAADLDTQRSDIATLLKTSLRKGDTWYLVDSRWFKQWKKYVGFDSWDKYQMGDQNVYPGPIDNSGLLKDGDAQSLKEHLIDELDYILLPTEGWNKLVSWYTLMEGQEPIARKVVEQGMFVKHCKVEVYLTELKLCENGNMNNVVTRRFSKADTIDTIEKEIRKIFSIPDEKETRLWNKYMSNTFEPLNKPDSTIQDAGLYQGQVLVIEQKNEDGTWPRGPSTPNVKNSNYCLPSYTAYKNYDYSEPGRNNEQPGLCGLSNLGNTCFMNSAIQCLSNTPPLTEYFLNDKYQEELNFDNPLGMRGEIAKSYAELIKQMWSGKFSYVTPRAFKTQVGRFAPQFSGYQQQDCQELLAFLLDGLHEDLNRIRKKPYIQLKDADGRPDKVVAEEAWENHLKRNDSIIVDIFHGLFKSTLVCPECAKISVTFDPFCYLTLPLPMKKERTLEVYLVRMDPLTKPMQYKVVVPKIGNILDLCTALSALSGIPADKMIVTDIYNHRFHRIFAMDENLSSIMERDDIYVFEININRTEDTEHVIIPVCLREKFRHSSYTHHTGSSLFGQPFLMAVPRNNTEDKLYNLLLLRMCRYVKISTETEETEGSLHCCKDQNINGNGPNGIHEEGSPSEMETDEPDDESSQDQELPSENENSQSEDSVGGDNDSENGLCTEDTCKGQLTGHKKRLFTFQFNNLGNTDINYIKDDTRHIRFDDRQLRLDERSFLALDWDPDLKKRYFDENAAEDFEKHESVEYKPPKKPFVKLKDCIELFTTKEKLGAEDPWYCPNCKEHQQATKKLDLWSLPPVLVVHLKRFSYSRYMRDKLDTLVDFPINDLDMSEFLINPNAGPCRYNLIAVSNHYGGMGGGHYTAFAKNKDDGKWYYFDDSSVSTASEDQIVSKAAYVLFYQRQDTFSGTGFFPLDRETKGASAATGIPLESDEDSNDNDNDIENENCMHTN

SEQ ID NO: 94737 - protein, 981 aa, Homo sapiens
  Payload ID: 18883
  Gene Name: ubiquitin specific peptidase 15
  Uniprot ID: Q9Y4E8
  ENSP ID: ENSP00000280377
MAEGGAADLDTQRSDIATLLKTSLRKGDTWYLVDSRWFKQWKKYVGFDSWDKYQMGDQNVYPGPIDNSGLLKDGDAQSLKEHLIDELDYILLPTEGWNKLVSWYTLMEGQEPIARKVVEQGMFVKHCKVEVYLTELKLCENGNMNNVVTRRFSKADTIDTIEKEIRKIFSIPDEKETRLWNKYMSNTFEPLNKPDSTIQDAGLYQGQVLVIEQKNEDGTWPRGPSTPKSPGASNFSTLPKISPSSLSNNYNNMNNRNVKNSNYCLPSYTAYKNYDYSEPGRNNEQPGLCGLSNLGNTCFMNSAIQCLSNTPPLTEYFLNDKYQEELNFDNPLGMRGEIAKSYAELIKQMWSGKFSYVTPRAFKTQVGRFAPQFSGYQQQDCQELLAFLLDGLHEDLNRIRKKPYIQLKDADGRPDKVVAEEAWENHLKRNDSIIVDIFHGLFKSTLVCPECAKISVTFDPFCYLTLPLPMKKERTLEVYLVRMDPLTKPMQYKVVVPKIGNILDLCTALSALSGIPADKMIVTDIYNHRFHRIFAMDENLSSIMERDDIYVFEININRTEDTEHVIIPVCLREKFRHSSYTHHTGSSLFGQPFLMAVPRNNTEDKLYNLLLLRMCRYVKISTETEETEGSLHCCKDQNINGNGPNGIHEEGSPSEMETDEPDDESSQDQELPSENENSQSEDSVGGDNDSENGLCTEDTCKGQLTGHKKRLFTFQFNNLGNTDINYIKDDTRHIRFDDRQLRLDERSFLALDWDPDLKKRYFDENAAEDFEKHESVEYKPPKKPFVKLKDCIELFTTKEKLGAEDPWYCPNCKEHQQATKKLDLWSLPPVLVVHLKRFSYSRYMRDKLDTLVDFPINDLDMSEFLINPNAGPCRYNLIAVSNHYGGMGGGHYTAFAKNKDDGKWYYFDDSSVSTASEDQIVSKAAYVLFYQRQDTFSGTGFFPLDRETKGASAATGIPLESDEDSNDNDNDIENENCMHTN

SEQ ID NO: 94738 - protein, 235 aa, Homo sapiens
  Payload ID: 18883
  Gene Name: ubiquitin specific peptidase 15
  Uniprot ID: Q9Y4E8
  ENSP ID: ENSP00000309240
MAEGGAADLDTQRSDIATLLKTSLRKGDTWYLVDSRWFKQWKKYVGFDSWDKYQMGDQNVYPGPIDNSGLLKDGDAQSLKEHLIDELDYILLPTEGWNKLVSWYTLMEGQEPIARKVVEQGMFVKHCKVEVYLTELKLCENGNMNNVVTRRFSKADTIDTIEKEIRKIFSIPDEKETRLWNKYMSNTFEPLNKPDSTIQDAGLYQGQVLVIEQKNEDGTWPRGPSTPKKPLEQSC

SEQ ID NO: 94739 - protein, 49 aa, Homo sapiens
  Payload ID: 18883
  Gene Name: ubiquitin specific peptidase 15
  ENSP ID: ENSP00000446559
HQQATKKLDLWSLPPVLVVHLKRFSYSRYMRDKLDTLVDFPIKYCFCKK

SEQ ID NO: 94740 - protein, 139 aa, Homo sapiens
  Payload ID: 18883
  Gene Name: ubiquitin specific peptidase 15
  ENSP ID: ENSP00000446843
MGDQNVYPGPIDNSGLLKDGDAQSLKEHLIDELDYILLPTEGWNKLVSWYTLMEGQEPIARKVVEQGMFVKHCKVEVYLTELKLCENGNMNNVVTRRFSKADTIDTIEKEIRKIFSIPDEKETRLWNKYMSNTFEPLNK

SEQ ID NO: 94741 - protein, 87 aa, Homo sapiens
  Payload ID: 18883
  Gene Name: ubiquitin specific peptidase 15
  ENSP ID: ENSP00000447367
  MOD_RES (1)..(1): Any amino acid
XDTIEKEIRKIFSIPDEKETRLWNKYMSNTFEPLNKPDSTIQDAGLYQGQVLVIEQKNEDGTWPRGPSTPNFVGHMVSVITITADVV

SEQ ID NO: 94742 - protein, 175 aa, Homo sapiens
  Payload ID: 18883
  Gene Name: ubiquitin specific peptidase 15
  ENSP ID: ENSP00000447603
MAEGGAADLDTQRSDIATLLKTSLRKGDTWYLVDSRWFKQWKKYVGFDSWDKYQMGDQNVYPGPIDNSGLLKDGDAQSLKEHLIDELDYILLPTEGWNKLVSWYTLMEGQEPIARKGGSILGMKVVEQGMFVKHCKVEVYLTELKLCENGNMNNVVTRRFSKADTIDTIEKEIRK

SEQ ID NO: 94743 - protein, 157 aa, Homo sapiens
  Payload ID: 18883
  Gene Name: ubiquitin specific peptidase 15
  ENSP ID: ENSP00000448372
EKLGAEDPWYCPNCKEHQQATKKLDLWSLPPVLVVHLKRFSYSRYMRDKLDTLVDFPINDLDMSEFLINPNAGPCRYNLIAVSNHYGGMGGGHYTAFAKNKDDGKWYYFDDSSVSTASEDQIVCWAHNPLKASESRREVCWCTCGKFFWRKEKMILL

SEQ ID NO: 94744 - protein, 240 aa, Homo sapiens
  Payload ID: 18883
  Gene Name: ubiquitin specific peptidase 15
  ENSP ID: ENSP00000448393
  MOD_RES (1)..(1): Any amino acid
XAADLDTQRSDIATLLKTSLRKGDTWYLVDSRWFKQWKKYVGFDSWDKYQMGDQNVYPGPIDNSGLLKDGDAQSLKEHLIDELDYILLPTEGWNKLVSWYTLMEGQEPIARKVVEQGMFVKHCKVEVYLTELKLCENGNMNNVVTRRFSKADTIDTIEKEIRKIFSIPDEKETRLWNKYMSNTFEPLNKPDSTIQDAGLYQGQVLVIEQKNEDGTWPRGPSTPNTISFLFIPTTLVLGFV

SEQ ID NO: 94745 - protein, 106 aa, Homo sapiens
  Payload ID: 18883
  Gene Name: ubiquitin specific peptidase 15
  ENSP ID: ENSP00000449563
MFVKHCKVEVYLTELKLCENGNMNNVVTRRFSKADTIDTIEKEIRKIFSIPDEKETRLWNKYMSNTFEPLNKPDSTIQDAGLYQGQVLVIEQKNEDGTWPRGPSTP

SEQ ID NO: 94746 - protein, 823 aa, Homo sapiens
  Payload ID: 18884
  Gene Name: ubiquitin specific peptidase 16
  Uniprot ID: Q9Y5T5
  ENSP ID: ENSP00000334808
MGKKRTKGKTVPIDDSSETLEPVCRHIRKGLEQGNLKKALVNVEWNICQDCKTDNKVKDKAEEETEEKPSVWLCLKCGHQGCGRNSQEQHALKHYLTPRSEPHCLVLSLDNWSVWCYVCDNEVQYCSSNQLGQVVDYVRKQASITTPKPAEKDNGNIELENKKLEKESKNEQEREKKENMAKENPPMNSPCQITVKGLSNLGNTCFFNAVMQNLSQTPVLRELLKEVKMSGTIVKIEPPDLALTEPLEINLEPPGPLTLAMSQFLNEMQETKKGVVTPKELFSQVCKKAVRFKGYQQQDSQELLRYLLDGMRAEEHQRVSKGILKAFGNSTEKLDEELKNKVKDYEKKKSMPSFVDRIFGGELTSMIMCDQCRTVSLVHESFLDLSLPVLDDQSGKKSVNDKNLKKTVEDEDQDSEEEKDNDSYIKERSDIPSGTSKHLQKKAKKQAKKQAKNQRRQQKIQGKVLHLNDICTIDHPEDSEYEAEMSLQGEVNIKSNHISQEGVMHKEYCVNQKDLNGQAKMIESVTDNQKSTEEVDMKNINMDNDLEVLTSSPTRNLNGAYLTEGSNGEVDISNGFKNLNLNAALHPDEINIEILNDSHTPGTKVYEVVNEDPETAFCTLANREVFNTDECSIQHCLYQFTRNEKLRDANKLLCEVCTRRQCNGPKANIKGERKHVYTNAKKQMLISLAPPVLTLHLKRFQQAGFNLRKVNKHIKFPEILDLAPFCTLKCKNVAEENTRVLYSLYGVVEHSGTMRSGHYTAYAKARTANSHLSNLVLHGDIPQDFEMESKGQWFHISDTHVQAVPTTKVLNSQAYLLFYERIL

SEQ ID NO: 94747 - protein, 107 aa, Homo sapiens
  Payload ID: 18884
  Gene Name: ubiquitin specific peptidase 16
  ENSP ID: ENSP00000382855
MGKKRTKGKTVPIDDSSETLEPVCRHIRKGLEQGNLKKALVNVEWNICQDCKTDNKVKDKAEEETEEKPSVWLCLKCGHQGCGRNSQEQHALKHYLTPRSEPHCLVL

SEQ ID NO: 94748 - protein, 822 aa, Homo sapiens
  Payload ID: 18884
  Gene Name: ubiquitin specific peptidase 16
  Uniprot ID: Q9Y5T5
  ENSP ID: ENSP00000382857
MGKKRTKGKTVPIDDSSETLEPVCRHIRKGLEQGNLKKALVNVEWNICQDCKTDNKVKDKAEEETEEKPSVWLCLKCGHQGCGRNSQEQHALKHYLTPRSEPHCLVLSLDNWSVWCYVCDNEVQYCSSNQLGQVVDYVRKQASITTPKPEKDNGNIELENKKLEKESKNEQEREKKENMAKENPPMNSPCQITVKGLSNLGNTCFFNAVMQNLSQTPVLRELLKEVKMSGTIVKIEPPDLALTEPLEINLEPPGPLTLAMSQFLNEMQETKKGVVTPKELFSQVCKKAVRFKGYQQQDSQELLRYLLDGMRAEEHQRVSKGILKAFGNSTEKLDEELKNKVKDYEKKKSMPSFVDRIFGGELTSMIMCDQCRTVSLVHESFLDLSLPVLDDQSGKKSVNDKNLKKTVEDEDQDSEEEKDNDSYIKERSDIPSGTSKHLQKKAKKQAKKQAKNQRRQQKIQGKVLHLNDICTIDHPEDSEYEAEMSLQGEVNIKSNHISQEGVMHKEYCVNQKDLNGQAKMIESVTDNQKSTEEVDMKNINMDNDLEVLTSSPTRNLNGAYLTEGSNGEVDISNGFKNLNLNAALHPDEINIEILNDSHTPGTKVYEVVNEDPETAFCTLANREVFNTDECSIQHCLYQFTRNEKLRDANKLLCEVCTRRQCNGPKANIKGERKHVYTNAKKQMLISLAPPVLTLHLKRFQQAGFNLRKVNKHIKFPEILDLAPFCTLKCKNVAEENTRVLYSLYGVVEHSGTMRSGHYTAYAKARTANSHLSNLVLHGDIPQDFEMESKGQWFHISDTHVQAVPTTKVLNSQAYLLFYERIL

SEQ ID NO: 94749 - protein, 823 aa, Homo sapiens; identical to SEQ ID NO: 94746
  Payload ID: 18884
  Gene Name: ubiquitin specific peptidase 16
  Uniprot ID: Q9Y5T5
  ENSP ID: ENSP00000382858

SEQ ID NO: 94750 - protein, 530 aa, Homo sapiens
  Payload ID: 18885
  Gene Name: ubiquitin specific peptidase 17-like family member 1
  Uniprot ID: Q7RTZ2
  ENSP ID: ENSP00000485364
MGDDSLYLGGEWQFNHFSKLTSSRPDAAFAEIQRTSLPEKSPLSSETRVDLCDDLAPVARQLAPREKLPLSSRRPAAVGAGLQNMGNTCYENASLQCLTYTLPLANYMLSREHSQTCQRPKCCMLCTMQAHITWALHSPGHVIQPSQALAAGFHRGKQEDVHEFLMFTVDAMKKACLPGHKQVDHHCKDTTLIHQIFGGCWRSQIKCLHCHGISDTFDPYLDIALDIQAAQSVKQALEQLVKPEELNGENAYHCGLCLQRAPASNTLTLHTSAKVLILVLKRFSDVAGNKLAKNVQYPECLDMQPYMSQQNTGPLVYVLYAVLVHAGWSCHDGHYFSYVKAQEVQWYKMDDAEVTVCSIISVLSQQAYVLFYIQKSEWERHSESVSRGREPRALGAEDTDRRAKQGELKRDHPCLQAPELDEHLVERATQESTLDHWKFLQEQNKTKPEFNVGKVEGTLPPNALVIHQSKYKCGMKNHHPEQQSSLLNLSSTTRTDQESMNTGTLASLQGRTRRAKGKNKHSKRALLVCQ

SEQ ID NO: 94751 - protein, 558 aa, Homo sapiens
  Payload ID: 18886
  Gene Name: ubiquitin specific peptidase 17-like family member 10
  ENSP ID: ENSP00000390759
MEDDSLYLGGEWQFNHFSKLTSSRPDAAFAEIQRTSLPEKSPLSCETRVDLCDDLAPVARQLAPREKPPLSSRRPAAVGAGLQNMGNTCYVNASLQCLTYKPPLANYMLFREHSQTCHRHKGCMLCTMQAHITRALHIPGHVIQPSQALAAGFHRGKQEDAHEFLMFTVDAMRKACLPGHKQVDRHSKDTTLIHQIFGGYWRSQIKCLHCHGISDTFDPYLDIALDIQAAQSVQQALEQLVKPEELNGENAYHCGVCLQRAPASKTLTLHNSAKVLILVLKRFPDVTGNKIAKNVQYPECLDMQPYMSQQNTGPLVYVLYAVLVHAGWSCHNGHYSSYVKAQEGQWYKMDDAEVTASSITSVLSQQAYVLFYIQKSEWERHSESVSRGREPRALGVEDTDRRATQGELKRDHPCLQAPELDEHLVERATQESTLDHWKFLQEQNKTKPEFNVRRVEGTVPPDVLVIHQSKYKCRMKNHHPEQQSSLLNLSSTTPTDQESMNTGTLASLRGRTRRSKGKNKHSKRALLVCQSQWKYRPTRDIQCVFMNMTYRRVGLRVR

SEQ ID NO: 94752 - protein, 530 aa, Homo sapiens
  Payload ID: 18886
  Gene Name: ubiquitin specific peptidase 17-like family member 10
  Uniprot ID: C9JJH3
  ENSP ID: ENSP00000403760
MEDDSLYLGGEWQFNHFSKLTSSRPDAAFAEIQRTSLPEKSPLSCETRVDLCDDLAPVARQLAPREKPPLSSRRPAAVGAGLQNMGNTCYVNASLQCLTYKPPLANYMLFREHSQTCHRHKGCMLCTMQAHITRALHIPGHVIQPSQALAAGFHRGKQEDAHEFLMFTVDAMRKACLPGHKQVDRHSKDTTLIHQIFGGYWRSQIKCLHCHGISDTFDPYLDIALDIQAAQSVQQALEQLVKPEELNGENAYHCGVCLQRAPASKTLTLHNSAKVLILVLKRFPDVTGNKIAKNVQYPECLDMQPYMSQQNTGPLVYVLYAVLVHAGWSCHNGHYSSYVKAQEGQWYKMDDAEVTASSITSVLSQQAYVLFYIQKSEWERHSESVSRGREPRALGVEDTDRRATQGELKRDHPCLQAPELDEHLVERATQESTLDHWKFLQEQNKTKPEFNVRRVEGTVPPDVLVIHQSKYKCRMKNHHPEQQSSLLNLSSTTPTDQESMNTGTLASLRGRTRRSKGKNKHSKRALLVCQ

SEQ ID NO: 94753 - protein, 530 aa, Homo sapiens
  Payload ID: 18887
  Gene Name: ubiquitin specific peptidase 17-like family member 11
  Uniprot ID: C9JVI0
  ENSP ID: ENSP00000400880
MEDDSLYLGGEWQFNHFSKLTSSRPDAAFAEIQRTSLPEKSPLSCETRVDLCDDLAPVARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLVKPEELNGENAYHCGVCLQRAPASKTLTLHTSAKVLILVLKRFSDVTGNKIAKNVQYPECLDMQPYMSQTNTGPLVYVLYAVLVHAGWSCHNGHYFSYVKAQEGQWYKMDDAEVTASSITSVLSQQAYVLFYIQKSEWERHSESVSRGREPRALGAEDTDRRATQGELKRDHPCLQAPELDEHLVERATQESTLDHWKFLQEQNKTKPEFNVRKVEGTLPPDVLVIHQSKYKCGMKNHHPEQQSSLLNLSSTTPTHQESMNTGTLASLRGRARRSKGKNKHSKRALLVCQ

SEQ ID NO: 94754 - protein, 558 aa, Homo sapiens
  Payload ID: 18887
  Gene Name: ubiquitin specific peptidase 17-like family member 11
  ENSP ID: ENSP00000477697
MEDDSLYLGGEWQFNHFSKLTSSRPDAAFAEIQRTSLPEKSPLSCETRVDLCDDLAPVARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLVKPEELNGENAYHCGVCLQRAPASKTLTLHTSAKVLILVLKRFSDVTGNKIAKNVQYPECLDMQPYMSQTNTGPLVYVLYAVLVHAGWSCHNGHYFSYVKAQEGQWYKMDDAEVTASSITSVLSQQAYVLFYIQKSEWERHSESVSRGREPRALGAEDTDRRATQGELKRDHPCLQAPELDEHLVERATQESTLDHWKFLQEQNKTKPEFNVRKVEGTLPPDVLVIHQSKYKCGMKNHHPEQQSSLLNLSSTTPTHQESMNTGTLASLRGRARRSKGKNKHSKRALLVCQSQWKYRPTRDIQCVFLNMTYRRVGLRVR

SEQ ID NO: 94755 - protein, 530 aa, Homo sapiens
  Payload ID: 18888
  Gene Name: ubiquitin specific peptidase 17-like family member 12
  Uniprot ID: C9JPN9
  ENSP ID: ENSP00000389443
MEEDSLYLGGEWQFNHFSKLTSSRPDAAFAEIQRTSLPEKSPLSCETRVDLCDDLAPVARQLAPREKLPLSNRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLVKPEELNGENAYHCGVCLQRAPASKMLTLLTSAKVLILVLKRFSDVTGNKIAKNVQYPECLDMQPYMSQPNTGPLVYVLYAVLVHAGWSCHNGHYFSYVKAQEGQWYKMDDAEVTASSITSVLSQQAYVLFYIQKSEWERHSESVSRGREPRALGAEDTDRRATQGELKRDHPCLQAPELDEHLVERATQESTLDHWKFLQEQNKTKPEFNVRKVEGTLPPDVLVIHQSKYKCGMKNHHPEQQSSLLKLSSTTPTHQESMNTGTLASLRGRARRSKGKNKHSKRALLVCQ

SEQ ID NO: 94756 - protein, 530 aa, Homo sapiens
  Payload ID: 18889
  Gene Name: ubiquitin specific peptidase 17-like family member 13
  Uniprot ID: C9JLJ4
  ENSP ID: ENSP00000414392
MEEDSLYLGGEWQFNHFSKLTSSRLDAAFAEIQRTSLPEKSPLSCETRVDLCDDLVPEARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHPSKDTTLIHQIFGGYWRSQIKCLHCHGISDTFDPYLDIALDIQAAQSVQQALEQLVKPEELNGENAYHCGVCLQRAPASKTLTLHTSAKVLILVLKRFSDVTGNKIAKNVQYPECLDMQPYMSQQNTGPLVYVLYAVLVHAGWSCHNGHYFSYVKAQEGQWYKMDDAEVTAASITSVLSQQAYVLFYIQKSEWERHSESVSRGREPRALGAEDTDRRATQGELKRDHPCLQAPELDEHLVERATQESTLDRWKFLQEQNKTKPEFNVRKVEGTLPPDVLVIHQSKYKCGMKNHHPEQQSSLLNLSSSTPTHQESMNTGTLASLRGRARRSKGKNKHSKRALLVCQ

SEQ ID NO: 94757 - protein, 558 aa, Homo sapiens
  Payload ID: 18889
  Gene Name: ubiquitin specific peptidase 17-like family member 13
  ENSP ID: ENSP00000481603
MEEDSLYLGGEWQFNHFSKLTSSRLDAAFAEIQRTSLPEKSPLSCETRVDLCDDLVPEARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHPSKDTTLIHQIFGGYWRSQIKCLHCHGISDTFDPYLDIALDIQAAQSVQQALEQLVKPEELNGENAYHCGVCLQRAPASKTLTLHTSAKVLILVLKRFSDVTGNKIAKNVQYPECLDMQPYMSQQNTGPLVYVLYAVLVHAGWSCHNGHYFSYVKAQEGQWYKMDDAEVTAASITSVLSQQAYVLFYIQKSEWERHSESVSRGREPRALGAEDTDRRATQGELKRDHPCLQAPELDEHLVERATQESTLDRWKFLQEQNKTKPEFNVRKVEGTLPPDVLVIHQSKYKCGMKNHHPEQQSSLLNLSSSTPTHQESMNTGTLASLRGRARRSKGKNKHSKRALLVCQSQWKYRPTRDIQCVFLNMTYRRVGLRVR

SEQ ID NO: 94758 - protein, 530 aa, Homo sapiens
  Payload ID: 18890
  Gene Name: ubiquitin specific peptidase 17-like family member 15
  Uniprot ID: C9J2P7
  ENSP ID: ENSP00000410621
MEDDSLYLGGEWQFNHFSKLTSSRPDAAFAEIQRTSLPEKSPLSCETRVDLCDDLAPVARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLVKPEELNGENAYHCGVCLQRAPASKTLTLHTSAKVLILVLKRFSDVTGNKIDKNVQYPECLDMKLYMSQTNSGPLVYVLYAVLVHAGWSCHNGHYFSYVKAQEGQWYKMDDAEVTASSITSVLSQQAYVLFYIQKSEWERHSESVSRGREPRALGAEDTDRRATQGELKRDHPCLQAPELDEHLVERATQESTLDHWKFLQEQNKTKPEFNVRKVEGTLPPDVLVIHQSKYKCGMKNHHPEQQSSLLNLSSTTPTHQESMNTGTLASLRGRARRSKGKNKHSKRALLVCQ

SEQ ID NO: 94759 - protein, 559 aa, Homo sapiens
  Payload ID: 18890
  Gene Name: ubiquitin specific peptidase 17-like family member 15
  ENSP ID: ENSP00000478980
MEDDSLYLGGEWQFNHFSKLTSSRPDAAFAEIQRTSLPEKSPLSCETRVDLCDDLAPVARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLVKPEELNGENAYHCGVCLQRAPASKTLTLHTSAKVLILVLKRFSDVTGNKIDKNVQYPECLDMKLYMSQTNSGPLVYVLYAVLVHAGWSCHNGHYFSYVKAQEGQWYKMDDAEVTASSITSVLSQQAYVLFYIQKSEWERHSESVSRGREPRALGAEDTDRRATQGELKRDHPCLQAPELDEHLVERATQESTLDHWKFLQEQNKTKPEFNVRKVEGTLPPDVLVIHQSKYKCGMKNHHPEQQSSLLNLSSTTPTHQESMNTGTLASLRGRARRSKGKNKHSKRALLVCQWSQWKYRPTRDIQCVFLNMTYRRVGLRVR

SEQ ID NO: 94760 - protein, 559 aa, Homo sapiens; identical to SEQ ID NO: 94759
  Payload ID: 18890
  Gene Name: ubiquitin specific peptidase 17-like family member 15
  ENSP ID: ENSP00000483519

SEQ ID NO: 94761 - protein, 530 aa, Homo sapiens
  Payload ID: 18891
  Gene Name: ubiquitin specific peptidase 17-like family member 17
  Uniprot ID: D6RBQ6
  ENSP ID: ENSP00000422621
MEDDSLYLGGEWQFNHFSKLTSSRPDAAFAEIQRTSLPEKSPLSCETRVDLCDDLAPVARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLVKPEELNGENAYHCGVCLQRAPASKTLTLHTSAKVLILVLKRFSDVTGNKIAKNVQYPECLDMQPYMSQQNTGPLVYVLYAVLVHAGWSCHNGHYFSYVKAQEGQWYKMDDAEVTAASITSVLSQQAYVLFYIQKSEWERHSESVSRGREPRALGAEDTDRRATQGELKRDHPCLQAPELDEHLVERATQESTLDHWKFLQEQNKTKPEFNVRKVEGTLPPDVLVIHQSKYKCGMKNHHPEQQSSLLNLSSSTPTHQESMNTGTLASLRGRARRSKGKNKHSKRALLVCQ

SEQ ID NO: 94762 - protein, 558 aa, Homo sapiens
  Payload ID: 18891
  Gene Name: ubiquitin specific peptidase 17-like family member 17
  ENSP ID: ENSP00000479739
MEDDSLYLGGEWQFNHFSKLTSSRPDAAFAEIQRTSLPEKSPLSCETRVDLCDDLAPVARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLVKPEELNGENAYHCGVCLQRAPASKTLTLHTSAKVLILVLKRFSDVTGNKIAKNVQYPECLDMQPYMSQQNTGPLVYVLYAVLVHAGWSCHNGHYFSYVKAQEGQWYKMDDAEVTAASITSVLSQQAYVLFYIQKSEWERHSESVSRGREPRALGAEDTDRRATQGELKRDHPCLQAPELDEHLVERATQESTLDHWKFLQEQNKTKPEFNVRKVEGTLPPDVLVIHQSKYKCGMKNHHPEQQSSLLNLSSSTPTHQESMNTGTLASLRGRARRSKGKNKHSKRALLVCQSQWKYRPTRDIQCVFLNMTYRRVGLRVR

SEQ ID NO: 94763 - protein, 530 aa, Homo sapiens
  Payload ID: 18892
  Gene Name: ubiquitin specific peptidase 17-like family member 18
  Uniprot ID: D6R9N7
  ENSP ID: ENSP00000423503
MEDDSLYLGGEWQFNHFSKLTSSRPDAAFAEIQRTSLPEKSPLSCETRVDLCDDLAPVARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLVKPEELNGENAYHCGVCLQRAPASKTLTLHTSAKVLILVLKRFSDVTGNKIAKNVQYPECLDMQPYMSQTNTGPLVYVLYAVLVHAGWSCHNGHYFSYVKAQEGQWYKMDDAEVTASSITSVLSQQAYVLFYIQKSEWERHSESVSRGREPRALGAEDTDRRAKQGELKRDHPCLQAPELDEHLVERATQESTLDHWKFLQEQNKTKPEFNVRKVEGTLPPDVLVIHQSKYKCGMKNHHPEQQSSLLNLSSTTPTHQESMNTGTLASLRGRARRSKGKNKHSKRALLVCQ

SEQ ID NO: 94764 - protein, 558 aa, Homo sapiens
  Payload ID: 18892
  Gene Name: ubiquitin specific peptidase 17-like family member 18
  ENSP ID: ENSP00000477751
MEDDSLYLGGEWQFNHFSKLTSSRPDAAFAEIQRTSLPEKSPLSCETRVDLCDDLAPVARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLVKPEELNGENAYHCGVCLQRAPASKTLTLHTSAKVLILVLKRFSDVTGNKIAKNVQYPECLDMQPYMSQTNTGPLVYVLYAVLVHAGWSCHNGHYFSYVKAQEGQWYKMDDAEVTASSITSVLSQQAYVLFYIQKSEWERHSESVSRGREPRALGAEDTDRRAKQGELKRDHPCLQAPELDEHLVERATQESTLDHWKFLQEQNKTKPEFNVRKVEGTLPPDVLVIHQSKYKCGMKNHHPEQQSSLLNLSSTTPTHQESMNTGTLASLRGRARRSKGKNKHSKRALLVCQSQWKYRPTRDIQCVFLNMTYRRVGLRVR

SEQ ID NO: 94765 - protein, 530 aa, Homo sapiens
  Payload ID: 18893
  Gene Name: ubiquitin specific peptidase 17-like family member 19
  Uniprot ID: D6RCP7
  ENSP ID: ENSP00000425582
MEEDSLYLGGEWQFNHFSKLTSSRPDAAFAEIQRTSLPEKSPLSCETRVDLCDDLAPVARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLVKPEELNGENAYHCGVCLQRAPASKTLTLHTSAKVLILVLKRFSDVTGNKIAKNVQYPECLDMQPYMSQTNTGPLVYVLYAVLVHAGWSCHNGHYFSYVKAQEGQWYKMDDAEVTASSITSVLSQQAYVLFYIQKSEWERHSESVSRGREPRALGAEDTDRRATQGELKRDHPCLQAPELDEHLVERATQESTLDHWKFLQEQNKTKPEFNVRKVEGTLPPDVLVIHQSKYKCGMKNHHPEQQSSLLKLSSTTPTHQESMNTGTLASLRGRARRSKGKNKHSKRALLVCQ

SEQ ID NO: 94766 - protein, 558 aa, Homo sapiens
  Payload ID: 18893
  Gene Name: ubiquitin specific peptidase 17-like family member 19
  ENSP ID: ENSP00000481718
MEEDSLYLGGEWQFNHFSKLTSSRPDAAFAEIQRTSLPEKSPLSCETRVDLCDDLAPVARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLVKPEELNGENAYHCGVCLQRAPASKTLTLHTSAKVLILVLKRFSDVTGNKIAKNVQYPECLDMQPYMSQTNTGPLVYVLYAVLVHAGWSCHNGHYFSYVKAQEGQWYKMDDAEVTASSITSVLSQQAYVLFYIQKSEWERHSESVSRGREPRALGAEDTDRRATQGELKRDHPCLQAPELDEHLVERATQESTLDHWKFLQEQNKTKPEFNVRKVEGTLPPDVLVIHQSKYKCGMKNHHPEQQSSLLKLSSTTPTHQESMNTGTLASLRGRARRSKGKNKHSKRALLVCQSQWKYRPTRDIQCVFLNMTYRRVGLRVR

SEQ ID NO: 94767 - protein, 530 aa, Homo sapiens
  Payload ID: 18894
  Gene Name: ubiquitin specific peptidase 17-like family member 2
  Uniprot ID: Q6R6M4
  ENSP ID: ENSP00000333329
MEDDSLYLGGEWQFNHFSKLTSSRPDAAFAEIQRTSLPEKSPLSSEARVDLCDDLAPVARQLAPRKKLPLSSRRPAAVGAGLQNMGNTCYENASLQCLTYTPPLANYMLSREHSQTCQRPKCCMLCTMQAHITWALHSPGHVIQPSQALAAGFHRGKQEDAHEFLMFTVDAMKKACLPGHKQVDHHSKDTTLIHQIFGGCWRSQIKCLHCHGISDTFDPYLDIALDIQAAQSVKQALEQLVKPEELNGENAYHCGLCLQRAPASKTLTLHTSAKVLILVLKRFSDVTGNKLAKNVQYPECLDMQPYMSQQNTGPLVYVLYAVLVHAGWSCHDGHYFSYVKAQEGQWYKMDDAKVTACSITSVLSQQAYVLFYIQKSEWERHSESVSRGREPRALGAEDTDRRATQGELKRDHPCLQAPELDERLVERATQESTLDHWKFPQEQNKTKPEFNVRKVEGTLPPNVLVIHQSKYKCGMKNHHPEQQSSLLNLSSTTRTDQESVNTGTLASLQGRTRRSKGKNKHSKRALLVCQ

SEQ ID NO: 94768 - protein, 530 aa, Homo sapiens
  Payload ID: 18895
  Gene Name: ubiquitin specific peptidase 17-like family member 20
  Uniprot ID: D6RJB6
  ENSP ID: ENSP00000427264
MEDDSLYLGGEWQFNHFSKLTSSRPDAAFAEIQRTSLPEKSPLSCETRVDLCDDLAPVARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLVKPEELNGENAYHCGVCLQRAPASKTLTLHTSAKVLILVLKRFSDVTGNKIAKNVQYPECLDMQPYMSQPNTGPLVYVLYAVLVHAGWSCHNGHYFSYVKAQEGQWYKMDDAEVTASSITSVLSQQAYVLFYIQKSEWERHSESVSRGREPRALGAEDTDRRATQGELKRDHPCLQAPELDEHLVERATQESTLDHWKFLQEQNKTKPEFNVRKVEGTLPPDVLVIHQSKYKCGMKNHHPEQQSSLLNLSSTTPTHQESMNTGTLASLRGRARRSKGKNKHSKRALLVCQ

SEQ ID NO: 94769 - protein, 558 aa, Homo sapiens
  Payload ID: 18895
  Gene Name: ubiquitin specific peptidase 17-like family member 20
  ENSP ID: ENSP00000477832
MEDDSLYLGGEWQFNHFSKLTSSRPDAAFAEIQRTSLPEKSPLSCETRVDLCDDLAPVARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLVKPEELNGENAYHCGVCLQRAPASKTLTLHTSAKVLILVLKRFSDVTGNKIAKNVQYPECLDMQPYMSQPNTGPLVYVLYAVLVHAGWSCHNGHYFSYVKAQEGQWYKMDDAEVTASSITSVLSQQAYVLFYIQKSEWERHSESVSRGREPRALGAEDTDRRATQGELKRDHPCLQAPELDEHLVERATQESTLDHWKFLQEQNKTKPEFNVRKVEGTLPPDVLVIHQSKYKCGMKNHHPEQQSSLLNLSSTTPTHQESMNTGTLASLRGRARRSKGKNKHSKRALLVCQSQWKYRPTRDIQCVFLNMTYRRVGLRVR

SEQ ID NO: 94770 - protein, 530 aa, Homo sapiens
  Payload ID: 18896
  Gene Name: ubiquitin specific peptidase 17-like family member 21
  Uniprot ID: D6R901
  ENSP ID: ENSP00000422216
MEEDSLYLGGEWQFNHFSKLTSSRPDAAFAEIQRTSLPEKSPLSCETRVDLCDDLAPVARQLAPREKLPLSNRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLVKPEELNGENAYHCGVCLQRAPASKMLTLLTSAKVLILVLKRFSDVTGNKIAKNVQYPECLDMQPYMSQPNTGPLVYVLYAVLVHAGWSCHNGHYFSYVKAQEGQWYKMDDAEVTASSITSVLSQQAYVLFYIQKSEWERHSESVSRGREPRALGAEDTDRRATQGELKRDHPCLQAPELDEHLVERATQESTLDHWKFLQEQNKTKPEFNVRKVEGTLPPDVLVIHQSKYKCGMKNHHPEQQSSLLNLSSSTPTHQESMNTGTLASLRGRARRSKGKNKHSKRALLVCQ

SEQ ID NO: 94771 - protein, 558 aa, Homo sapiens
  Payload ID: 18896
  Gene Name: ubiquitin specific peptidase 17-like family member 21
  ENSP ID: ENSP00000478565
MEEDSLYLGGEWQFNHFSKLTSSRPDAAFAEIQRTSLPEKSPLSCETRVDLCDDLAPVARQLAPREKLPLSNRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLVKPEELNGENAYHCGVCLQRAPASKMLTLLTSAKVLILVLKRFSDVTGNKIAKNVQYPECLDMQPYMSQPNTGPLVYVLYAVLVHAGWSCHNGHYFSYVKAQEGQWYKMDDAEVTASSITSVLSQQAYVLFYIQKSEWERHSESVSRGREPRALGAEDTDRRATQGELKRDHPCLQAPELDEHLVERATQESTLDHWKFLQEQNKTKPEFNVRKVEGTLPPDVLVIHQSKYKCGMKNHHPEQQSSLLNLSSSTPTHQESMNTGTLASLRGRARRSKGKNKHSKRALLVCQSQWKYRPTRDIQCVFLNMTYRRVGLRVR

SEQ ID NO: 94772 - protein, 530 aa, Homo sapiens
  Payload ID: 18897
  Gene Name: ubiquitin specific peptidase 17-like family member 22
  Uniprot ID: D6RA61
  ENSP ID: ENSP00000423115
MEDDSLYLGGEWQFNHFSKLTSSRPDAAFAEIQRTSLPEKSPLSCETRVDLCDDLAPVARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLVKPEELNGENAYHCGVCLQRAPASKTLTLHTSAKVLILVLKRFSDVTGNKIAKNVQYPECLDMQPYMSQQNTGPLVYVLYAVLVHAGWSCHNGHYFSYVKAQEGQWYKMDDAEVTASSITSVLSQQAYVLFYIQKSEWERHSESVSRGREPRALGAEDTDRRATQGELKRDHPCLQAPELDEHLVERATQESTLDHWKFLQEQNKTKPEFNVRKVEGTLPPDVLVIHQSKYKCGMKNHHPEQQSSLLKLSSTTPTHQESMNTGTLASLRGRARRSKGKNKHSKRALLVCQ

SEQ ID NO: 94773 - protein, 558 aa, Homo sapiens
  Payload ID: 18897
  Gene Name: ubiquitin specific peptidase 17-like family member 22
  ENSP ID: ENSP00000480174
MEDDSLYLGGEWQFNHFSKLTSSRPDAAFAEIQRTSLPEKSPLSCETRVDLCDDLAPVARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLVKPEELNGENAYHCGVCLQRAPASKTLTLHTSAKVLILVLKRFSDVTGNKIAKNVQYPECLDMQPYMSQQNTGPLVYVLYAVLVHAGWSCHNGHYFSYVKAQEGQWYKMDDAEVTASSITSVLSQQAYVLFYIQKSEWERHSESVSRGREPRALGAEDTDRRATQGELKRDHPCLQAPELDEHLVERATQESTLDHWKFLQEQNKTKPEFNVRKVEGTLPPDVLVIHQSKYKCGMKNHHPEQQSSLLKLSSTTPTHQESMNTGTLASLRGRARRSKGKNKHSKRALLVCQSQWKYRPTRDIQCVFLNMTYRRVGLRVR

SEQ ID NO: 94774 - protein, 183 aa, Homo sapiens
  Payload ID: 18898
  Gene Name: ubiquitin specific peptidase 17-like family member 23
  Uniprot ID: D6RBM5
  ENSP ID: ENSP00000424077
MEDDSLYLGGEWQFNHFSKLTSSRPDAAFAEIQRTSLPEKSPLSCETRVDLCDDLAPVARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMEKACLPGHKQV

SEQ ID NO: 94775 - protein, 530 aa, Homo sapiens
  Payload ID: 18899
  Gene Name: ubiquitin specific peptidase 17-like family member 24
  Uniprot ID: Q0WX57
  ENSP ID: ENSP00000425375
MEDDSLYLRGEWQFNHFSKLTSSRPDAAFAEIQRTSLPEKSPLSCETRVDLCDDLAPVARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLVKPEELNGENAYHCGVCLQRAPASKTLTLHTSAKVLILVLKRFSDVTGNKIAKNVQYPECLDMQPYMSQPNTGPLVYVLYAVLVHAGWSCHNGHYFSYVKAQEGQWYKMDDAEVTASSITSVLSQQAYVLFYIQKSEWERHSESVSRGREPRALGAEDTDRRATQGELKRDHPCLQAPELDEHLVERATQESTLDHWKFLQEQNKTKPEFNVRKVEGTLPPDVLVIHQSKYKCGMKNHHPEQQSSLLNLSSSTPTHQESMNTGTLASLRGRARRSKGKNKHSKRALLVCQ

SEQ ID NO: 94776 - protein, 558 aa, Homo sapiens
  Payload ID: 18899
  Gene Name: ubiquitin specific peptidase 17-like family member 24
  ENSP ID: ENSP00000477655
MEDDSLYLRGEWQFNHFSKLTSSRPDAAFAEIQRTSLPEKSPLSCETRVDLCDDLAPVARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLVKPEELNGENAYHCGVCLQRAPASKTLTLHTSAKVLILVLKRFSDVTGNKIAKNVQYPECLDMQPYMSQPNTGPLVYVLYAVLVHAGWSCHNGHYFSYVKAQEGQWYKMDDAEVTASSITSVLSQQAYVLFYIQKSEWERHSESVSRGREPRALGAEDTDRRATQGELKRDHPCLQAPELDEHLVERATQESTLDHWKFLQEQNKTKPEFNVRKVEGTLPPDVLVIHQSKYKCGMKNHHPEQQSSLLNLSSSTPTHQESMNTGTLASLRGRARRSKGKNKHSKRALLVCQSQWKYRPTRDIQCVFLNMTYRRVGLRVR

SEQ ID NO: 94777 - protein, 530 aa, Homo sapiens; identical to SEQ ID NO: 94775
  Payload ID: 18900
  Gene Name: ubiquitin specific peptidase 17-like family member 25
  Uniprot ID: Q0WX57
  ENSP ID: ENSP00000422097

SEQ ID NO: 94778 - protein, 558 aa, Homo sapiens; identical to SEQ ID NO: 94776
  Payload ID: 18900
  Gene Name: ubiquitin specific peptidase 17-like family member 25
  ENSP ID: ENSP00000478002

SEQ ID NO: 94779 - protein, 530 aa, Homo sapiens; identical to SEQ ID NO: 94775
  Payload ID: 18901
  Gene Name: ubiquitin specific peptidase 17-like family member 26
  Uniprot ID: Q0WX57
  ENSP ID: ENSP00000427366

SEQ ID NO: 94780 - protein, 558 aa, Homo sapiens; identical to SEQ ID NO: 94776
  Payload ID: 18901
  Gene Name: ubiquitin specific peptidase 17-like family member 26
  ENSP ID: ENSP00000484378

SEQ ID NO: 94781 - protein, 530 aa, Homo sapiens; identical to SEQ ID NO: 94775
  Payload ID: 18902
  Gene Name: ubiquitin specific peptidase 17-like family member 27
  Uniprot ID: Q0WX57
  ENSP ID: ENSP00000423211

SEQ ID NO: 94782 - protein, 530 aa, Homo sapiens; identical to SEQ ID NO: 94775
  Payload ID: 18903
  Gene Name: ubiquitin specific peptidase 17-like family member 28
  Uniprot ID: Q0WX57
  ENSP ID: ENSP00000423777

SEQ ID NO: 94783 - protein, 530 aa, Homo sapiens; identical to SEQ ID NO: 94775
  Payload ID: 18904
  Gene Name: ubiquitin specific peptidase 17-like family member 29
  Uniprot ID: Q0WX57
  ENSP ID: ENSP00000422969

SEQ ID NO: 94784 - protein, 530 aa, Homo sapiens
  Payload ID: 18905
  Gene Name: ubiquitin specific peptidase 17-like family member 3
  Uniprot ID: A6NCW0
  ENSP ID: ENSP00000485323
MGDDSLYLGGEWQFNHFSKLTSSRPDAAFAEIQRTSLPEKSPLSSETRVDLCDDLAPVARQLAPREKLPLSSRRPAAVGAGLQNMGNTCYENASLQCLTYTLPLANYMLSREHSQTCQRPKCCMLCTMQAHITWALHSPGHVIQPSQALASGFHRGKQEDVHEFLMFTVDAMKKACLPGHKQVDHHSKDTTLIHQIFGGCWRSQIKCLHCHGISDTFDPYLDIALDIQAAQSVKQALEQLVKPEELNGENAYHCGLCLQRAPASNTLTLHTSAKVLILVLKRFSDVAGNKLAKNVQYPECLDMQPYMSQQNTGPLVYVLYAVLVHAGWSCHDGHYFSYVKAQEGQWYKMDDAEVTVCSITSVLSQQAYVLFYIQKSEWERHSESVSRGREPRALGAEDTDRRAKQGELKRDHPCLQAPELDEHLVERATQESTLDHWKFLQEQNKTKPEFNVGKVEGTLPPNALVIHQSKYKCGMKNHHPEQQSSLLNLSSTTRTDQESMNTGTLASLQGRTRRAKGKNKHSKRALLVCQ

SEQ ID NO: 94785 - protein, 530 aa, Homo sapiens; identical to SEQ ID NO: 94775
  Payload ID: 18906
  Gene Name: ubiquitin specific peptidase 17-like family member 30
  Uniprot ID: Q0WX57
  ENSP ID: ENSP00000422887

SEQ ID NO: 94786 - protein, 530 aa, Homo sapiens
  Payload ID: 18907
  Gene Name: ubiquitin specific peptidase 17-like family member 4
  Uniprot ID: A6NCW7
  ENSP ID: ENSP00000485243
MGDDSLYLGGEWQFNHFSKLTSSRPDAAFAEIQRTSLPEKSPLSSETRVDLCDDLAPVARQLAPREKLPLSSRRPAAVGAGLQNMGNTCYENASLQCLTYTLPLANYMLSREHSQTCQRPKCCMLCTMQAHITWALHSPGHVIQPSQALAAGFHRGKQEDVHEFLMFTVDAMKKACLPGHKQVDHHSKDTTLIHQIFGGCWRSQIKCLHCHGISDTFDPYLDIALDIQAAQSVKQALEQLVKPEELNGENAYHCGLCLQRAPASNTLTLHTSAKVLILVLKRFSDVAGNKLAKNVQYPECLDMQPYMSQQNTGPLVYVLYAVLVHAGWSCHDGYYFSYVKAQEGQWYKMDDAEVTVCSITSVLSQQAYVLFYIQKSEWERHSESVSRGREPRALGAEDTDRPATQGELKRDHPCLQVPELDEHLVERATEESTLDHWKFPQEQNKMKPEFNVRKVEGTLPPNVLVIHQSKYKCGMKNHHPEQQSSLLNLSSMNSTDQESMNTGTLASLQGRTRRSKGKNKHSKRSLLVCQ

SEQ ID NO: 94787 - protein, 530 aa, Homo sapiens
  Payload ID: 18908
  Gene Name: ubiquitin specific peptidase 17-like family member 5
  Uniprot ID: A8MUK1
  ENSP ID: ENSP00000425955
MEDDSLYLRGEWQFNHFSKLTSSRPDAAFAEIQRTSLPEKSPLSCETRVDLCDDLAPVARQLAPREKLPLSSRRPAAVGAGLQNMGNTCYVNASLQCLTYTPPLANYMLSREHSQTCHRHKGCMLCTMQAHITRALHNPGHVIQPSQALAAGFHRGKQEDAHEFLMFTVDAMKKACLPGHKQVDHHSKDTTLIHQIFGGYWRSQIKCLHCHGISDTFDPYLDIALDIQAAQSVQQALEQLAKPEELNGENAYHCGVCLQRAPASKTLTLHTSAKVLILVLKRFSDVTGNKIAKNVQYPECLDMQPYMSQPNTGPLVYVLYAVLVHAGWSCHNGHYFSYVKAQEGQWYKMDDAEVTASSITSVLSQQAYVLFYIQKSEWERHSESVSRGREPRALGAEDTDRRATQGELKRDHPCLQAPELDEHLVERATQESTLDHWKFLQEQNKTKPEFNVRKVEGTLPPDVLVIHQSKYKCGMKNHHPEQQSSLLNLSSSTPTHQESMNTGTLASLRGRARRSKGKNKHSKRALLVCQ

SEQ ID NO: 94788 - protein, 530 aa, Homo sapiens
  Payload ID: 18909
  Gene Name: ubiquitin specific peptidase 17-like family member 7
  Uniprot ID: P0C7H9
  ENSP ID: ENSP00000485337
MEDDSLYLGGDWQFNHFSKLTSSRLDAAFAEIQRTSLSEKSPLSSETRFDLCDDLAPVARQLAPREKLPLSSRRPAAVGAGLQKIGNTFYVNVSLQCLTYTLPLSNYMLSREDSQTCHLHKCCMFCTMQAHITWALHSPGHVIQPSQVLAAGFHRGEQEDAHEFLMFTVDAMKKACLPGHKQLDHHSKDTTLIHQIFGAYWRSQIKYLHCHGVSDTFDPYLDIALDIQAAQSVKQALEQLVKPKELNGENAYHCGLCLQKAPASKTLTLPTSAKVLILVLKRFSDVTGNKLAKNVQYPKCRDMQPYMSQQNTGPLVYVLYAVLVHAGWSCHNGHYFSYVKAQEGQWYKMDDAEVTASGITSVLSQQAYVLFYIQKSEWERHSESVSRGREPRALGAEDTDRPATQGELKRDHPCLQVPELDEHLVERATQESTLDHWKFPQEQNKTKPEFNVRKVEGTLPPNVLVIHQSKYKCGMKNHHPEQQSSLLNLSSTKPTDQESMNTGTLASLQGSTRRSKGNNKHSKRSLLVCQ

SEQ ID NO: 94789 - protein, 530 aa, Homo sapiens
  Payload ID: 18910
  Gene Name: ubiquitin specific peptidase 17-like family member 8
  ENSP ID: ENSP00000485101
MGDDSLYLGGEWQFNHFSKLTSSRPDAAFAEIQRTSLPEKSPLSSETRVDLCDDLAPVARQLAPREKLPLSSRRPAAVGAGLQNMGNTCYENASLQCLTYTLPLANYMLSREHSQTCQRPKCCMLCTMQAHITWALHSPGHVIQPSQALASGFHRGKQEDVHEFLMFTVDAMKKACLPGHKQVDHHSKDTTLIHQIFGGCWRSQIKCLHCHGISDTFDPYLDIALDIQAAQSVKQALEQLVKPEELNGENAYHCGLCLQRAPASNTLTLHTSAKVLILVLKRFCDVTGNKLAKNVQYPECLDMQPYMSQQNTGPLVYVLYAVLVHAGWSCHNGYYFSYVKAQEGQWYKMDDAEVTACSITSVLSQQAYVLFYIQKSEWERHSESVSRGREPRALGAEDTDRPATQGELKRDHPCLQVPELDEHLVERATEESTLDHWKFPQEQNKMKPEFNVRKVEGTLPPNVLVIHQSKYKCGMKNHHPEQQSSLLNLSSMNSTDQESMNTGTLASLQGRTRRSKGKNKHSKRSLLVCQ

SEQ ID NO: 94790 - protein, 530 aa, Homo sapiens
  Payload ID: 18910
  Gene Name: ubiquitin specific peptidase 17-like family member 8
  Uniprot ID: P0C7I0
  ENSP ID: ENSP00000485306
MEDDSLYLGGEWQFNHFSKLTSPRPDAAFAEIQRTSLPEKSPLSSETRVDLCDDLAPVARQLAPREKLPLSSRRPAAVGAGLQNMGNTCYLNASLQCLTYTPPLANYMLSREHSQTCQRPKCCMLCTMQAHITWALHSPGHVIQPSQALAAGFHRGKQEDAHEFLMFTVDAMKKACLPGHKQVDHHSKDTTLIHQIFGGCWRSQIKCLHCHGISDTFDPYLDIALDIQAAQSVKQALEQLVKPEELNGENAYPCGLCLQRAPASNTLTLHTSAKVLILVLKRFCDVTGNKLAKNVQYPECLDMQPYMSQQNTGPLVYVLYAVLVHAGWSCHNGYYFSYVKAQEGQWYKMDDAEVTACSITSVLSQQAYVLFYIQKSEWERHSESVSRGREPRALGAEDTDRPATQGELKRDHPCLQVPELDEHLVERATEESTLDHWKFPQEQNKMKPEFNVRKVEGTLPPNVLVIHQSKYKCGMKNHHPEQQSSLLNLSSMNSTDQESMNTGTLASLQGRTRRSKGKNKHSKRSLLVCQ

SEQ ID NO: 94791 - protein, 372 aa, Homo sapiens
  Payload ID: 18911
  Gene Name: ubiquitin specific peptidase 18
  Uniprot ID: Q9UMW8
  ENSP ID: ENSP00000215794
MSKAFGLLRQICQSILAESSQSPADLEEKKEEDSNMKREQPRERPRAWDYPHGLVGLHNIGQTCCLNSLIQVFVMNVDFTRILKRITVPRGADEQRRSVPFQMLLLLEKMQDSRQKAVRPLELAYCLQKCNVPLFVQHDAAQLYLKLWNLIKDQITDVHLVERLQALYTIRVKDSLICVDCAMESSRNSSMLTLPLSLFDVDSKPLKTLEDALHCFFQPRELSSKSKCFCENCGKKTRGKQVLKLTHLPQTLTIHLMRFSIRNSQTRKICHSLYFPQSLDFSQILPMKRESCDAEEQSGGQYELFAVIAHVGMADSGHYCVYIRNAVDGKWFCFNDSNICLVSWEDIQCTYGNPNYHWQETAYLLVYMKMEC

SEQ ID NO: 94792 - protein, 568 aa, Homo sapiens
  Payload ID: 18912
  Gene Name: ubiquitin specific peptidase 19
  ENSP ID: ENSP00000303503
MSGGASATGPRRGPPGLEDTTSKKKQKDRANQESKDGDPRKETGSRYVAQAGLEPLASGDPSASASHAAGITGSRHRTRLFFPSSSGSASTPQEEQTKEELLLDWRQSAEEVIVKLRVGVGPLQLEDVDAAFTDTDCVVRFAGGQQWGGVFYAEIKSSCAKVQTRKGSLLHLTLPKKVPMLTWPSLLKKPLGTQELVPGLRCQENGQELSPIALEPGPEPHRAKQEARNQKRAQGRGEVGAGAGPGAQAGPSAKRAVHLCRGPEGDGSRDDPGPRGDAPPFVADPATQVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARGAVGGAKVAVPTGPTPLDSTPPGGAPHPLTGQEEARAVEKDKSKARSEDTGLDSVATRTPMEHVTPKPETHLASPKPTCMVPPMPHSPVSGDS

SEQ ID NO: 94793 - protein, 1318 aa, Homo sapiens
  Payload ID: 18912
  Gene Name: ubiquitin specific peptidase 19
  Uniprot ID: O94966
  ENSP ID: ENSP00000381863
MSGGASATGPRRGPPGLEDTTSKKKQKDRANQESKDGDPRKETGSRYVAQAGLEPLASGDPSASASHAAGITGSRHRTRLFFPSSSGSASTPQEEQTKEGACEDPHDLLATPTPELLLDWRQSAEEVIVKLRVGVGPLQLEDVDAAFTDTDCVVRFAGGQQWGGVFYAEIKSSCAKVQTRKGSLLHLTLPKKVPMLTWPSLLVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQASRIWQELEAEEEPVPEGSGPLGPWGPQDWVGPLPRGPTTPDEGCLRYFVLGTVAALVALVLNVFYPLVSQSRWR

SEQ ID NO: 94794 - protein, 1358 aa, Homo sapiens
  Payload ID: 18912
  Gene Name: ubiquitin specific peptidase 19
  ENSP ID: ENSP00000381867
MSGGASATGPRRGPPGLEDTTSKKKQKDRANQESKDGDPRKASTPQEEQTKEELLLDWRQSAEEVIVKLRVGVGPLQLEDVDAAFTDTDCVVRFAGGQQWGGVFYAEIKSSCAKVQTRKGSLLHLTLPKKVPMLTWPSLLKPLGTQELVPGLRCQENGQELSPIALEPGPEPHRAKQEARNQKRAQGRGEVGAGAGPGAQAGPSAKRAVHLCRGPEGDGSRDDPGPRGDAPPFVADPATQVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARGAVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQASRIWQELEAEEEPVPEGSGPLGPWGPQDWVGPLPRGPTTPDEGCLRYFVLGTVAALVALVLNVFYPLVSQSRWR

SEQ ID NO: 94795 - protein, 1180 aa, Homo sapiens
  Payload ID: 18912
  Gene Name: ubiquitin specific peptidase 19
  ENSP ID: ENSP00000381870
  MOD_RES (1)..(1): Any amino acid
XSTPQEEQTKEELLLDWRQSAEEVIVKLRVGVGPLQLEDVDAAFTDTDCVVRFAGGQQWGGVFYAEIKSSCAKVQTRKGSLLHLTLPKKVPMLTWPSLLVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARGAVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQGLGPGQAPEVAPTRTAPERFAPPVDRPAPTYSNMEEVD

SEQ ID NO: 94796 - protein, 1321 aa, Homo sapiens
  Payload ID: 18912
  Gene Name: ubiquitin specific peptidase 19
  ENSP ID: ENSP00000381872
MSGGASATGPRRGPPGLEDTTSKKKQKDRANQESKDGDPRKASTPQEEQTKEELLLDWRQSAEEVIVKLRVGVGPLQLEDVDAAFTDTDCVVRFAGGQQWGGVFYAEIKSSCAKVQTRKGSLLHLTLPKKVPMLTWPSLLKPLGTQELVPGLRCQENGQELSPIALEPGPEPHRAKQEARNQKRAQGRGEVGAGAGPGAQAGPSAKRAVHLCRGPEGDGSRDDPGPRGDAPPFVADPATQVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARGAVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQGLGPGQAPEVAPTRTAPERFAPPVDRPAPTYSNMEEVD

SEQ ID NO: 94797 - protein, 1384 aa, Homo sapiens
  Payload ID: 18912
  Gene Name: ubiquitin specific peptidase 19
  Uniprot ID: O94966
  ENSP ID: ENSP00000395260
MSGGASATGPRRGPPGLEDTTSKKKQKDRANQESKDGDPRKETGSRYVAQAGLEPLASGDPSASASHAAGITGSRHRTRLFFPSSSGSASTPQEEQTKEGACEDPHDLLATPTPELLLDWRQSAEEVIVKLRVGVGPLQLEDVDAAFTDTDCVVRFAGGQQWGGVFYAEIKSSCAKVQTRKGSLLHLTLPKKVPMLTWPSLLKKPLGTQELVPGLRCQENGQELSPIALEPGPEPHRAKQEARNQKRAQGRGEVGAGAGPGAQAGPSAKRAVHLCRGPEGDGSRDDPGPRGDAPPFVADPATQVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARGAVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQGLGPGQAPEVAPTRTAPERFAPPVDRPAPTYSNMEEVD

SEQ ID NO: 94798 - protein, 1372 aa, Homo sapiens
  Payload ID: 18912
  Gene Name: ubiquitin specific peptidase 19
  Uniprot ID: O94966
  ENSP ID: ENSP00000400090
MSGGASATGPRRGPPGLEDTTSKKKQKDRANQESKDGDPRKETGSRYVAQAGLEPLASGDPSASASHAAGITGSRHRTRLFFPSSSGSASTPQEEQTKEGACEDPHDLLATPTPELLLDWRQSAEEVIVKLRVGVGPLQLEDVDAAFTDTDCVVRFAGGQQWGGVFYAEIKSSCAKVQTRKGSLLHLTLPKKKKPLGTQELVPGLRCQENGQELSPIALEPGPEPHRAKQEARNQKRAQGRGEVGAGAGPGAQAGPSAKRAVHLCRGPEGDGSRDDPGPRGDAPPFVADPATQVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQGLGPGQAPEVAPTRTAPERFAPPVDRPAPTYSNMEEVD

SEQ ID NO: 94799 - protein, 1419 aa, Homo sapiens
  Payload ID: 18912
  Gene Name: ubiquitin specific peptidase 19
  Uniprot ID: O94966
  ENSP ID: ENSP00000401197
MSGGASATGPRRGPPGLEDTTSKKKQKDRANQESKDGDPRKETGSRYVAQAGLEPLASGDPSASASHAAGITGSRHRTRLFFPSSSGSASTPQEEQTKEGACEDPHDLLATPTPELLLDWRQSAEEVIVKLRVGVGPLQLEDVDAAFTDTDCVVRFAGGQQWGGVFYAEIKSSCAKVQTRKGSLLHLTLPKKVPMLTWPSLLKKPLGTQELVPGLRCQENGQELSPIALEPGPEPHRAKQEARNQKRAQGRGEVGAGAGPGAQAGPSAKRAVHLCRGPEGDGSRDDPGPRGDAPPFVADPATQVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQASRIWQELEAEEEPVPEGSGPLGPWGPQDWVGPLPRGPTTPDEGCLRYFVLGTVAALVALVLNVFYPLVSQSRWR

SEQ ID NO: 94800 - protein, 120 aa, Homo sapiens
  Payload ID: 18912
  Gene Name: ubiquitin specific peptidase 19
  ENSP ID: ENSP00000428539
KPLGTQELVPGLRCQENGQELSPIALEPGPEPHRAKQEARNQKRAQGRGEVEADEQLCIPPLNSQTCLLGSEENLAPLAGEKAVPPGNDPVSPAMVRSRNPGKDDCAKEEMAVAADAATL

SEQ ID NO: 94801 - protein, 605 aa, Homo sapiens
  Payload ID: 18913
  Gene Name: ubiquitin specific peptidase 2
  Uniprot ID: O75604
  ENSP ID: ENSP00000260187
MSQLSSTLKRYTESARYTDAHYAKSGYGAYTPSSYGANLAASLLEKEKLGFKPVPTSSFLTRPRTYGPSSLLDYDRGRPLLRPDITGGGKRAESQTRGTERPLGSGLSGGSGFPYGVTNNCLSYLPINAYDQGVTLTQKLDSQSDLARDFSSLRTSDSYRIDPRNLGRSPMLARTRKELCTLQGLYQTASCPEYLVDYLENYGRKGSASQVPSQAPPSRVPEIISPTYRPIGRYTLWETGKGQAPGPSRSSSPGRDGMNSKSAQGLAGLRNLGNTCFMNSILQCLSNTRELRDYCLQRLYMRDLHHGSNAHTALVEEFAKLIQTIWTSSPNDVVSPSEFKTQIQRYAPRFVGYNQQDAQEFLRFLLDGLHNEVNRVTLRPKSNPENLDHLPDDEKGRQMWRKYLEREDSRIGDLFVGQLKSSLTCTDCGYCSTVFDPFWDLSLPIAKRGYPEVTLMDCMRLFTKEDVLDGDEKPTCCRCRGRKRCIKKFSIQRFPKILVLHLKRFSESRIRTSKLTTFVNFPLRDLDLREFASENTNHAVYNLYAVSNHSGTTMGGHYTAYCRSPGTGEWHTFNDSSVTPMSSSQVRTSDAYLLFYELASPPSRM

SEQ ID NO: 94802 - protein, 362 aa, Homo sapiens
  Payload ID: 18913
  Gene Name: ubiquitin specific peptidase 2
  Uniprot ID: O75604
  ENSP ID: ENSP00000407842
MLVPGSTRPYSKKRQNSKSAQGLAGLRNLGNTCFMNSILQCLSNTRELRDYCLQRLYMRDLHHGSNAHTALVEEFAKLIQTIWTSSPNDVVSPSEFKTQIQRYAPRFVGYNQQDAQEFLRFLLDGLHNEVNRVTLRPKSNPENLDHLPDDEKGRQMWRKYLEREDSRIGDLFVGQLKSSLTCTDCGYCSTVFDPFWDLSLPIAKRGYPEVTLMDCMRLFTKEDVLDGDEKPTCCRCRGRKRCIKKFSIQRFPKILVLHLKRFSESRIRTSKLTTFVNFPLRDLDLREFASENTNHAVYNLYAVSNHSGTTMGGHYTAYCRSPGTGEWHTFNDSSVTPMSSSQVRTSDAYLLFYELASPPSRM

SEQ ID NO: 94803 - protein, 137 aa, Homo sapiens
  Payload ID: 18913
  Gene Name: ubiquitin specific peptidase 2
  ENSP ID: ENSP00000431857
MSQLSSTLKRYTESARYTDAHYAKSGYGAYTPSSYGANLAASLLEKEKLGFKPVPTSSFLTRPRTYGPSSLLDYDRGRPLLRPDITGGGKRAESQTRGTERPLGSGLSGGSGFPYGVTNNCLSYLPINAYDQGVTLT

SEQ ID NO: 94804 - protein, 167 aa, Homo sapiens
  Payload ID: 18913
  Gene Name: ubiquitin specific peptidase 2
  ENSP ID: ENSP00000433977
MSQLSSTLKRYTESARYTDAHYAKSGYGAYTPSSYGANLAASLLEKEKLGFKPVPTSSFLTRPRTYGPSSLLDYDRGRPLLRPDITGGGKRAESQTRGTERPLGSGLSGGSGFPYGVTNNCLSYLPINAYDQGVTLTQKLDSQSDLARDFSSLRTSDSYRIDPRNLG

SEQ ID NO: 94805 - protein, 396 aa, Homo sapiens
  Payload ID: 18913
  Gene Name: ubiquitin specific peptidase 2
  Uniprot ID: O75604
  ENSP ID: ENSP00000436952
MRTSYTVTLPEDPPAAPFPALAKELRPRSPLSPSLLLSTFVGLLLNKAKNSKSAQGLAGLRNLGNTCFMNSILQCLSNTRELRDYCLQRLYMRDLHHGSNAHTALVEEFAKLIQTIWTSSPNDVVSPSEFKTQIQRYAPRFVGYNQQDAQEFLRFLLDGLHNEVNRVTLRPKSNPENLDHLPDDEKGRQMWRKYLEREDSRIGDLFVGQLKSSLTCTDCGYCSTVFDPFWDLSLPIAKRGYPEVTLMDCMRLFTKEDVLDGDEKPTCCRCRGRKRCIKKFSIQRFPKILVLHLKRFSESRIRTSKLTTFVNFPLRDLDLREFASENTNHAVYNLYAVSNHSGTTMGGHYTAYCRSPGTGEWHTFNDSSVTPMSSSQVRTSDAYLLFYELASPPSRM

SEQ ID NO: 94806 - protein, 914 aa, Homo sapiens
  Payload ID: 18914
  Gene Name: ubiquitin specific peptidase 20
  Uniprot ID: Q9Y2K6
  ENSP ID: ENSP00000313811
MGDSRDLCPHLDSIGEVTKEDLLLKSKGTCQSCGVTGPNLWACLQVACPYVGCGESFADHSTIHAQAKKHNLTVNLTTFRLWCYACEKEVFLEQRLAAPLLGSSSKFSEQDSPPPSHPLKAVPIAVADEGESESEDDDLKPRGLTGMKNLGNSCYMNAALQALSNCPPLTQFFLECGGLVRTDKKPALCKSYQKLVSEVWHKKRPSYVVPTSLSHGIKLVNPMFRGYAQQDTQEFLRCLMDQLHEELKEPVVATVALTEARDSDSSDTDEKREGDRSPSEDEFLSCDSSSDRGEGDGQGRGGGSSQAETELLIPDEAGRAISEKERMKDRKFSWGQQRTNSEQVDEDADVDTAMAALDDQPAEAQPPSPRSSSPCRTPEPDNDAHLRSSSRPCSPVHHHEGHAKLSSSPPRASPVRMAPSYVLKKAQVLSAGSRRRKEQRYRSVISDIFDGSILSLVQCLTCDRVSTTVETFQDLSLPIPGKEDLAKLHSAIYQNVPAKPGACGDSYAAQGWLAFIVEYIRRFVVSCTPSWFWGPVVTLEDCLAAFFAADELKGDNMYSCERCKKLRNGVKYCKVLRLPEILCIHLKRFRHEVMYSFKINSHVSFPLEGLDLRPFLAKECTSQITTYDLLSVICHHGTAGSGHYIAYCQNVINGQWYEFDDQYVTEVHETVVQNAEGYVLFYRKSSEEAMRERQQVVSLAAMREPSLLRFYVSREWLNKFNTFAEPGPITNQTFLCSHGGIPPHKYHYIDDLVVILPQNVWEHLYNRFGGGPAVNHLYVCSICQVEIEALAKRRRIEIDTFIKLNKAFQAEESPGVIYCISMQWFREWEAFVKGKDNEPPGPIDNSRIAQVKGSGHVQLKQGADYGQISEETWTYLNSLYGGGPEIAIRQSVAQPLGPENLHGEQKIEAETRAV

SEQ ID NO: 94807 - protein, 914 aa, Homo sapiens; identical to SEQ ID NO: 94806
  Payload ID: 18914
  Gene Name: ubiquitin specific peptidase 20
  Uniprot ID: Q9Y2K6
  ENSP ID: ENSP00000351122

SEQ ID NO: 94808 - protein, 914 aa, Homo sapiens; identical to SEQ ID NO: 94806
  Payload ID: 18914
  Gene Name: ubiquitin specific peptidase 20
  Uniprot ID: Q9Y2K6
  ENSP ID: ENSP00000361506

SEQ ID NO: 94809 - protein, 565 aa, Homo sapiens
  Payload ID: 18915
  Gene Name: ubiquitin specific peptidase 21
  Uniprot ID: Q9UK80
  ENSP ID: ENSP00000289865
MPQASEHRLGRTREPPVNIQPRVGSKLPFAPRARSKERRNPASGPNPMLRPLPPRPGLPDERLKKLELGRGRTSGPRPRGPLRADHGVPLPGSPPPTVALPLPSRTNLARSKSVSSGDLRPMGIALGGHRGTGELGAALSRLALRPEPPTLRRSTSLRRLGGFPGPPTLFSIRTEPPASHGSFHMISARSSEPFYSDDKMAHHTLLLGSGHVGLRNLGNTCFLNAVLQCLSSTRPLRDFCLRRDFRQEVPGGGRAQELTEAFADVIGALWHPDSCEAVNPTRFRAVFQKYVPSFSGYSQQDAQEFLKLLMERLHLEINRRGRRAPPILANGPVPSPPRRGGALLEEPELSDDDRANLMWKRYLEREDSKIVDLFVGQLKSCLKCQACGYRSTTFEVFCDLSLPIPKKGFAGGKVSLRDCFNLFTKEEELESENAPVCDRCRQKTRSTKKLTVQRFPRILVLHLNRFSASRGSIKKSSVGVDFPLQRLSLGDFASDKAGSPVYQLYALCNHSGSVHYGHYTALCRCQTGWHVYNDSRVSPVSENQVASSEGYVLFYQLMQEPPRCL

SEQ ID NO: 94810 - protein, 551 aa, Homo sapiens
  Payload ID: 18915
  Gene Name: ubiquitin specific peptidase 21
  Uniprot ID: Q9UK80
  ENSP ID: ENSP00000356980
MPQASEHRLGRTREPPVNIQPRVGSKLPFAPRARSKERRNPASGPNPMLRPLPPRPGLPDERLKKLELGRGRTSGPRPRGPLRADHGVPLPGSPPPTVALPLPSRTNLARSKSVSSGDLRPMGIALGGHRGTGELGAALSRLALRPEPPTLRRSTSLRRLGGFPGPPTLFSIRTEPPASHGSFHMISARSSEPFYSDDKMAHHTLLLGSGHVGLRNLGNTCFLNAVLQCLSSTRPLRDFCLRRDFRQEVPGGGRAQELTEAFADVIGALWHPDSCEAVNPTRFRAVFQKYVPSFSGYSQQDAQEFLKLLMERLHLEINRRGRRAPPILANGPVPSPPRRGGALLEEPELSDDDRANLMWKRYLEREDSKIVDLFVGQLKSCLKCQACGYRSTTFEVFCDLSLPIPKKGFAGGKVSLRDCFNLFTKEEELESENAPVCDRCRQKTRSTKKLTVQRFPRILVLHLNRFSASRGSIKKSSVGVDFPLQRLSLGDFASDKAGSVHYGHYTALCRCQTGWHVYNDSRVSPVSENQVASSEGYVLFYQLMQEPPRCL

SEQ ID NO: 94811 - protein, 565 aa, Homo sapiens; identical to SEQ ID NO: 94809
  Payload ID: 18915
  Gene Name: ubiquitin specific peptidase 21
  Uniprot ID: Q9UK80
  ENSP ID: ENSP00000356981

SEQ ID NO: 94812 - protein, 253 aa, Homo sapiens
  Payload ID: 18915
  Gene Name: ubiquitin specific peptidase 21
  ENSP ID: ENSP00000476344
MPQASEHRLGRTREPPVNIQPRVGSKLPFAPRARSKERRNPASGPNPMLRPLPPRPGLPDERLKKLELGRGRTSGPRPRGPLRADHGVPLPGSPPPTVALPLPSRTNLARSKSVSSGDLRPMGIALGGHRGTGELGAALSRLALRPEPPTLRRSTSLRRLGGFPGPPTLFSIRTEPPASHGSFHMISARSSEPFYSDDKMAHHTLLLGSGHVGLRNLGNTCFLNAVLQCLSSTRPLRDFCLRRDFRQEVPGGG

SEQ ID NO: 94813 - protein, 117 aa, Homo sapiens
  Payload ID: 18915
  Gene Name: ubiquitin specific peptidase 21
  ENSP ID: ENSP00000476830
MPQASEHRLGRTREPPVNIQPRVGSKLPFAPRARSKERRNPASGPNPMLRPLPPRPGLPDERLKKLELGRGRTSGPRPRGPLRADHGVPLPGSPPPTVALPLPSRTNLARSKSVSSG

SEQ ID NO: 94814 - protein, 525 aa, Homo sapiens
  Payload ID: 18916
  Gene Name: ubiquitin specific peptidase 22
  Uniprot ID: Q9UPT9
  ENSP ID: ENSP00000261497
MVSRPEPEGEAMDAELAVAPPGCSHLGSFKVDNWKQNLRAIYQCFVWSGTAEARKRKAKSCICHVCGVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNPNHCNCIIDQIFTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRFEHSAKLRRKITTYVSFPLELDMTPFMASSKESRMNGQYQQPTDSLNNDNKYSLFAVVNHQGTLESGHYTSFIRQHKDQWFKCDDAIITKASIKDVLDSEGYLLFYHKQFLEYE

SEQ ID NO: 94815 - protein, 513 aa, Homo sapiens
  Payload ID: 18916
  Gene Name: ubiquitin specific peptidase 22
  Uniprot ID: Q9UPT9
  ENSP ID: ENSP00000440950
MAPGWPSLSAGSRQEAPQLAAGGSAYQAVGRQFQPRATALQGPSQAKSCICHVCGVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNPNHCNCIIDQIFTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRFEHSAKLRRKITTYVSFPLELDMTPFMASSKESRMNGQYQQPTDSLNNDNKYSLFAVVNHQGTLESGHYTSFIRQHKDQWFKCDDAIITKASIKDVLDSEGYLLFYHKQFLEYE

SEQ ID NO: 94816 - protein, 194 aa, Homo sapiens
  Payload ID: 18916
  Gene Name: ubiquitin specific peptidase 22
  ENSP ID: ENSP00000464398
MAPGWPSLSAGSRQEAPQLAAGGSAYQAVGRQFQPRATALQGPSQVTATGGPANSSRLGGAFGWESAGPGWRPDLRRSSSSPRLFAAELRPAQTGSVLGLTSRAAQPQHAPASPVLWKRQGTSSRQGPGRRLCTRRTILRAYDNSRRPSPVSAMSVASTSTGCIPASTVSSSAVSQRSIFTSMRRRSGTTWPLI

SEQ ID NO: 94817 - protein, 102 aa, Homo sapiens
  Payload ID: 18916
  Gene Name: ubiquitin specific peptidase 22
  ENSP ID: ENSP00000464499
  MOD_RES (1)..(1): Any amino acid
XELLKHNPKRRKITSNCTIGLRGLINLGNTCFMNCIVQALTHTPLLRDFFLSDRHRCEMQSPSSCLVCEMSSLFQEWSLHHHRPLLGHQLGSPRLFHPILAP

SEQ ID NO: 94818 - protein, 125 aa, Homo sapiens
  Payload ID: 18916
  Gene Name: ubiquitin specific peptidase 22
  ENSP ID: ENSP00000468457
MYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQE

SEQ ID NO: 94819 - protein, 107 aa, Homo sapiens
  Payload ID: 18916
  Gene Name: ubiquitin specific peptidase 22
  ENSP ID: ENSP00000468748
MYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCE

SEQ ID NO: 94820 - protein, 2620 aa, Homo sapiens
  Payload ID: 18917
  Gene Name: ubiquitin specific peptidase 24
  Uniprot ID: Q9UPU5
  ENSP ID: ENSP00000294383
MESEEEQHMTTLLCMGFSDPATIRKALRLAKNDINEAVALLTNERPGLDYGGYEPMDSGGGPSPGPGGGPRGDGGGDGGGGGPSRGGSTGGGGGFDPPPAYHEVVDAEKNDENGNCSGEGIEFPTTNLYELESRVLTDHWSIPYKREESLGKCLLASTYLARLGLSESDENCRRFMDRCMPEAFKKLLTSSAVHKWGTEIHEGIYNMLMLLIELVAERIKQDPIPTGLLGVLTMAFNPDNEYHFKNRMKVSQRNWAEVFGEGNMFAVSPVSTFQKEPHGWVVDLVNKFGELGGFAAIQAKLHSEDIELGAVSALIQPLGVCAEYLNSSVVQPMLDPVILTTIQDVRSVEEKDLKDKRLVSIPELLSAVKLLCMRFQPDLVTIVDDLRLDILLRMLKSPHFSAKMNSLKEVTKLIEDSTLSKSVKNAIDTDRLLDWLVENSVLSIALEGNIDQAQYCDRIKGIIELLGSKLSLDELTKIWKIQSGQSSTVIENIHTIIAAAAVKFNSDQLNHLFVLIQKSWETESDRVRQKLLSLIGRIGREARFETTSGKVLDVLWELAHLPTLPSSLIQQALEEHLTILSDAYAVKEAIKRSYIIKCIEDIKRPGEWSGLEKNKKDGFKSSQLNNPQFVWVVPALRQLHEITRSFIKQTYQKQDKSIIQDLKKNFEIVKLVTGSLIACHRLAAAVAGPGGLSGSTLVDGRYTYREYLEAHLKFLAFFLQEATLYLGWNRAKEIWECLVTGQDVCELDREMCFEWFTKGQHDLESDVQQQLFKEKILKLESYEITMNGFNLFKTFFENVNLCDHRLKRQGAQLYVEKLELIGMDFIWKIAMESPDEEIANEAIQLIINYSYINLNPRLKKDSVSLHKKFIADCYTRLEAASSALGGPTLTHAVTRATKMLTATAMPTVATSVQSPYRSTKLVIIERLLLLAERYVITIEDFYSVPRTILPHGASFHGHLLTLNVTYESTKDTFTVEAHSNETIGSVRWKIAKQLCSPVDNIQIFTNDSLLTVNKDQKLLHQLGFSDEQILTVKTSGSGTPSGSSADSSTSSSSSSSGVFSSSYAMEQEKSLPGVVMALVCNVFDMLYQLANLEEPRITLRVRKLLLLIPTDPAIQEALDQLDSLGRKKTLLSESSSQSSKSPSLSSKQQHQPSASSILESLFRSFAPGMSTFRVLYNLEVLSSKLMPTADDDMARSCAKSFCENFLKAGGLSLVVNVMQRDSIPSEVDYETRQGVYSICLQLARFLLVGQTMPTLLDEDLTKDGIEALSSRPFRNVSRQTSRQMSLCGTPEKSSYRQLSVSDRSSIRVEEIIPAARVAIQTMEVSDFTSTVACFMRLSWAAAAGRLDLVGSSQPIKESNSLCPAGIRNRLSSSGSNCSSGSEGEPVALHAGICVRQQSVSTKDSLIAGEALSLLVTCLQLRSQQLASFYNLPCVADFIIDILLGSPSAEIRRVACDQLYTLSQTDTSAHPDVQKPNQFLLGVILTAQLPLWSPTSIMRGVNQRLLSQCMEYFDLRCQLLDDLTTSEMEQLRISPATMLEDEITWLDNFEPNRTAECETSEADNILLAGHLRLIKTLLSLCGAEKEMLGSSLIKPLLDDFLFRASRIILNSHSPAGSAAISQQDFHPKCSTANSRLAAYEVLVMLADSSPSNLQIIIKELLSMHHQPDPALTKEFDYLPPVDSRSSSGFVGLRNGGATCYMNAVFQQLYMQPGLPESLLSVDDDTDNPDDSVFYQVQSLFGHLMESKLQYYVPENFWKIFKMWNKELYVREQQDAYEFFTSLIDQMDEYLKKMGRDQIFKNTFQGIYSDQKICKDCPHRYEREEAFMALNLGVTSCQSLEISLDQFVRGEVLEGSNAYYCEKCKEKRITVKRTCIKSLPSVLVIHLMRFGFDWESGRSIKYDEQIRFPWMLNMEPYTVSGMARQDSSSEVGENGRSVDQGGGGSPRKKVALTENYELVGVIVHSGQAHAGHYYSFIKDRRGCGKGKWYKFNDTVIEEFDLNDETLEYECFGGEYRPKVYDQTNPYTDVRRRYWNAYMLFYQRVSDQNSPVLPKKSRVSVVRQEAEDLSLSAPSSPEISPQSSPRPHRPNNDRLSILTKLVKKGEKKGLFVEKMPARIYQMVRDENLKFMKNRDVYSSDYFSFVLSLASLNATKLKHPYYPCMAKVSLQLAIQFLFQTYLRTKKKLRVDTEEWIATIEALLSKSFDACQWLVEYFISSEGRELIKIFLLECNVREVRVAVATILEKTLDSALFYQDKLKSLHQLLEVLLALLDKDVPENCKNCAQYFFLFNTFVQKQGIRAGDLLLRHSALRHMISFLLGASRQNNQIRRWSSAQAREFGNLHNTVALLVLHSDVSSQRNVAPGIFKQRPPISIAPSSPLLPLHEEVEALLFMSEGKPYLLEVMFALRELTGSLLALIEMVVYCCFCNEHFSFTMLHFIKNQLETAPPHELKNTFQLLHEILVIEDPIQVERVKFVFETENGLLALMHHSNHVDSSRCYQCVKFLVTLAQKCPAAKEYFKENSHHWSWAVQWLQKKMSEHYWTPQSNVSNETSTGKTFQRTISAQDTLAYATALLNEKEQSGSSNGSESSPANENGDRHLQQGSESPMMIGELRSDLDDVDP

SEQ ID NO: 94821 - protein, 150 aa, Homo sapiens
  Payload ID: 18917
  Gene Name: ubiquitin specific peptidase 24
  ENSP ID: ENSP00000489026
ERVKFVFETENGLLALMHHSNHVDSSRCYQCVKFLVTLAQKCPAAKEYFKENSHHWSWAVQWLQKKMSEHYWTPQSNVSNETSTGKTFQRTISAQDTLAYATALLNEKEQSGSSNGSESSPANENGDRHLQQVTESPSFALTSLPGNVDS

SEQ ID NO: 94822 - protein, 34 aa, Homo sapiens
  Payload ID: 18917
  Gene Name: ubiquitin specific peptidase 24
  ENSP ID: ENSP00000489531
PGEWSGLEKNKKDGFKAARWADWGLCLPARLHRN

SEQ ID NO: 94823 - protein, 1055 aa, Homo sapiens
  Payload ID: 18918
  Gene Name: ubiquitin specific peptidase 25
  Uniprot ID: Q9UHP3
  ENSP ID: ENSP00000285679
MTVEQNVLQQSAAQKHQQTFLNQLREITGINDTQILQQALKDSNGNLELAVAFLTAKNAKTPQQEETTYYQTALPGNDRYISVGSQADTNVIDLTGDDKDDLQRAIALSLAESNRAFRETGITDEEQAISRVLEASIAENKACLKRTPTEVWRDSRNPYDRKRQDKAPVGLKNVGNTCWFSAVIQSLFNLLEFRRLVLNYKPPSNAQDLPRNQKEHRNLPFMRELRYLFALLVGTKRKYVDPSRAVEILKDAFKSNDSQQQDVSEFTHKLLDWLEDAFQMKAEEETDEEKPKNPMVELFYGRFLAVGVLEGKKFENTEMFGQYPLQVNGFKDLHECLEAAMIEGEIESLHSENSGKSGQEHWFTELPPVLTFELSRFEFNQALGRPEKIHNKLEFPQVLYLDRYMHRNREITRIKREEIKRLKDYLTVLQQRLERYLSYGSGPKRFPLVDVLQYALEFASSKPVCTSPVDDIDASSPPSGSIPSQTLPSTTEQQGALSSELPSTSPSSVAAISSRSVIHKPFTQSRIPPDLPMHPAPRHITEEELSVLESCLHRWRTEIENDTRDLQESISRIHRTIELMYSDKSMIQVPYRLHAVLVHEGQANAGHYWAYIFDHRESRWMKYNDIAVTKSSWEELVRDSFGGYRNASAYCLMYINDKAQFLIQEEFNKETGQPLVGIETLPPDLRDFVEEDNQRFEKELEEWDAQLAQKALQEKLLASQKLRESETSVTTAQAAGDPEYLEQPSRSDFSKHLKEETIQIITKASHEHEDKSPETVLQSAIKLEYARLVKLAQEDTPPETDYRLHHVVVYFIQNQAPKKIIEKTLLEQFGDRNLSFDERCHNIMKVAQAKLEMIKPEEVNLEEYEEWHQDYRKFRETTMYLIIGLENFQRESYIDSLLFLICAYQNNKELLSKGLYRGHDEELISHYRRECLLKLNEQAAELFESGEDREVNNGLIIMNEFIVPFLPLLLVDEMEEKDILAVEDMRNRWCSYLGQEMEPHLQEKLTDFLPKLLDCSMEIKSFHEPPKLPSYSTHELCERFARIMLSLSRTPADGR

SEQ ID NO: 94824 - protein, 1087 aa, Homo sapiens
  Payload ID: 18918
  Gene Name: ubiquitin specific peptidase 25
  Uniprot ID: Q9UHP3
  ENSP ID: ENSP00000285681
MTVEQNVLQQSAAQKHQQTFLNQLREITGINDTQILQQALKDSNGNLELAVAFLTAKNAKTPQQEETTYYQTALPGNDRYISVGSQADTNVIDLTGDDKDDLQRAIALSLAESNRAFRETGITDEEQAISRVLEASIAENKACLKRTPTEVWRDSRNPYDRKRQDKAPVGLKNVGNTCWFSAVIQSLFNLLEFRRLVLNYKPPSNAQDLPRNQKEHRNLPFMRELRYLFALLVGTKRKYVDPSRAVEILKDAFKSNDSQQQDVSEFTHKLLDWLEDAFQMKAEEETDEEKPKNPMVELFYGRFLAVGVLEGKKFENTEMFGQYPLQVNGFKDLHECLEAAMIEGEIESLHSENSGKSGQEHWFTELPPVLTFELSRFEFNQALGRPEKIHNKLEFPQVLYLDRYMHRNREITRIKREEIKRLKDYLTVLQQRLERYLSYGSGPKRFPLVDVLQYALEFASSKPVCTSPVDDIDASSPPSGSIPSQTLPSTTEQQGALSSELPSTSPSSVAAISSRSVIHKPFTQSRIPPDLPMHPAPRHITEEELSVLESCLHRWRTEIENDTRDLQESISRIHRTIELMYSDKSMIQVPYRLHAVLVHEGQANAGHYWAYIFDHRESRWMKYNDIAVTKSSWEELVRDSFGGYRNASAYCLMYINDKAQFLIQEEFNKETGQPLVGIETLPPDLRDFVEEDNQRFEKELEEWDAQLAQKALQEKLLASQKLRESETSVTTAQAAGDPEYLEQPSRSDFSKHLKEETIQIITKASHEHEDKSPETVLQSIMMTPNMQGIIMAIGKSRSVYDRCGPEAGFFKAIKLEYARLVKLAQEDTPPETDYRLHHVVVYFIQNQAPKKIIEKTLLEQFGDRNLSFDERCHNIMKVAQAKLEMIKPEEVNLEEYEEWHQDYRKFRETTMYLIIGLENFQRESYIDSLLFLICAYQNNKELLSKGLYRGHDEELISHYRRECLLKLNEQAAELFESGEDREVNNGLIIMNEFIVPFLPLLLVDEMEEKDILAVEDMRNRWCSYLGQEMEPHLQEKLTDFLPKLLDCSMEIKSFHEPPKLPSYSTHELCERFARIMLSLSRTPADGR

SEQ ID NO: 94825 - protein, 450 aa, Homo sapiens
  Payload ID: 18918
  Gene Name: ubiquitin specific peptidase 25
  ENSP ID: ENSP00000299574
MTVEQNVLQQSAAQKHQQTFLNQLREITGINDTQILQQALKDSNGNLELAVAFLTAKNAKTPQQEETTYYQTALPGNDRYISVGSQADTNVIDLTGDDKDDLQRAIALSLAESNRAFRETGITDEEQAISRVLEASIAENKACLKRTPTEVWRDSRNPYDRKRQDKAPVGLKNVGNTCWFSAVIQSLFNLLEFRRLVLNYKPPSNAQDLPRNQKEHRNLPFMRELRYLFALLVGTKRKYVDPSRAVEILKDAFKSNDSQQEWHQDYRKFRETTMYLIIGLENFQRESYIDSLLFLICAYQNNKELLSKGLYRGHDEELISHYRRECLLKLNEQAAELFESGEDREVNNGLIIMNEFIVPFLPLLLVDEMEEKDILAVEDMRNRWCSYLGQEMEPHLQEKLTDFLPKLLDCSMEIKSFHEPPKLPSYSTHELCERFARIMLSLSRTPADGR

SEQ ID NO: 94826 - protein, 1125 aa, Homo sapiens
  Payload ID: 18918
  Gene Name: ubiquitin specific peptidase 25
  Uniprot ID: Q9UHP3
  ENSP ID: ENSP00000383044
MTVEQNVLQQSAAQKHQQTFLNQLREITGINDTQILQQALKDSNGNLELAVAFLTAKNAKTPQQEETTYYQTALPGNDRYISVGSQADTNVIDLTGDDKDDLQRAIALSLAESNRAFRETGITDEEQAISRVLEASIAENKACLKRTPTEVWRDSRNPYDRKRQDKAPVGLKNVGNTCWFSAVIQSLFNLLEFRRLVLNYKPPSNAQDLPRNQKEHRNLPFMRELRYLFALLVGTKRKYVDPSRAVEILKDAFKSNDSQQQDVSEFTHKLLDWLEDAFQMKAEEETDEEKPKNPMVELFYGRFLAVGVLEGKKFENTEMFGQYPLQVNGFKDLHECLEAAMIEGEIESLHSENSGKSGQEHWFTELPPVLTFELSRFEFNQALGRPEKIHNKLEFPQVLYLDRYMHRNREITRIKREEIKRLKDYLTVLQQRLERYLSYGSGPKRFPLVDVLQYALEFASSKPVCTSPVDDIDASSPPSGSIPSQTLPSTTEQQGALSSELPSTSPSSVAAISSRSVIHKPFTQSRIPPDLPMHPAPRHITEEELSVLESCLHRWRTEIENDTRDLQESISRIHRTIELMYSDKSMIQVPYRLHAVLVHEGQANAGHYWAYIFDHRESRWMKYNDIAVTKSSWEELVRDSFGGYRNASAYCLMYINDKAQFLIQEEFNKETGQPLVGIETLPPDLRDFVEEDNQRFEKELEEWDAQLAQKALQEKLLASQKLRESETSVTTAQAAGDPEYLEQPSRSDFSKHLKEETIQIITKASHEHEDKSPETVLQSKPENTTSQPLSNQRVVEVAIPHVGKFMIESKEGGYDDEIMMTPNMQGIIMAIGKSRSVYDRCGPEAGFFKAIKLEYARLVKLAQEDTPPETDYRLHHVVVYFIQNQAPKKIIEKTLLEQFGDRNLSFDERCHNIMKVAQAKLEMIKPEEVNLEEYEEWHQDYRKFRETTMYLIIGLENFQRESYIDSLLFLICAYQNNKELLSKGLYRGHDEELISHYRRECLLKLNEQAAELFESGEDREVNNGLIIMNEFIVPFLPLLLVDEMEEKDILAVEDMRNRWCSYLGQEMEPHLQEKLTDFLPKLLDCSMEIKSFHEPPKLPSYSTHELCERFARIMLSLSRTPADGR

SEQ ID NO: 94827 - protein, 229 aa, Homo sapiens
  Payload ID: 18918
  Gene Name: ubiquitin specific peptidase 25
  ENSP ID: ENSP00000402354
  MOD_RES (1)..(1): Any amino acid
XPETVLQSKPENTTSQPLSNQRVVEVAIPHVGKFMIESKEGGYDDEIMMTPNMQGIIMAIGKSRSVYDRCGPEAGFFKAIKLEYARLVKLAQEDTPPETDYRLHHVVVYFIQNQAPKKIIEKTLLEQFGDRNLSFDERCHNIMKVAQAKLEMIKPEEVNLEEYEEWHQDYRKFRETTMYLIIGLENFQRESYIDSLLFLICAYQNNKELLSKGLYRGHDEELISHYRRE

SEQ ID NO: 94828 - protein, 204 aa, Homo sapiens
  Payload ID: 18918
  Gene Name: ubiquitin specific peptidase 25
  ENSP ID: ENSP00000404086
  MOD_RES (1)..(1): Any amino acid
XIKRLKDYLTVLQQRLESTTEQQGALSSELPSTSPSSVAAISSRSVIHKPFTQSRIPPDLPMHPAPRHITEEELSVLESCLHRWRTEIENDTRDLQESISRIHRTIELMYSDKSMIQVPYRLHAVLVHEGQANAGHYWAYIFDHRESRWMKYNDIAVTKSSWEELVRDSFGGYRNASAYCLMYINDKAQFLIQEEFNKETGQPL

SEQ ID NO: 94829 - protein, 913 aa, Homo sapiens
  Payload ID: 18919
  Gene Name: ubiquitin specific peptidase 26
  Uniprot ID: Q9BXU7
  ENSP ID: ENSP00000359869
MAALFLRGFVQIGNCKTGISKSKEAFIEAVERKKKDRLVLYFKSGKYSTFRLSDNIQNVVLKSYRGNQNHLHLTLQNNNGLFIEGLSSTDAEQLKIFLDRVHQNEVQPPVRPGKGGSVFSSTTQKEINKTSFHKVDEKSSSKSFEIAKGSGTGVLQRMPLLTSKLTLTCGELSENQHKKRKRMLSSSSEMNEEFLKENNSVEYKKSKADCSRCVSYNREKQLKLKELEENKKLECESSCIMNATGNPYLDDIGLLQALTEKMVLVFLLQQGYSDGYTKWDKLKLFFELFPEKICHGLPNLGNTCYMNAVLQSLLSIPSFADDLLNQSFPWGKIPLNALTMCLARLLFFKDTYNIEIKEMLLLNLKKAISAAAEIFHGNAQNDAHEFLAHCLDQLKDNMEKLNTIWKPKSEFGEDNFPKQVFADDPDTSGFSCPVITNFELELLHSIACKACGQVILKTELNNYLSINLPQRIKAHPSSIQSTFDLFFGAEELEYKCAKCEHKTSVGVHSFSRLPRILIVHLKRYSLNEFCALKKNDQEVIISKYLKVSSHCNEGTRPPLPLSEDGEITDFQLLKVIRKMTSGNISVSWPATKESKDILAPHIGSDKESEQKKGQTVFKGASRRQQQKYLGKNSKPNELESVYSGDRAFIEKEPLAHLMTYLEDTSLCQFHKAGGKPASSPGTPLSKVDFQTVPENPKRKKYVKTSKFVAFDRIINPTKDLYEDKNIRIPERFQKVSEQTQQCDGMRICEQAPQQALPQSFPKPGTQGHTKNLLRPTKLNLQKSNRNSLLALGSNKNPRNKDILDKIKSKAKETKRNDDKGDHTYRLISVVSHLGKTLKSGHYICDAYDFEKQIWFTYDDMRVLGIQEAQMQEDRRCTGYIFFYMHNEIFEEMLKREENAQLNSKEVEETLQKE

SEQ ID NO: 94830 - protein, 913 aa, Homo sapiens; identical to SEQ ID NO: 94829
  Payload ID: 18919
  Gene Name: ubiquitin specific peptidase 26
  Uniprot ID: Q9BXU7
  ENSP ID: ENSP00000423390

SEQ ID NO: 94831 - protein, 438 aa, Homo sapiens
  Payload ID: 18920
  Gene Name: ubiquitin specific peptidase 27, X-linked
  Uniprot ID: A6NNY8
  ENSP ID: ENSP00000483631
MCKDYVYDKDIEQIAKEEQGEALKLQASTSTEVSHQQCSVPGLGEKFPTWETTKPELELLGHNPRRRRITSSFTIGLRGLINLGNTCFMNCIVQALTHTPILRDFFLSDRHRCEMPSPELCLVCEMSSLFRELYSGNPSPHVPYKLLHLVWIHARHLAGYRQQDAHEFLIAALDVLHRHCKGDDVGKAANNPNHCNCIIDQIFTGGLQSDVTCQACHGVSTTIDPCWDISLDLPGSCTSFWPMSPGRESSVNGESHIPGITTLTDCLRRFTRPEHLGSSAKIKCGSCQSYQESTKQLTMNKLPVVACFHFKRFEHSAKQRRKITTYISFPLELDMTPFMASSKESRMNGQLQLPTNSGNNENKYSLFAVVNHQGTLESGHYTSFIRHHKDQWFKCDDAVITKASIKDVLDSEGYLLFYHKQVLEHESEKVKEMNTQAY

SEQ ID NO: 94832 - protein, 1077 aa, Homo sapiens
  Payload ID: 18921
  Gene Name: ubiquitin specific peptidase 28
  Uniprot ID: Q96RU2
  ENSP ID: ENSP00000003302
MTAELQQDDAAGAADGHGSSCQMLLNQLREITGIQDPSFLHEALKASNGDITQAVSLLTDERVKEPSQDTVATEPSEVEGSAANKEVLAKVIDLTHDNKDDLQAAIALSLLESPKIQADGRDLNRMHEATSAETKRSKRKRCEVWGENPNPNDWRRVDGWPVGLKNVGNTCWFSAVIQSLFQLPEFRRLVLSYSLPQNVLENCRSHTEKRNIMFMQELQYLFALMMGSNRKFVDPSAALDLLKGAFRSSEEQQQDVSEFTHKLLDWLEDAFQLAVNVNSPRNKSENPMVQLFYGTFLTEGVREGKPFCNNETFGQYPLQVNGYRNLDECLEGAMVEGDVELLPSDHSVKYGQERWFTKLPPVLTFELSRFEFNQSLGQPEKIHNKLEFPQIIYMDRYMYRSKELIRNKRECIRKLKEEIKILQQKLERYVKYGSGPARFPLPDMLKYVIEFASTKPASESCPPESDTHMTLPLSSVHCSVSDQTSKESTSTESSSQDVESTFSSPEDSLPKSKPLTSSRSSMEMPSQPAPRTVTDEEINFVKTCLQRWRSEIEQDIQDLKTCIASTTQTIEQMYCDPLLRQVPYRLHAVLVHEGQANAGHYWAYIYNQPRQSWLKYNDISVTESSWEEVERDSYGGLRNVSAYCLMYINDKLPYFNAEAAPTESDQMSEVEALSVELKHYIQEDNWRFEQEVEEWEEEQSCKIPQMESSTNSSSQDYSTSQEPSVASSHGVRCLSSEHAVIVKEQTAQAIANTARAYEKSGVEAALSEVMLSPAMQGVILAIAKARQTFDRDGSEAGLIKAFHEEYSRLYQLAKETPTSHSDPRLQHVLVYFFQNEAPKRVVERTLLEQFADKNLSYDERSISIMKVAQAKLKEIGPDDMNMEEYKKWHEDYSLFRKVSVYLLTGLELYQKGKYQEALSYLVYAYQSNAALLMKGPRRGVKESVIALYRRKCLLELNAKAASLFETNDDHSVTEGINVMNELIIPCIHLIINNDISKDDLDAIEVMRNHWCSYLGQDIAENLQLCLGEFLPRLLDPSAEIIVLKEPPTIRPNSPYDLCSRFAAVMESIQGVSTVTVK

SEQ ID NO: 94833 - protein, 46 aa, Homo sapiens
  Payload ID: 18921
  Gene Name: ubiquitin specific peptidase 28
  ENSP ID: ENSP00000437450
MRNYICRTKLADRYPQSCQMLLNQLREITGIQDPSFLHEALKASNG

SEQ ID NO: 94834 - protein, 40 aa, Homo sapiens
  Payload ID: 18921
  Gene Name: ubiquitin specific peptidase 28
  ENSP ID: ENSP00000437688
  MOD_RES (1)..(1): Any amino acid
XFALMMGSNRKFVDPSAALDLLKGAFRSSEEQQQQSQEQI

SEQ ID NO: 94835 - protein, 51 aa, Homo sapiens
  Payload ID: 18921
  Gene Name: ubiquitin specific peptidase 28
  ENSP ID: ENSP00000438050
  MOD_RES (1)..(1): Any amino acid
XRNIMFMQELQYLFALMMGSNRKFVDPSAALDLLKGAFRSSEEQQQSQEQI

SEQ ID NO: 94836 - protein, 194 aa, Homo sapiens
  Payload ID: 18921
  Gene Name: ubiquitin specific peptidase 28
  ENSP ID: ENSP00000440260
  MOD_RES (1)..(1): Any amino acid
XNWRFEQEVEEWEEEQSCKIPQMESSTNSSSQDYSTSQEPSVASSHGVRCLSSEHAVIVKEQTAQAIANTARAYEKSGVEAALSELKEAEPKKPMPQETNLAEQSEQPPKANDAESTAQPNSEVMLSPAMQGVILAIAKARQTFDRDGSEAGLIKAFHEEYSRLYQLAKETPTSHSDPRLQHVLVYFFQNEAPK

SEQ ID NO: 94837 - protein, 244 aa, Homo sapiens
  Payload ID: 18921
  Gene Name: ubiquitin specific peptidase 28
  ENSP ID: ENSP00000440799
CGAAAGRRGRRGRRPRLEVIDLTHDNKDDLQAAIALSLLESPKIQADGRDLNRMHEATSAETKRSKRKRCEVWGENPNPNDWRRVDGWPVGLKNVGNTCWFSAVIQEKRNIMFMQELQYLFALMMGSNRKFVDPSAALDLLKGAFRSSEEQQQDVSEFTHKLLDWLEDAFQLAVNVNSPRNKSENPMVQLFYGTFLTEGVREGKPFCNNETFGQYPLQVNGYRNLDECLEGAMVEGDVELLPSD

SEQ ID NO: 94838 - protein, 194 aa, Homo sapiens
  Payload ID: 18921
  Gene Name: ubiquitin specific peptidase 28
  ENSP ID: ENSP00000441513
MTAELQQDDAAGAADGHGSSCQMLLNQLREITGIQDPSFLHEALKASNGDITQAVSLLTDERVKEPSQDTVATEPSEVEGSAANKEVLAKVIDLTHDNKDDLQAAIALSLLESPKIQADGRDLNRMHEATSAETKRSKRKRCEVWGENPNPNDWRRVDGWPVGLKNVGNTCWFSAVIQDASSGVPPCRPERVFI

SEQ ID NO: 94839 - protein, 360 aa, Homo sapiens
  Payload ID: 18921
  Gene Name: ubiquitin specific peptidase 28
  ENSP ID: ENSP00000442257
AALDLLKGAFRSSEEQQQDVSEFTHKLLDWLEDAFQLAVNVNSPRNKSENPMVQLFYGTFLTEGVREGKPFCNNETFGQYPLQVNGYRNLDECLEGAMVEGDVELLPSDHSVKYGQERWFTKLPPVLTFELSRFEFNQSLGQPEKIHNKLEFPQIIYMDRYMYRSKELIRNKRECIRKLKEEIKILQQKLESTSTESSSQDVESTFSSPEDSLPKSKPLTSSRSSMEMPSQPAPRTVTDEEINFVKTCLQRWRSEIEQDIQDLKTCIASTTQTIEQMYCDPLLRQVPYRLHAVLVHEGQANAGHYWAYIYNQPRQSWLKYNDISVTESSWEEVERDSYGGLRNVSAYCLMYINDKLPYFN

SEQ ID NO: 94840 - protein, 753 aa, Homo sapiens
  Payload ID: 18921
  Gene Name: ubiquitin specific peptidase 28
  ENSP ID: ENSP00000442431
MSFLKSLSLCLGKPFCNNETFGQYPLQVNGYRNLDECLEGAMVEGDVELLPSDHSVKYGQERWFTKLPPVLTFELSRFEFNQSLGQPEKIHNKLEFPQIIYMDRYMYRSKELIRNKRECIRKLKEEIKILQQKLERYVKYGSGPARFPLPDMLKYVIEFASTKPASESCPPESDTHMTLPLSSVHCSVSDQTSKESTSTESSSQDVESTFSSPEDSLPKSKPLTSSRSSMEMPSQPAPRTVTDEEINFVKTCLQRWRSEIEQDIQDLKTCIASTTQTIEQMYCDPLLRQVPYRLHAVLVHEGQANAGHYWAYIYNQPRQSWLKYNDISVTESSWEEVERDSYGGLRNVSAYCLMYINDKLPYFNAEAAPTESDQMSEVEALSVELKHYIQEDNWRFEQEVEEWEEEQSCKIPQMESSTNSSSQDYSTSQEPSVASSHGVRCLSSEHAVIVKEQTAQAIANTARAYEKSGVEAALSEAFHEEYSRLYQLAKETPTSHSDPRLQHVLVYFFQNEAPKRVVERTLLEQFADKNLSYDERSISIMKVAQAKLKEIGPDDMNMEEYKKWHEDYSLFRKVSVYLLTGLELYQKGKYQEALSYLVYAYQSNAALLMKGPRRGVKESVIALYRRKCLLELNAKAASLFETNDDHSVTEGINVMNELIIPCIHLIINNDISKDDLDAIEVMRNHWCSYLGQDIAENLQLCLGEFLPRLLDPSAEIIVLKEPPTIRPNSPYDLCSRFAAVMESIQGVSTVTVK

SEQ ID NO: 94841 - protein, 920 aa, Homo sapiens
  Payload ID: 18921
  Gene Name: ubiquitin specific peptidase 28
  ENSP ID: ENSP00000444991
MHEATSAETKRSKRKRCEVWGENPNPNDWRRVDGWPVGLKNVGNTCWFSAVIQSLFQLPEFRRLVLSYSLPQNVLENCRSHTEKRNIMFMQELQYLFALMMGSNRKFVDPSAALDLLKGAFRSSEEQQQDVSEFTHKLLDWLEDAFQLAVNVNSPRNKSENPMVQLFYGTFLTEGVREGKPFCNNETFGQYPLQVNGYRNLDECLEGAMVEGDVELLPSDHSVKYGQERWFTKLPPVLTFELSRFEFNQSLGQPEKIHNKLEFPQIIYMDRYMYRSKELIRNKRECIRKLKEEIKILQQKLERYVKYGSGPARFPLPDMLKYVIEFASTKPASESCPPESDTHMTLPLSSVHCSVSDQTSKESTSTESSSQDVESTFSSPEDSLPKSKPLTSSRSSMEMPSQPAPRTVTDEEINFVKTCLQRWRSEIEQDIQDLKTCIASTTQTIEQMYCDPLLRQVPYRLHAVLVHEGQANAGHYWAYIYNQPRQSWLKYNDISVTESSWEEVERDSYGGLRNVSAYCLMYINDKLPYFNAEAAPTESDQMSEVEALSVELKHYIQEDNWRFEQEVEEWEEEQSCKIPQMESSTNSSSQDYSTSQEPSVASSHGVRCLSSEHAVIVKEQTAQAIANTARAYEKSGVEAALSEAFHEEYSRLYQLAKETPTSHSDPRLQHVLVYFFQNEAPKRVVERTLLEQFADKNLSYDERSISIMKVAQAKLKEIGPDDMNMEEYKKWHEDYSLFRKVSVYLLTGLELYQKGKYQEALSYLVYAYQSNAALLMKGPRRGVKESVIALYRRKCLLELNAKAASLFETNDDHSVTEGINVMNELIIPCIHLIINNDISKDDLDAIEVMRNHWCSYLGQDIAENLQLCLGEFLPRLLDPSAEIIVLKEPPTIRPNSPYDLCSRFAAVMESIQGVSTVTVK

SEQ ID NO: 94842 - protein, 91 aa, Homo sapiens
  Payload ID: 18921
  Gene Name: ubiquitin specific peptidase 28
  ENSP ID: ENSP00000445722
  MOD_RES (1)..(1): Any amino acid
XNPELSPFPKSSSPRNKSENPMVQLFYGTFLTEGVREGKPFCNNETFGQYPLQVNGYRNLDECLEGAMVEGDVELLPSDHSVKYGQEPTCT

SEQ ID NO: 94843 - protein, 583 aa, Homo sapiens
  Payload ID: 18921
  Gene Name: ubiquitin specific peptidase 28
  Uniprot ID: Q96RU2
  ENSP ID: ENSP00000445743
MTAELQQDDAAGAADGHGSSCQMLLNQLREITGIQDPSFLHEALKASNGDITQAVSLLTDERVKEPSQDTVATEPSEVEGSAANKEVLAKVIDLTHDNKDDLQAAIALSLLESPKIQADGRDLNRMHEATSAETKRSKRKRCEVWGENPNPNDWRRVDGWPVGLKNVGNTCWFSAVIQSLFQLPEFRRLVLSYSLPQNVLENCRSHTEKRNIMFMQELQYLFALMMGSNRKFVDPSAALDLLKGAFRSSEEQQQDVSEFTHKLLDWLEDAFQLAVNVNSPRNKSENPMVQLFYGTFLTEGVREGKPFCNNETFGQYPLQVNGYRNLDECLEGAMVEGDVELLPSDHSVKYGQERWFTKLPPVLTFELSRFEFNQSLGQPEKIHNKLEFPQIIYMDRYMYRSKELIRNKRECIRKLKEEIKILQQKLERYVKYGSGPARFPLPDMLKYVIEFASTKPASESCPPESDTHMTLPLSSVHCSVSDQTSKESTSTESSSQDVESTFSSPEDSLPKSKPLTSSRSSMEMPSQPAPRTVTDEEINFVKTCLQRWRSEIEQDIQDLKTCIASTTQTIEQMYCDPLLRQVE

SEQ ID NO: 94844 - protein, 77 aa, Homo sapiens
  Payload ID: 18921
  Gene Name: ubiquitin specific peptidase 28
  ENSP ID: ENSP00000446284
MRNYICRTKLADRYPQSCQMLLNQLREITGIQDPSFLHEALKASNGDITQAVSLLTDERVKEPSQDTVATEPSEVEG

SEQ ID NO: 94845 - protein, 922 aa, Homo sapiens
  Payload ID: 18922
  Gene Name: ubiquitin specific peptidase 29
  Uniprot ID: Q9HBJ7
  ENSP ID: ENSP00000254181
MISLKVCGFIQIWSQKTGMTKLKEALIETVQRQKEIKLVVTFKSGKFIRIFQLSNNIRSVVLRHCKKRQSHLRLTLKNNVFLFIDKLSYRDAKQLNMFLDIIHQNKSQQPMKSDDDWSVFESRNMLKEIDKTSFYSICNKPSYQKMPLFMSKSPTHVKKGILENQGGKGQNTLSSDVQTNEDILKEDNPVPNKKYKTDSLKYIQSNRKNPSSLEDLEKDRDLKLGPSFNTNCNGNPNLDETVLATQTLNAKNGLTSPLEPEHSQGDPRCNKAQVPLDSHSQQLQQGFPNLGNTCYMNAVLQSLFAIPSFADDLLTQGVPWEYIPFEALIMTLTQLLALKDFCSTKIKRELLGNVKKVISAVAEIFSGNMQNDAHEFLGQCLDQLKEDMEKLNATLNTGKECGDENSSPQMHVGSAATKVFVCPVVANFEFELQLSLICKACGHAVLKVEPNNYLSINLHQETKPLPLSIQNSLDLFFKEEELEYNCQMCKQKSCVARHTFSRLSRVLIIHLKRYSFNNAWLLVKNNEQVYIPKSLSLSSYCNESTKPPLPLSSSAPVGKCEVLEVSQEMISEINSPLTPSMKLTSESSDSLVLPVEPDKNADLQRFQRDCGDASQEQHQRDLENGSALESELVHFRDRAIGEKELPVADSLMDQGDISLPVMYEDGGKLISSPDTRLVEVHLQEVPQHPELQKYEKTNTFVEFNFDSVTESTNGFYDCKENRIPEGSQGMAEQLQQCIEESIIDEFLQQAPPPGVRKLDAQEHTEETLNQSTELRLQKADLNHLGALGSDNPGNKNILDAENTRGEAKELTRNVKMGDPLQAYRLISVVSHIGSSPNSGHYISDVYDFQKQAWFTYNDLCVSEISETKMQEARLHSGYIFFYMHNGIFEELLRKAENSRLPSTQAGVIPQGEYEGDSLYRPA

SEQ ID NO: 94846 - protein, 30 aa, Homo sapiens
  Payload ID: 18922
  Gene Name: ubiquitin specific peptidase 29
  ENSP ID: ENSP00000470618
MISLKVCGFIQIWSQKTGMTKLKEALIETV

SEQ ID NO: 94847 - protein, 922 aa, Homo sapiens; identical to SEQ ID NO: 94845
  Payload ID: 18922
  Gene Name: ubiquitin specific peptidase 29
  Uniprot ID: Q9HBJ7
  ENSP ID: ENSP00000470747

SEQ ID NO: 94848 - protein, 13 aa, Homo sapiens
  Payload ID: 18922
  Gene Name: ubiquitin specific peptidase 29
  ENSP ID: ENSP00000472876
MISLKVCGFIQIW

SEQ ID NO: 94849 - protein, 498 aa, Homo sapiens
  Payload ID: 18923
  Gene Name: ubiquitin specific peptidase 3
  ENSP ID: ENSP00000268049
MQSPPHLAVCRSNKSPWVCLTCSSVHCGRYVNGHAKKHYEDAQVPLTNHKKSEKQDKVQHTVCMDCSSYSTYCYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 94850 - protein, 520 aa, Homo sapiens
  Payload ID: 18923
  Gene Name: ubiquitin specific peptidase 3
  Uniprot ID: Q9Y6I4
  ENSP ID: ENSP00000369681
MECPHLSSSVCIAPDSAKFPNGSPSSWCCSVCRSNKSPWVCLTCSSVHCGRYVNGHAKKHYEDAQVPLTNHKKSEKQDKVQHTVCMDCSSYSTYCYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 94851 - protein, 6 aa, Homo sapiens
  Payload ID: 18923
  Gene Name: ubiquitin specific peptidase 3
  ENSP ID: ENSP00000445793
  MOD_RES (1)..(1): Any amino acid
XSYSTY

SEQ ID NO: 94852 - protein, 476 aa, Homo sapiens
  Payload ID: 18923
  Gene Name: ubiquitin specific peptidase 3
  Uniprot ID: Q9Y6I4
  ENSP ID: ENSP00000445828
MECPHLSSSVCIAPDSAKFPNGSPSSWCCSVCRSNKSPWVCLTCSSVHCGSYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 94853 - protein, 56 aa, Homo sapiens
  Payload ID: 18923
  Gene Name: ubiquitin specific peptidase 3
  ENSP ID: ENSP00000452929
MECPHLSSSVCIAPDSAKFPNGSPSSWCCSAFKCLSGVTVLCPQRVLYVAQAGLEL

SEQ ID NO: 94854 - protein, 443 aa, Homo sapiens
  Payload ID: 18923
  Gene Name: ubiquitin specific peptidase 3
  ENSP ID: ENSP00000452947
  MOD_RES (1)..(1): Any amino acid
XKVQHTVCMDCSSYSTYCYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 94855 - protein, 126 aa, Homo sapiens
  Payload ID: 18923
  Gene Name: ubiquitin specific peptidase 3
  ENSP ID: ENSP00000453093
MQSPPHLAVCRSNKSPWVCLTCSSVHCGRYVNGHAKKHYEDAQVPLTNHKKSEKQDKVQHTVCMDCSSYSTYCYRCDDFVVNDTKLGLVQKVREHLQNLENSAFTADRHKKRKLLENSTLNSKLLK

SEQ ID NO: 94856 - protein, 431 aa, Homo sapiens
  Payload ID: 18923
  Gene Name: ubiquitin specific peptidase 3
  ENSP ID: ENSP00000453138
MENTEGYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 94857 - protein, 133 aa, Homo sapiens
  Payload ID: 18923
  Gene Name: ubiquitin specific peptidase 3
  ENSP ID: ENSP00000453194
MECPHLSSSVCIAPDSAKFPNGSPSSWCCSVCRSNKSPWVCLTCSSVHCGSYRCDDFVVNDTKLGLVQKVREHLQNLENSAFTADRHKKRKLLENSTLNSKLLKVNGSTTAICATGLRNLGNTCFMNAILQSL

SEQ ID NO: 94858 - protein, 55 aa, Homo sapiens
  Payload ID: 18923
  Gene Name: ubiquitin specific peptidase 3
  ENSP ID: ENSP00000453228
MECPHLSSSVCIAPDSAKFPNGSPSSWCCSVCRSNKSPWVCLTCSSVHCGRIWGT

SEQ ID NO: 94859 - protein, 106 aa, Homo sapiens
  Payload ID: 18923
  Gene Name: ubiquitin specific peptidase 3
  ENSP ID: ENSP00000453489
HWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 94860 - protein, 503 aa, Homo sapiens
  Payload ID: 18923
  Gene Name: ubiquitin specific peptidase 3
  ENSP ID: ENSP00000453619
MMQLVYCVFFFLLVCRSNKSPWVCLTCSSVHCGRYVNGHAKKHYEDAQVPLTNHKKSEKQDKVQHTVCMDCSSYSTYCYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 94861 - protein, 132 aa, Homo sapiens
  Payload ID: 18923
  Gene Name: ubiquitin specific peptidase 3
  ENSP ID: ENSP00000453688
MECPHLSSSVCIAPDSAKFPNGSPSSWCCSEMEFHHFTKAGLELLDSSNLPASASQSVGTTVCRSNKSPWVCLTCSSVHCGRYVNGHAKKHYEDAQVPLTNHKKSEKQDKVQHTVCMDCSSYSTYCYRCDDF

SEQ ID NO: 94862 - protein, 79 aa, Homo sapiens
  Payload ID: 18923
  Gene Name: ubiquitin specific peptidase 3
  ENSP ID: ENSP00000453767
MECPHLSSSVCIAPDSAKFPNGSPSSWCCSGAINSRTPMNSCATFWTTYTWNFRAVSTVFPAQQFCRRILLCLQVTSVA

SEQ ID NO: 94863 - protein, 56 aa, Homo sapiens; identical to SEQ ID NO: 94853
  Payload ID: 18923
  Gene Name: ubiquitin specific peptidase 3
  ENSP ID: ENSP00000454043

SEQ ID NO: 94864 - protein, 39 aa, Homo sapiens
  Payload ID: 18923
  Gene Name: ubiquitin specific peptidase 3
  ENSP ID: ENSP00000454197
MQSPPHLAVCRSNKSPWVCLTCSSVHCGRYVNGHAKKHY

SEQ ID NO: 94865 - protein, 517 aa, Homo sapiens
  Payload ID: 18924
  Gene Name: ubiquitin specific peptidase 30
  Uniprot ID: Q70CQ3
  ENSP ID: ENSP00000257548
MLSSRAEAAMTAADRAIQRFLRTGAAVRYKVMKNWGVIGGIAAALAAGIYVIWGPITERKKRRKGLVPGLVNLGNTCFMNSLLQGLSACPAFIRWLEEFTSQYSRDQKEPPSHQYLSLTLLHLLKALSCQEVTDDEVLDASCLLDVLRMYRWQISSFEEQDAHELFHVITSSLEDERDRQPRVTHLFDVHSLEQQSEITPKQITCRTRGSPHPTSNHWKSQHPFHGRLTSNMVCKHCEHQSPVRFDTFDSLSLSIPAATWGHPLTLDHCLHHFISSESVRDVVCDNCTKIEAKGTLNGEKVEHQRTTFVKQLKLGKLPQCLCIHLQRLSWSSHGTPLKRHEHVQFNEFLMMDIYKYHLLGHKPSQHNPKLNKNPGPTLELQDGPGAPTPVLNQPGAPKTQIFMNGACSPSLLPTLSAPMPFPLPVVPDYSSSTYLFRLMAVVVHHGDMHSGHFVTYRRSPPSARNPLSTSNQWLWVSDDTVRKASLQEVLSSSAYLLFYERVLSRMQHQSQECKSEE

SEQ ID NO: 94866 - protein, 486 aa, Homo sapiens
  Payload ID: 18924
  Gene Name: ubiquitin specific peptidase 30
  ENSP ID: ENSP00000376535
MKNWGVIGGIAAALAAGIYVIWGPITERKKRRKGLVPGLVNLGNTCFMNSLLQGLSACPAFIRWLEEFTSQYSRDQKEPPSHQYLSLTLLHLLKALSCQEVTDDEVLDASCLLDVLRMYRWQISSFEEQDAHELFHVITSSLEDERDRQPRVTHLFDVHSLEQQSEITPKQITCRTRGSPHPTSNHWKSQHPFHGRLTSNMVCKHCEHQSPVRFDTFDSLSLSIPAATWGHPLTLDHCLHHFISSESVRDVVCDNCTKIEAKGTLNGEKVEHQRTTFVKQLKLGKLPQCLCIHLQRLSWSSHGTPLKRHEHVQFNEFLMMDIYKYHLLGHKPSQHNPKLNKNPGPTLELQDGPGAPTPVLNQPGAPKTQIFMNGACSPSLLPTLSAPMPFPLPVVPDYSSSTYLFRLMAVVVHHGDMHSGHFVTYRRSPPSARNPLSTSNQWLWVSDDTVRKASLQEVLSSSAYLLFYERVLSRMQHQSQECKSEE

SEQ ID NO: 94867 - protein, 146 aa, Homo sapiens
  Payload ID: 18924
  Gene Name: ubiquitin specific peptidase 30
  ENSP ID: ENSP00000438829
MLSSRAEAAMTAADRAIQRFLRTGAAVRYKVMKNWGVIGGIAAALAAGIYVIWGPITERKKRRKALSCQEVTDDEVLDASCLLDVLRMYRWQISSFEEQDAHELFHVITSSLEDERDRQPRVTHLFDVHSLEQQSEITPKQITCRT

SEQ ID NO: 94868 - protein, 95 aa, Homo sapiens
  Payload ID: 18924
  Gene Name: ubiquitin specific peptidase 30
  ENSP ID: ENSP00000440837
MRYKVMKNWGVIGGIAAALAAGIYVIWGPITERKKRRKGLVPGLVNLGNTCFMNSLLQGLSACPAFIRWLEEFTSQYSRDQKEPPSHQYLSLTLL

SEQ ID NO: 94869 - protein, 177 aa, Homo sapiens
  Payload ID: 18924
  Gene Name: ubiquitin specific peptidase 30
  ENSP ID: ENSP00000443678
MKNWGVIGGIAAALAAGIYVIWGPITERKKRRKGLVPGLVNLGNTCFMNSLLQGLSACPAFIRWLEEFTSQYSRDQKEPPSHQYLSLTLLHLLKALSCQEVTDDEVLDASCLLDVLRMYRWQISSFEEQDAHELFHVITSSLEDERDRQPRVTHLFDVHSLEQQSEITPKQITCRTR

SEQ ID NO: 94870 - protein, 35 aa, Homo sapiens
  Payload ID: 18924
  Gene Name: ubiquitin specific peptidase 30
  ENSP ID: ENSP00000473942
MLSSRAEAAMTAADRAIQRFLRTGAAVSLVLPRSY

SEQ ID NO: 94871 - protein, 91 aa, Homo sapiens
  Payload ID: 18924
  Gene Name: ubiquitin specific peptidase 30
  ENSP ID: ENSP00000474166
PDYSSSTYLFRLMAVVVHHGDMHSGHFVTYRRSPPSARNPLSTSNQWLWVSDDTVRKASLQEVLSSSAYLLFYERVLSRMQHQSQECKSEE

SEQ ID NO: 94872 - protein, 1352 aa, Homo sapiens
  Payload ID: 18925
  Gene Name: ubiquitin specific peptidase 31
  Uniprot ID: Q70CQ4
  ENSP ID: ENSP00000219689
MSKVTAPGSGPPAAASGKEKRSFSKRLFRSGRAGGGGAGGPGASGPAAPSSPSSPSSARSVGSFMSRVLKTLSTLSHLSSEGAAPDRGGLRSCFPPGPAAAPTPPPCPPPPASPAPPACAAEPVPGVAGLRNHGNTCFMNATLQCLSNTELFAEYLALGQYRAGRPEPSPDPEQPAGRGAQGQGEVTEQLAHLVRALWTLEYTPQHSRDFKTIVSKNALQYRGNSQHDAQEFLLWLLDRVHEDLNHSVKQSGQPPLKPPSETDMMPEGPSFPVCSTFVQELFQAQYRSSLTCPHCQKQSNTFDPFLCISLPIPLPHTRPLYVTVVYQGKCSHCMRIGVAVPLSGTVARLREAVSMETKIPTDQIVLTEMYYDGFHRSFCDTDDLETVHESDCIFAFETPEIFRPEGILSQRGIHLNNNLNHLKFGLDYHRLSSPTQTAAKQGKMDSPTSRAGSDKIVLLVCNRACTGQQGKRFGLPFVLHLEKTIAWDLLQKEILEKMKYFLRPTVCIQVCPFSLRVVSVVGITYLLPQEEQPLCHPIVERALKSCGPGGTAHVKLVVEWDKETRDFLFVNTEDEYIPDAESVRLQRERHHQPQTCTLSQCFQLYTKEERLAPDDAWRCPHCKQLQQGSITLSLWTLPDVLIIHLKRFRQEGDRRMKLQNMVKFPLTGLDMTPHVVKRSQSSWSLPSHWSPWRRPYGLGRDPEDYIYDLYAVCNHHGTMQGGHYTAYCKNSVDGLWYCFDDSDVQQLSEDEVCTQTAYILFYQRRTAIPSWSANSSVAGSTSSSLCEHWVSRLPGSKPASVTSAASSRRTSLASLSESVEMTGERSEDDGGFSTRPFVRSVQRQSLSSRSSVTSPLAVNENCMRPSWSLSAKLQMRSNSPSRFSGDSPIHSSASTLEKIGEAADDKVSISCFGSLRNLSSSYQEPSDSHSRREHKAVGRAPLAVMEGVFKDESDTRRLNSSVVDTQSKHSAQGDRLPPLSGPFDNNNQIAYVDQSDSVDSSPVKEVKAPSHPGSLAKKPESTTKRSPSSKGTSEPEKSLRKGRPALASQESSLSSTSPSSPLPVKVSLKPSRSRSKADSSSRGSGRHSSPAPAQPKKESSPKSQDSVSSPSPQKQKSASALTYTASSTSAKKASGPATRSPFPPGKSRTSDHSLSREGSRQSLGSDRASATSTSKPNSPRVSQARAGEGRGAGKHVRSSSMASLRSPSTSIKSGLKRDSKSEDKGLSFFKSALRQKETRRSTDLGKTALLSKKAGGSSVKSVCKNTGDDEAERGHQPPASQQPNANTTGKEQLVTKDPASAKHSLLSARKSKSSQLDSGVPSSPGGRQSAEKSSKKLSSSMQTSARPSQKPQ

SEQ ID NO: 94873 - protein, 645 aa, Homo sapiens
  Payload ID: 18925
  Gene Name: ubiquitin specific peptidase 31
  ENSP ID: ENSP00000461621
MRQEVCLTSFHLNWGYSDRHDMTQGLGIDADLGVRTSTPPSSARNTFMRVCVAQGWPRDPSLTSMPVFFSAGSTSSSLCEHWVSRLPGSKPASVTSAASSRRTSLASLSESVEMTGERSEDDGGFSTRPFVRSVQRQSLSSRSSVTSPLAVNENCMRPSWSLSAKLQMRSNSPSRFSGDSPIHSSASTLEKIGEAADDKVSISCFGSLRNLSSSYQEPSDSHSRREHKAVGRAPLAVMEGVFKDESDTRRLNSSVVDTQSKHSAQGDRLPPLSGPFDNNNQIAYVDQSDSVDSSPVKEVKAPSHPGSLAKKPESTTKRSPSSKGTSEPEKSLRKGRPALASQESSLSSTSPSSPLPVKVSLKPSRSRSKADSSSRGSGRHSSPAPAQPKKESSPKSQDSVSSPSPQKQKSASALTYTASSTSAKKASGPATRSPFPPGKSRTSDHSLSREGSRQSLGSDRASATSTSKPNSPRVSQARAGEGRGAGKHVRSSSMASLRSPSTSIKSGLKRDSKSEDKGLSFFKSALRQKETRRSTDLGKTALLSKKAGGSSVKSVCKNTGDDEAERGHQPPASQQPNANTTGKEQLVTKDPASAKHSLLSARKSKSSQLDSGVPSSPGGRQSAEKSSKKLSSSMQTSARPSQKPQ

SEQ ID NO: 94874 - protein, 266 aa, Homo sapiens
  Payload ID: 18925
  Gene Name: ubiquitin specific peptidase 31
  ENSP ID: ENSP00000481339
  MOD_RES (1)..(1): Any amino acid
XQEEQPLCHPIVERALKSCGPGGTAHVKLVVEWDKETRDFLFVNTEDEYIPDAESVRLQRERHHQPQTCTLSQCFQLYTKEERLAPDDAWRCPHCKQLQQGSITLSLWTLPDVLIIHLKRFRQEGDRRMKLQNMVKFPLTGLDMTPHVVKRSQSSWSLPSHWSPWRRPYGLGRDPEDYIYDLYAVCNHHGTMQGGHYTGLQCERLRVCAGESFRRVCLWQGDLTLEPHFPSGRQCANCEGSFHPLDLCPRANKRTFFLLFLSWVVQ

SEQ ID NO: 94875 - protein, 1604 aa, Homo sapiens
  Payload ID: 18926
  Gene Name: ubiquitin specific peptidase 32
  Uniprot ID: Q8NFA0
  ENSP ID: ENSP00000300896
MGAKESRIGFLSYEEALRRVTDVELKRLKDAFKRTCGLSYYMGQHCFIREVLGDGVPPKVAEVIYCSFGGTSKGLHFNNLIVGLVLLTRGKDEEKAKYIFSLFSSESGNYVIREEMERMLHVVDGKVPDTLRKCFSEGEKVNYEKFRNWLFLNKDAFTFSRWLLSGGVYVTLTDDSDTPTFYQTLAGVTHLEESDIIDLEKRYWLLKAQSRTGRFDLETFGPLVSPPIRPSLSEGLFNAFDENRDNHIDFKEISCGLSACCRGPLAERQKFCFKVFDVDRDGVLSRVELRDMVVALLEVWKDNRTDDIPELHMDLSDIVEGILNAHDTTKMGHLTLEDYQIWSVKNVLANEFLNLLFQVCHIVLGLRPATPEEEGQIIRGWLERESRYGLQAGHNWFIISMQWWQQWKEYVKYDANPVVIEPSSVLNGGKYSFGTAAHPMEQVEDRIGSSLSYVNTTEEKFSDNISTASEASETAGSGFLYSATPGADVCFARQHNTSDNNNQCLLGANGNILLHLNPQKPGAIDNQPLVTQEPVKATSLTLEGGRLKRTPQLIHGRDYEMVPEPVWRALYHWYGANLALPRPVIKNSKTDIPELELFPRYLLFLRQQPATRTQQSNIWVNMGNVPSPNAPLKRVLAYTGCFSRMQTIKEIHEYLSQRLRIKEEDMRLWLYNSENYLTLLDDEDHKLEYLKIQDEQHLVIEVRNKDMSWPEEMSFIANSSKIDRHKVPTEKGATGLSNLGNTCFMNSSIQCVSNTQPLTQYFISGRHLYELNRTNPIGMKGHMAKCYGDLVQELWSGTQKNVAPLKLRWTIAKYAPRFNGFQQQDSQELLAFLLDGLHEDLNRVHEKPYVELKDSDGRPDWEVAAEAWDNHLRRNRSIVVDLFHGQLRSQVKCKTCGHISVRFDPFNFLSLPLPMDSYMHLEITVIKLDGTTPVRYGLRLNMDEKYTGLKKQLSDLCGLNSEQILLAEVHGSNIKNFPQDNQKVRLSVSGFLCAFEIPVPVSPISASSPTQTDFSSSPSTNEMFTLTTNGDLPRPIFIPNGMPNTVVPCGTEKNFTNGMVNGHMPSLPDSPFTGYIIAVHRKMMRTELYFLSSQKNRPSLFGMPLIVPCTVHTRKKDLYDAVWIQVSRLASPLPPQEASNHAQDCDDSMGYQYPFTLRVVQKDGNSCAWCPWYRFCRGCKIDCGEDRAFIGNAYIAVDWDPTALHLRYQTSQERVVDEHESVEQSRRAQAEPINLDSCLRAFTSEEELGENEMYYCSKCKTHCLATKKLDLWRLPPILIIHLKRFQFVNGRWIKSQKIVKFPRESFDPSAFLVPRDPALCQHKPLTPQGDELSEPRILAREVKKVDAQSSAGEEDVLLSKSPSSLSANIISSPKGSPSSSRKSGTSCPSSKNSSPNSSPRTLGRSKGRLRLPQIGSKNKLSSSKENLDASKENGAGQICELADALSRGHVLGGSQPELVTPQDHEVALANGFLYEHEACGNGYSNGQLGNHSEEDSTDDQREDTRIKPIYNLYAISCHSGILGGGHYVTYAKNPNCKWYCYNDSSCKELHPDEIDTDSAYILFYEQQGIDYAQFLPKTDGKKMADTSSMDEDFESDYKKYCVLQ

SEQ ID NO: 94876 - protein, 390 aa, Homo sapiens
  Payload ID: 18926
  Gene Name: ubiquitin specific peptidase 32
  Uniprot ID: Q8NFA0
  ENSP ID: ENSP00000376727
MGAKESRIGFLSYEEALRRVTDVELKRLKDAFKRTCGLSYYMGQHCFIREVLGDGVPPKVAEVIYCSFGGTSKGLHFNNLIVGLVLLTRGKDEEKAKYIFSLFSSESGNYVIREEMERMLHVVDGKVPDTLRKCFSEGEKVNYEKFRNWLFLNKDAFTFSRWLLSGGVYVTLTDDSDTPTFYQTLAGVTHLEESDIIDLEKRYWLLKAQSRTGRFDLETFGPLVSPPIRPSLSEGLFNAFDENRDNHIDFKEISCGLSACCRGPLAERQKFCFKVFDVDRDGVLSRVELRDMVVALLEVWKDNRTDDIPELHMDLSDIVEGILNAHDTTKMGHLTLEDYQIWSVKNVLANEFLNLLFQVCHIVLGLRPATPEEEGQIIRTLETDQIYTRN

SEQ ID NO: 94877 - protein, 246 aa, Homo sapiens
  Payload ID: 18926
  Gene Name: ubiquitin specific peptidase 32
  ENSP ID: ENSP00000464762
EASETAGSGFLYSATPGADVCFARQHNTSDNNNQCLLGANGNILLHLNPQKPGAIDNQPLVTQEPVKATSLTLEGGRLKRTPQLIHGRDYEMVPEPVWRALYHWYGANLALPRPVIKNSKTDIPELELFPRYLLFLRQQPATRTQQSNIWVNMGMMSLRMFPQHLPRGNVPSPNAPLKRVLAYTGCFSRMQTIKEIHEYLSQRLRIKEEDMRLWLYNSENYLTLLDDEDHKLEYLKIQDEQHLVIE

SEQ ID NO: 94878 - protein, 133 aa, Homo sapiens
  Payload ID: 18926
  Gene Name: ubiquitin specific peptidase 32
  ENSP ID: ENSP00000465659
MGAKESRIGFLSYEEALRRVTDVELKRLKDAFKRTCGLSYYMGQHCFIREVLGDGVPPKVAEVCHIVLGLRPATPEEEGQIIRGWLERESRYGLQAGHNWFIISMQWWQQWKEYVKYDANPVVIEPSSVLNGG

SEQ ID NO: 94879 - protein, 847 aa, Homo sapiens
  Payload ID: 18926
  Gene Name: ubiquitin specific peptidase 32
  ENSP ID: ENSP00000465844
MRYVRRCVPLPGAPARVTDVELKRLKDAFKRTCGLSYYMGQHCFIREVLGDGVPPKVAEVIYCSFGGTSKGLHFNNLIVGLVLLTRGKDEEKAKYIFSLFSSESGNYVIREEMERMLHVVDGKVPDTLRKCFSEGEKVNYEKFRNWLFLNKDAFTFSRWLLSGGVYVTLTDDSDTPTFYQTLAGVTHLEESDIIDLEKRYWLLKAQSRTGRFDLETFGPLVSPPIRPSLSEGLFNAFDENRDNHIDFKEISCGLSACCRGPLAERQKFCFKVFDVDRDGVLSRVELRDMVVALLEVWKDNRTDDIPELHMDLSDIVEGILNAHDTTKMGHLTLEDYQIWSVKNVLANEFLNLLFQVCHIVLGLRPATPEEEGQIIRGWLERESRYGLQAGHNWFIISMQWWQQWKEYVKYDANPVVIEPSSVLNGGKYSFGTAAHPMEQVEDRIGSSLSYVNTTEEKFSDNISTASEASETAGSGFLYSATPGADVCFARQHNTSDNNNQCLLGANGNILLHLNPQKPGAIDNQPLVTQEPVKATSLTLEGGRLKRTPQLIHGRDYEMVPEPVWRALYHWYGANLALPRPVIKNSKTDIPELELFPRYLLFLRQQPATRTQQSNIWVNMGNVPSPNAPLKRVLAYTGCFSRMQTIKEIHEYLSQRLRIKEEDMRLWLYNSENYLTLLDDEDHKLEYLKIQDEQHLVIEVRNKDMSWPEEMSFIANSSKIDRHKVPTEKGATGLSNLGNTCFMNSSIQCVSNTQPLTQYFISGRHLYELNRTNPIGMKGHMAKCYGDLVQELWSGTQKNVAPLKLRWTIAKYAPRFNGFQQQDSQELLAFLLDGLHEDLNRVHEKPYV

SEQ ID NO: 94880 - protein, 87 aa, Homo sapiens
  Payload ID: 18926
  Gene Name: ubiquitin specific peptidase 32
  ENSP ID: ENSP00000465922
DANPVVIEPSSVLNGGKYSFGTAAHPMEQVEDRIGSSLSYVNTTEEKFSDNISTASEASETAGSGYIINTRRRTIKTNSTADSWKRL

SEQ ID NO: 94881 - protein, 174 aa, Homo sapiens
  Payload ID: 18926
  Gene Name: ubiquitin specific peptidase 32
  ENSP ID: ENSP00000466740
  MOD_RES (1)..(1): Any amino acid
XTLGRSKGRLRLPQIGSKNKLSSSKENLDASKENGAGQICELADALSRGHVLGGSQPELVTPQDHEVALANGFLYEHEACGNGYSNGQLGNHSEEDSTDDQREDTRIKPIYNLYAISELHPDEIDTDSAYILFYEQQGIDYAQFLPKTDGKKMADTSSMDEDFESDYKKYCVLQ

SEQ ID NO: 94882 - protein, 153 aa, Homo sapiens
  Payload ID: 18926
  Gene Name: ubiquitin specific peptidase 32
  ENSP ID: ENSP00000467098
MCGVERRLWQSAQQARRGWRPFSQEYCQMLILTPPVTDVELKRLKDAFKRTCGLSYYMGQHCFIREVLGDGVPPKVAEVIYCSFGGTSKGLHFNNLIVGLVLLTRGKDEEKAKYIFSLFSSESGNYVIREEMERMLHVVDGKVPDTLRKCFSE

SEQ ID NO: 94883 - protein, 87 aa, Homo sapiens
  Payload ID: 18926
  Gene Name: ubiquitin specific peptidase 32
  ENSP ID: ENSP00000467435
  MOD_RES (1)..(1): Any amino acid
XRRLWQSAQQARRGWRPFSQEYCQMLILTPPGIPSPGPSFVSSGPGPSCPHSVWPCSSPAFATVRWDRRRPGPPLPPSGHLGHRRGA

SEQ ID NO: 94884 - protein, 1274 aa, Homo sapiens
  Payload ID: 18926
  Gene Name: ubiquitin specific peptidase 32
  ENSP ID: ENSP00000467885
MGHLTLEDYQIWSVKNVLANEFLNLLFQVCHIVLGLRPATPEEEGQIIRGWLERESRYGLQAGHNWFIISMQWWQQWKEYVKYDANPVVIEPSSVLNGGKYSFGTAAHPMEQVEDRIGSSLSYVNTTEEKFSDNISTASEASETAGSGFLYSATPGADVCFARQHNTSDNNNQCLLGANGNILLHLNPQKPGAIDNQPLVTQEPVKATSLTLEGGRLKRTPQLIHGRDYEMVPEPVWRALYHWYGANLALPRPVIKNSKTDIPELELFPRYLLFLRQQPATRTQQSNIWVNMGNVPSPNAPLKRVLAYTGCFSRMQTIKEIHEYLSQRLRIKEEDMRLWLYNSENYLTLLDDEDHKLEYLKIQDEQHLVIEVRNKDMSWPEEMSFIANSSKIDRHKVPTEKGATGLSNLGNTCFMNSSIQCVSNTQPLTQYFISGRHLYELNRTNPIGMKGHMAKCYGDLVQELWSGTQKNVAPLKLRWTIAKYAPRFNGFQQQDSQELLAFLLDGLHEDLNRVHEKPYVELKDSDGRPDWEVAAEAWDNHLRRNRSIVVDLFHGQLRSQVKCKTCGHISVRFDPFNFLSLPLPMDSYMHLEITVIKLDGTTPVRYGLRLNMDEKYTGLKKQLSDLCGLNSEQILLAEVHGSNIKNFPQDNQKVRLSVSGFLCAFEIPVPVSPISASSPTQTDFSSSPSTNEMFTLTTNGDLPRPIFIPNGMPNTVVPCGTEKNFTNGMVNGHMPSLPDSPFTGYIIAVHRKMMRTELYFLSSQKNRPSLFGMPLIVPCTVHTRKKDLYDAVWIQVSRLASPLPPQEASNHAQDCDDSMGYQYPFTLRVVQKDGNSCAWCPWYRFCRGCKIDCGEDRAFIGNAYIAVDWDPTALHLRYQTSQERVVDEHESVEQSRRAQAEPINLDSCLRAFTSEEELGENEMYYCSKCKTHCLATKKLDLWRLPPILIIHLKRFQFVNGRWIKSQKIVKFPRESFDPSAFLVPRDPALCQHKPLTPQGDELSEPRILAREVKKVDAQSSAGEEDVLLSKSPSSLSANIISSPKGSPSSSRKSGTSCPSSKNSSPNSSPRTLGRSKGRLRLPQIGSKNKLSSSKENLDASKENGAGQICELADALSRGHVLGGSQPELVTPQDHEVALANGFLYEHEACGNGYSNGQLGNHSEEDSTDDQREDTRIKPIYNLYAISCHSGILGGGHYVTYAKNPNCKWYCYNDSSCKELHPDEIDTDSAYILFYEQQGIDYAQFLPKTDGKKMADTSSMDEDFESDYKKYCVLQ

SEQ ID NO: 94885 - protein, 942 aa, Homo sapiens
  Payload ID: 18927
  Gene Name: ubiquitin specific peptidase 33
  Uniprot ID: Q8TEY7
  ENSP ID: ENSP00000350009
MTGSNSHITILTLKVLPHFESLGKQEKIPNKMSAFRNHCPHLDSVGEITKEDLIQKSLGTCQDCKVQGPNLWACLENRCSYVGCGESQVDHSTIHSQETKHYLTVNLTTLRVWCYACSKEVFLDRKLGTQPSLPHVRQPHQIQENSVQDFKIPSNTTLKTPLVAVFDDLDIEADEEDELRARGLTGLKNIGNTCYMNAALQALSNCPPLTQFFLDCGGLARTDKKPAICKSYLKLMTELWHKSRPGSVVPTTLFQGIKTVNPTFRGYSQQDAQEFLRCLMDLLHEELKEQVMEVEEDPQTITTEETMEEDKSQSDVDFQSCESCSNSDRAENENGSRCFSEDNNETTMLIQDDENNSEMSKDWQKEKMCNKINKVNSEGEFDKDRDSISETVDLNNQETVKVQIHSRASEYITDVHSNDLSTPQILPSNEGVNPRLSASPPKSGNLWPGLAPPHKKAQSASPKRKKQHKKYRSVISDIFDGTIISSVQCLTCDRVSVTLETFQDLSLPIPGKEDLAKLHSSSHPTSIVKAGSCGEAYAPQGWIAFFMEYVKRFVVSCVPSWFWGPVVTLQDCLAAFFARDELKGDNMYSCEKCKKLRNGVKFCKVQNFPEILCIHLKRFRHELMFSTKISTHVSFPLEGLDLQPFLAKDSPAQIVTYDLLSVICHHGTASSGHYIAYCRNNLNNLWYEFDDQSVTEVSESTVQNAEAYVLFYRKSSEEAQKERRRISNLLNIMEPSLLQFYISRQWLNKFKTFAEPGPISNNDFLCIHGGVPPRKAGYIEDLVLMLPQNIWDNLYSRYGGGPAVNHLYICHTCQIEAEKIEKRRKTELEIFIRLNRAFQKEDSPATFYCISMQWFREWESFVKGKDGDPPGPIDNTKIAVTKCGNVMLRQGADSGQISEETWNFLQSIYGGGPEVILRPPVVHVDPDILQAEEKIEVETRSL

SEQ ID NO: 94886 - protein, 828 aa, Homo sapiens
  Payload ID: 18927
  Gene Name: ubiquitin specific peptidase 33
  Uniprot ID: Q8TEY7
  ENSP ID: ENSP00000359828
MTGSNSHITILTLKVLPHFESLGKQEKIPNKMSAFRNHCPHLDSVGEITKEDLIQKSLGTCQDCKVQGPNLWACLENRCSYVGCGESQVDHSTIHSQETKHYLTVNLTTLRVWCYACSKEVFLDRKLGTQPSLPHVRQPHQIQENSVQDFKIPSNTTLKTPLVAVFDDLDIEADEEDELRARGLTGLKNIGNTCYMNAALQALSNCPPLTQFFLDCGGLARTDKKPAICKSYLKLMTELWHKSRPGSVVPTTLFQGIKTVNPTFRGYSQQDAQEFLRCLMDLLHEELKEQVMEVEEDPQTITTEETMEEDKSQSDVDFQSCESCSNSDRAENENGSRCFSEDNNETTMLIQDDENNSEMSKDWQKEKMCNKINKVNSEGEFDKDRDSISETVDLNNQETVKVQIHSRASEYITDVHSNDLSTPQILPSNEGVNPRLSASPPKSGNLWPGLAPPHKKAQSASPKRKKQHKKYRSVISDIFDGTIISSVQCLTCDRVSVTLETFQDLSLPIPGKEDLAKLHSSSHPTSIVKAGSCGEAYAPQGWIAFFMEYVKSWFWGPVVTLQDCLAAFFARDELKGDNMYSCEKCKKLRNGVKFCKVQNFPEILCIHLKRFRHELMFSTKISTHVSFPLEGLDLQPFLAKDSPAQIVTYDLLSVICHHGTASSGHYIAYCRNNLNNLWYEFDDQSVTEVSESTVQNAEAYVLFYRKSSEEAQKERRRISNLLNIMEPSLLQFYISRQWLNKFKTFAEPGPISNNDFLCIHGGVPPRKAGYIEDLVLMLPQNIWDNLYSRYGGGPAVNHLYICHTCQIEAEKIEKRRKTELEIFIRVKK

SEQ ID NO: 94887 - protein, 942 aa, Homo sapiens; identical to SEQ ID NO: 94885
  Payload ID: 18927
  Gene Name: ubiquitin specific peptidase 33
  Uniprot ID: Q8TEY7
  ENSP ID: ENSP00000359829

SEQ ID NO: 94888 - protein, 911 aa, Homo sapiens
  Payload ID: 18927
  Gene Name: ubiquitin specific peptidase 33
  Uniprot ID: Q8TEY7
  ENSP ID: ENSP00000359830
MSAFRNHCPHLDSVGEITKEDLIQKSLGTCQDCKVQGPNLWACLENRCSYVGCGESQVDHSTIHSQETKHYLTVNLTTLRVWCYACSKEVFLDRKLGTQPSLPHVRQPHQIQENSVQDFKIPSNTTLKTPLVAVFDDLDIEADEEDELRARGLTGLKNIGNTCYMNAALQALSNCPPLTQFFLDCGGLARTDKKPAICKSYLKLMTELWHKSRPGSVVPTTLFQGIKTVNPTFRGYSQQDAQEFLRCLMDLLHEELKEQVMEVEEDPQTITTEETMEEDKSQSDVDFQSCESCSNSDRAENENGSRCFSEDNNETTMLIQDDENNSEMSKDWQKEKMCNKINKVNSEGEFDKDRDSISETVDLNNQETVKVQIHSRASEYITDVHSNDLSTPQILPSNEGVNPRLSASPPKSGNLWPGLAPPHKKAQSASPKRKKQHKKYRSVISDIFDGTIISSVQCLTCDRVSVTLETFQDLSLPIPGKEDLAKLHSSSHPTSIVKAGSCGEAYAPQGWIAFFMEYVKRFVVSCVPSWFWGPVVTLQDCLAAFFARDELKGDNMYSCEKCKKLRNGVKFCKVQNFPEILCIHLKRFRHELMFSTKISTHVSFPLEGLDLQPFLAKDSPAQIVTYDLLSVICHHGTASSGHYIAYCRNNLNNLWYEFDDQSVTEVSESTVQNAEAYVLFYRKSSEEAQKERRRISNLLNIMEPSLLQFYISRQWLNKFKTFAEPGPISNNDFLCIHGGVPPRKAGYIEDLVLMLPQNIWDNLYSRYGGGPAVNHLYICHTCQIEAEKIEKRRKTELEIFIRLNRAFQKEDSPATFYCISMQWFREWESFVKGKDGDPPGPIDNTKIAVTKCGNVMLRQGADSGQISEETWNFLQSIYGGGPEVILRPPVVHVDPDILQAEEKIEVETRSL

SEQ ID NO: 94889 - protein, 456 aa, Homo sapiens
  Payload ID: 18927
  Gene Name: ubiquitin specific peptidase 33
  ENSP ID: ENSP00000432392
  MOD_RES (1)..(1): Any amino acid
XQETVKVQIHSRASEYITDVHSNDLSTPQILPSNEGVNPRLSASPPKSGNLWPGLAPPHKKAQSASPKRKKQHKKYRSVISDIFDGTIISSVQCLTCDRVSVTLETFQDLSLPIPGKEDLAKLHSSSHPTSIVKAGSCGEAYAPQGWIAFFMEYVKRFVVSCVPSWFWGPVVTLQDCLAAFFARDELKGDNMYSCEKCKKLRNGVKFCKVQNFPEILCIHLKRFRHELMFSTKISTHVSFPLEGLDLQPFLAKDSPAQIVTYDLLSVICHHGTASSGHYIAYCRNNLNNLWYEFDDQSVTEVSESTVQNAEAYVLFYRKSSEEAQKERRRISNLLNIMEPSLLQFYISRQWLNKFKTFAEPGPISNNDFLCIHGGVPPRKAGYIEDLVLMLPQNIWDNLYSRYGGGPAVNHLYICHTCQIEAEKIEKRRKTELEIFIRILQVLLTILRLQSLNVVM

SEQ ID NO: 94890 - protein, 139 aa, Homo sapiens
  Payload ID: 18927
  Gene Name: ubiquitin specific peptidase 33
  ENSP ID: ENSP00000432667
  MOD_RES (1)..(1): Any amino acid
XDNMYSCEKCKKLRNGVKFCKVQNFPEILCIHLKRFRHELMFSTKISTHVSFPLEGLDLQPFLAKDSPAQIVTYDLLSVICHHGTASSGHYIAYCRNNLNNLWYEFDDQSVTEVSESTVQNAEAYVLFYRCSSKKSWLY

SEQ ID NO: 94891 - protein, 110 aa, Homo sapiens
  Payload ID: 18927
  Gene Name: ubiquitin specific peptidase 33
  ENSP ID: ENSP00000433283
MTGSNSHITILTLKVLPHFESLGKQEKIPNKMSAFRNHCPHLDSVGEITKEDLIQKSLGTCQDCKVQGPNLWACLENRCSYVGCGESQVDHSTIHSQETKHYLTVNLTTL

SEQ ID NO: 94892 - protein, 202 aa, Homo sapiens
  Payload ID: 18927
  Gene Name: ubiquitin specific peptidase 33
  ENSP ID: ENSP00000434441
MTGSNSHITILTLKVLPHFESLGKQEKIPNKMSAFRNHCPHLDSVGEITKEDLIQKSLGTCQDCKVQGPNLWACLENRCSYVGCGESQVDHSTIHSQETKHYLTVNLTTLRVWCYACSKEVFLDRKLGTQPSLPHVRQPHQIQENSVQDFKIPSNTTLKTPLVAVFDDLDIEADEEDELRARGLTGLKNIGNTCYMNAALQA

SEQ ID NO: 94893 - protein, 72 aa, Homo sapiens
  Payload ID: 18927
  Gene Name: ubiquitin specific peptidase 33
  ENSP ID: ENSP00000436441
MSAFRNHCPHLDSVGEITKEDLIQKSLGTCQDCKVQGPNLWACLENRCSYVGCGESQVDHSTIHSQETKHYL

SEQ ID NO: 94894 - protein, 3546 aa, Homo sapiens
  Payload ID: 18928
  Gene Name: ubiquitin specific peptidase 34
  Uniprot ID: Q70CQ2
  ENSP ID: ENSP00000381577
MCENCADLVEVLNEISDVEGGDGLQLRKEHTLKIFTYINSWTQRQCLCCFKEYKHLEIFNQVVCALINLVIAQVQVLRDQLCKHCTTINIDSTWQDESNQAEEPLNIDRECNEGSTERQKSIEKKSNSTRICNLTEEESSKSSDPFSLWSTDEKEKLLLCVAKIFQIQFPLYTAYKHNTHPTIEDISTQESNILGAFCDMNDVEVPLHLLRYVCLFCGKNGLSLMKDCFEYGTPETLPFLIAHAFITVVSNIRIWLHIPAVMQHIIPFRTYVIRYLCKLSDQELRQSAARNMADLMWSTVKEPLDTTLCFDKESLDLAFKYFMSPTLTMRLAGLSQITNQLHTFNDVCNNESLVSDTETSIAKELADWLISNNVVEHIFGPNLHIEIIKQCQVILNFLAAEGRLSTQHIDCIWAAAQLKHCSRYIHDLFPSLIKNLDPVPLRHLLNLVSALEPSVHTEQTLYLASMLIKALWNNALAAKAQLSKQSSFASLLNTNIPIGNKKEEEELRRTAPSPWSPAASPQSSDNSDTHQSGGSDIEMDEQLINRTKHVQQRLSDTEESMQGSSDETANSGEDGSSGPGSSSGHSDGSSNEVNSSHASQSAGSPGSEVQSEDIADIEALKEEDEDDDHGHNPPKSSCGTDLRNRKLESQAGICLGDSQGMSERNGTSSGTGKDLVFNTESLPSVDNRMRMLDACSHSEDPEHDISGEMNATHIAQGSQESCITRTGDFLGETIGNELFNCRQFIGPQHHHHHHHHHHHHDGHMVDDMLSADDVSCSSSQVSAKSEKNMADFDGEESGCEEELVQINSHAELTSHLQQHLPNLASIYHEHLSQGPVVHKHQFNSNAVTDINLDNVCKKGNTLLWDIVQDEDAVNLSEGLINEAEKLLCSLVCWFTDRQIRMRFIEGCLENLGNNRSVVISLRLLPKLFGTFQQFGSSYDTHWITMWAEKELNMMKLFFDNLVYYIQTVREGRQKHALYSHSAEVQVRLQFLTCVFSTLGSPDHFRLSLEQVDILWHCLVEDSECYDDALHWFLNQVRSKDQHAMGMETYKHLFLEKMPQLKPETISMTGLNLFQHLCNLARLATSAYDGCSNSELCGMDQFWGIALRAQSGDVSRAAIQYINSYYINGKTGLEKEQEFISKCMESLMIASSSLEQESHSSLMVIERGLLMLKTHLEAFRRRFAYHLRQWQIEGTGISSHLKALSDKQSLPLRVVCQPAGLPDKMTIEMYPSDQVADLRAEVTHWYENLQKEQINQQAQLQEFGQSNRKGEFPGGLMGPVRMISSGHELTTDYDEKALHELGFKDMQMVFVSLGAPRRERKGEGVQLPASCLPPPQKDNIPMLLLLQEPHLTTLFDLLEMLASFKPPSGKVAVDDSESLRCEELHLHAENLSRRVWELLMLLPTCPNMLMAFQNISDEQSNDGFNWKELLKIKSAHKLLYALEIIEALGKPNRRIRRESTGSYSDLYPDSDDSSEDQVENSKNSWSCKFVAAGGLQQLLEIFNSGILEPKEQESWTVWQLDCLACLLKLICQFAVDPSDLDLAYHDVFAWSGIAESHRKRTWPGKSRKAAGDHAKGLHIPRLTEVFLVLVQGTSLIQRLMSVAYTYDNLAPRVLKAQSDHRSRHEVSHYSMWLLVSWAHCCSLVKSSLADSDHLQDWLKKLTLLIPETAVRHESCSGLYKLSLSGLDGGDSINRSFLLLAASTLLKFLPDAQALKPIRIDDYEEEPILKPGCKEYFWLLCKLVDNIHIKDASQTTLLDLDALARHLADCIRSREILDHQDGNVEDDGLTGLLRLATSVVKHKPPFKFSREGQEFLRDIFNLLFLLPSLKDRQQPKCKSHSSRAAAYDLLVEMVKGSVENYRLIHNWVMAQHMQSHAPYKWDYWPHEDVRAECRFVGLTNLGATCYLASTIQQLYMIPEARQAVFTAKYSEDMKHKTTLLELQKMFTYLMESECKAYNPRPFCKTYTMDKQPLNTGEQKDMTEFFTDLITKIEEMSPELKNTVKSLFGGVITNNVVSLDCEHVSQTAEEFYTVRCQVADMKNIYESLDEVTIKDTLEGDNMYTCSHCGKKVRAEKRACFKKLPRILSFNTMRYTFNMVTMMKEKVNTHFSFPLRLDMTPYTEDFLMGKSERKEGFKEVSDHSKDSESYEYDLIGVTVHTGTADGGHYYSFIRDIVNPHAYKNNKWYLFNDAEVKPFDSAQLASECFGGEMTTKTYDSVTDKFMDFSFEKTHSAYMLFYKRMEPEEENGREYKFDVSSELLEWIWHDNMQFLQDKNIFEHTYFGFMWQLCSCIPSTLPDPKAVSLMTAKLSTSFVLETFIHSKEKPTMLQWIELLTKQFNNSQAACEWFLDRMADDDWWPMQILIKCPNQIVRQMFQRLCIHVIQRLRPVHAHLYLQPGMEDGSDDMDTSVEDIGGRSCVTRFVRTLLLIMEHGVKPHSKHLTEYFAFLYEFAKMGEEESQFLLSLQAISTMVHFYMGTKGPENPQVEVLSEEEGEEEEEEEDILSLAEEKYRPAALEKMIALVALLVEQSRSERHLTLSQTDMAALTGGKGFPFLFQHIRDGINIRQTCNLIFSLCRYNNRLAEHIVSMLFTSIAKLTPEAANPFFKLLTMLMEFAGGPPGMPPFASYILQRIWEVIEYNPSQCLDWLAVQTPRNKLAHSWVLQNMENWVERFLLAHNYPRVRTSAAYLLVSLIPSNSFRQMFRSTRSLHIPTRDLPLSPDTTVVLHQVYNVLLGLLSRAKLYVDAAVHGTTKLVPYFSFMTYCLISKTEKLMFSTYFMDLWNLFQPKLSEPAIATNHNKQALLSFWYNVCADCPENIRLIVQNPVVTKNIAFNYILADHDDQDVVLFNRGMLPAYYGILRLCCEQSPAFTRQLASHQNIQWAFKNLTPHASQYPGAVEELFNLMQLFIAQRPDMREEELEDIKQFKKTTISCYLRCLDGRSCWTTLISAFRILLESDEDRLLVVFNRGLILMTESFNTLHMMYHEATACHVTGDLVELLSIFLSVLKSTRPYLQRKDVKQALIQWQERIEFAHKLLTLLNSYSPPELRNACIDVLKELVLLSPHDFLHTLVPFLQHNHCTYHHSNIPMSLGPYFPCRENIKLIGGKSNIRPPRPELNMCLLPTMVETSKGKDDVYDRMLLDYFFSYHQFIHLLCRVAINCEKFTETLVKLSVLVAYEGLPLHLALFPKLWTELCQTQSAMSKNCIKLLCEDPVFAEYIKCILMDERTFLNNNIVYTFMTHFLLKVQSQVFSEANCANLISTLITNLISQYQNLQSDFSNRVEISKASASLNGDLRALALLLSVHTPKQLNPALIPTLQELLSKCRTCLQQRNSLQEQEAKERKTKDDEGATPIKRRRVSSDEEHTVDSCISDMKTETREVLTPTSTSDNETRDSSIIDPGTEQDLPSPENSSVKEYRMEVPSSFSEDMSNIRSQHAEEQSNNGRYDDCKEFKDLHCSKDSTLAEEESEFPSTSISAVLSDLADLRSCDGQALPSQDPEVALSLSCGHSRGLFSHMQQHDILDTLCRTIESTIHVVTRISGKGNQAAS

SEQ ID NO: 94895 - protein, 45 aa, Homo sapiens
  Payload ID: 18928
  Gene Name: ubiquitin specific peptidase 34
  ENSP ID: ENSP00000388129
  MOD_RES (1)..(1): Any amino acid
XCENCADLVEVLNEISDVEGGDGLQLRKEHTLKIFTYINSWTQRM

SEQ ID NO: 94896 - protein, 424 aa, Homo sapiens
  Payload ID: 18928
  Gene Name: ubiquitin specific peptidase 34
  ENSP ID: ENSP00000398489
GKSNIRPPRPELNMCLLPTMVETSKFIHLLCRVAINCEKFTETLVKLSVLVAYEGLPLHLALFPKLWTELCQTQSAMSKNCIKLLCEDPVFAEYIKCILMDERTFLNNNIVYTFMTHFLLKVQSQVFSEANCANLISTLITNLISQYQNLQSDFSNRVEISKASASLNGDLRALALLLSVHTPKQLNPALIPTLQELLSKCRTCLQQRNSLQEQEAKERKTKDDEGATPIKRRRVSSDEEHTVDSCISDMKTETREVLTPTSTSDNETRDSSIIDPGTEQDLPSPENSSVKEYRMEVPSSFSEDMSNIRSQHAEEQSNNGRYDDCKEFKDLHCSKDSTLAEEESEFPSTSISAVLSDLADLRSCDGQALPSQDPEVALSLSCGHSRGLFSHMQQHDILDTLCRTIESTIHVVTRISGKGNQAAS

SEQ ID NO: 94897 - protein, 1223 aa, Homo sapiens
  Payload ID: 18928
  Gene Name: ubiquitin specific peptidase 34
  ENSP ID: ENSP00000398960
  MOD_RES (1)..(1): Any amino acid
XEEENGREYKFDVSSELLEWIWHDNMQFLQDKNIFEHTYFGFMWQLCSCIPSTLPDPKAVSLMTAKLSTSFVLETFIHSKEKPTMLQWIELLTKQFNNSQAACEWFLDRMADDDWWPMQILIKCPNQIVRQMFQRLCIHVIQRLRPVHAHLYLQPGMEDGSDDMDTSVEDIGGRSCVTRFVRTLLLIMEHGVKPHSKHLTEYFAFLYEFAKMGEEESQFLLSLQAISTMVHFYMGTKGPENPQVEVLSEEEGEEEEEEEDILSLAEEKYRPAALEKMIALVALLVEQSRSERHLTLSQTDMAALTGGKGFPFLFQHIRDGINIRQTCNLIFSLCRYNNRLAEHIVSMLFTSIAKLTPEAANPFFKLLTMLMEFAGGPPGMPPFASYILQRIWEVIEYNPSQCLDWLAVQTPRNKLAHSWVLQNMENWVERFLLAHNYPRVRTSAAYLLVSLIPSNSFRQMFRSTRSLHIPTRDLPLSPDTTVVLHQVYNVLLGLLSRAKLYVDAAVHGTTKLVPYFSFMTYCLISKTEKLMFSTYFMDLWNLFQPKLSEPAIATNHNKQALLSFWYNVCADCPENIRLIVQNPVVTKNIAFNYILADHDDQDVVLFNRGMLPAYYGILRLCCEQSPAFTRQLASHQNIQWAFKNLTPHASQYPGAVEELFNLMQLFIAQRPDMREEELEDIKQFKKTTISCYLRCLDGRSCWTTLISAFRILLESDEDRLLVVFNRGLILMTESFNTLHMMYHEATACHVTGDLVELLSIFLSVLKSTRPYLQRKDVKQALIQWQERIEFAHKLLTLLNSYSPPELRNACIDVLKELVLLSPHDFLHTLVPFLQHNHCTYHHSNIPSVLVAYEGLPLHLALFPKLWTELCQTQSAMSKNCIKLLCEDPVFAEYIKCILMDERTFLNNNIVYTFMTHFLLKVQSQVFSEANCANLISTLITNLISQYQNLQSDFSNRVEISKASASLNGDLRALALLLSVHTPKQLNPALIPTLQELLSKCRTCLQQRNSLQEQEAKERKTKDDEGATPIKRRRVSSDEEHTVDSCISDMKTETREVLTPTSTSDNETRDSSIIDPGTEQDLPSPENSSVKEYRMEVPSSFSEDMSNIRSQHAEEQSNNGRYDDCKEFKDLHCSKDSTLAEEESEFPSTSISAVLSDLADLRSCDGQALPSQDPEVALSLSCGHSRGLFSHMQQHDILDTLCRTIESTIHVVTRISGKGNQAAS

SEQ ID NO: 94898 - protein, 810 aa, Homo sapiens
  Payload ID: 18928
  Gene Name: ubiquitin specific peptidase 34
  ENSP ID: ENSP00000410559
EEPILKPGCKEYFWLLCKLVDNIHIKDASQTTLLDLDALARHLADCIRSREILDHQDGNVEDDGLTGLLRLATSVVKHKPPFKFSREGQEFLRDIFNLLFLLPSLKDRQQPKCKSHSSRAAAYDLLVEMVKGSVENYRLIHNWVMAQHMQSHAPYKWDYWPHEDVRAECRFVGLTNLGATCYLASTIQQLYMIPEARQAVFTAKYSEDMKHKTTLLELQKMFTYLMESECKAYNPRPFCKTYTMDKQPLNTGEQKDMTEFFTDLITKIEEMSPELKNTVKSLFGGVITNNVVSLDCEHVSQTAEEFYTVRCQVADMKNIYESLDEVTIKDTLEGDNMYTCSHCGKKVRAEKRACFKKLPRILSFNTMRYTFNMVTMMKEKVNTHFSFPLRLDMTPYTEDFLMGKSERKEGFKEVSDHSKDSESYEYDLIGVTVHTGTADGGHYYSFIRDIVNPHAYKNNKWYLFNDAEVKPFDSAQLASECFGGEMTTKTYDSVTDKFMDFSFEKTHSAYMLFYKRMEPEEENGREYKFDVSSELLEWIWHDNMQFLQDKNIFEHTYFGFMWQLCSCIPSTLPDPKAVSLMTAKLSTSFVLETFIHSKEKPTMLQWIELLTKQFNNSQAACEWFLDRMADDDWWPMQILIKCPNQIVRQMFQRLCIHVIQRLRPVHAHLYLQPGMEDGSDDMDTSVEDIGGRSCVTRFVRTLLLIMEHGVKPHSKHLTEYFAFLYEFAKMGEEESQFLLSLQAISTMVHFYMGTKGPENPQVEVLSEEEGEEEEEEEDILSLAEEKYRPAALEKMIALVALLVEQSRSER

SEQ ID NO: 94899 - protein, 1018 aa, Homo sapiens
  Payload ID: 18929
  Gene Name: ubiquitin specific peptidase 35
  Uniprot ID: Q9P2H5
  ENSP ID: ENSP00000431876
MDKILEAVVTSSYPVSVKQGLVRRVLEAARQPLEREQCLALLALGARLYVGGAEELPRRVGCQLLHVAGRHHPDVFAEFFSARRVLRLLQGGAGPPGPRALACVQLGLQLLPEGPAADEVFALLRREVLRTVCERPGPAACAQVARLLARHPRCVPDGPHRLLFCQQLVRCLGRFRCPAEGEEGAVEFLEQAQQVSGLLAQLWRAQPAAILPCLKELFAVISCAEEEPPSSALASVVQHLPLELMDGVVRNLSNDDSVTDSQMLTAISRMIDWVSWPLGKNIDKWIIALLKGLAAVKKFSILIEVSLTKIEKVFSKLLYPIVRGAALSVLKYMLLTFQHSHEAFHLLLPHIPPMVASLVKEDSNSGTSCLEQLAELVHCMVFRFPGFPDLYEPVMEAIKDLHVPNEDRIKQLLGQDAWTSQKSELAGFYPRLMAKSDTGKIGLINLGNTCYVNSILQALFMASDFRHCVLRLTENNSQPLMTKLQWLFGFLEHSQRPAISPENFLSASWTPWFSPGTQQDCSEYLKYLLDRLHEEEKTGTRICQKLKQSSSPSPPEEPPAPSSTSVEKMFGGKIVTRICCLCCLNVSSREEAFTDLSLAFPPPERCRRRRLGSVMRPTEDITARELPPPTSAQGPGRVGPRRQRKHCITEDTPPTSLYIEGLDSKEAGGQSSQEERIEREEEGKEERTEKEEVGEEEESTRGEGEREKEEEVEEEEEKVEKETEKEAEQEKEEDSLGAGTHPDAAIPSGERTCGSEGSRSVLDLVNYFLSPEKLTAENRYYCESCASLQDAEKVVELSQGPCYLILTLLRFSFDLRTMRRRKILDDVSIPLLLRLPLAGGRGQAYDLCSVVVHSGVSSESGHYYCYAREGAARPAASLGTADRPEPENQWYLFNDTRVSFSSFESVSNVTSFFPKDTAYVLFYRQRPREGPEAELGSSRVRTEPTLHKDLMEAISKDNILYLQEQEKEARSRAAYISALPTSPHWGRGFDEDKDEDEGSPGGCNPAGGNGGDFHRLVF

SEQ ID NO: 94900 - protein, 749 aa, Homo sapiens
  Payload ID: 18929
  Gene Name: ubiquitin specific peptidase 35
  Uniprot ID: Q9P2H5
  ENSP ID: ENSP00000434942
MIDWVSWPLGKNIDKWIIALLKGLAAVKKFSILIEVSLTKIEKVFSKLLYPIVRGAALSVLKYMLLTFQHSHEAFHLLLPHIPPMVASLVKEDSNSGTSCLEQLAELVHCMVFRFPGFPDLYEPVMEAIKDLHVPNEDRIKQLLGQDAWTSQKSELAGFYPRLMAKSDTGKIGLINLGNTCYVNSILQALFMASDFRHCVLRLTENNSQPLMTKLQWLFGFLEHSQRPAISPENFLSASWTPWFSPGTQQDCSEYLKYLLDRLHEEEKTGTRICQKLKQSSSPSPPEEPPAPSSTSVEKMFGGKIVTRICCLCCLNVSSREEAFTDLSLAFPPPERCRRRRLGSVMRPTEDITARELPPPTSAQGPGRVGPRRQRKHCITEDTPPTSLYIEGLDSKEAGGQSSQEERIEREEEGKEERTEKEEVGEEEESTRGEGEREKEEEVEEEEEKVEKETEKEAEQEKEEDSLGAGTHPDAAIPSGERTCGSEGSRSVLDLVNYFLSPEKLTAENRYYCESCASLQDAEKVVELSQGPCYLILTLLRFSFDLRTMRRRKILDDVSIPLLLRLPLAGGRGQAYDLCSVVVHSGVSSESGHYYCYAREGAARPAASLGTADRPEPENQWYLFNDTRVSFSSFESVSNVTSFFPKDTAYVLFYRQRPREGPEAELGSSRVRTEPTLHKDLMEAISKDNILYLQEQEKEARSRAAYISALPTSPHWGRGFDEDKDEDEGSPGGCNPAGGNGGDFHRLVF

SEQ ID NO: 94901 - protein, 586 aa, Homo sapiens
  Payload ID: 18929
  Gene Name: ubiquitin specific peptidase 35
  ENSP ID: ENSP00000435468
MAKSDTGKIGLINLGNTCYVNSILQALFMASDFRHCVLRLTENNSQPLMTKLQWLFGFLEHSQRPAISPENFLSASWTPWFSPGTQQDCSEYLKYLLDRLHEEEKTGTRICQKLKQSSSPSPPEEPPAPSSTSVEKMFGGKIVTRICCLCCLNVSSREEAFTDLSLAFPPPERCRRRRLGSVMRPTEDITARELPPPTSAQGPGRVGPRRQRKHCITEDTPPTSLYIEGLDSKEAGGQSSQEERIEREEEGKEERTEKEEVGEEEESTRGEGEREKEEEVEEEEEKVEKETEKEAEQEKEEDSLGAGTHPDAAIPSGERTCGSEGSRSVLDLVNYFLSPEKLTAENRYYCESCASLQDAEKVVELSQGPCYLILTLLRFSFDLRTMRRRKILDDVSIPLLLRLPLAGGRGQAYDLCSVVVHSGVSSESGHYYCYAREGAARPAASLGTADRPEPENQWYLFNDTRVSFSSFESVSNVTSFFPKDTAYVLFYRQRPREGPEAELGSSRVRTEPTLHKDLMEAISKDNILYLQEQEKEARSRAAYISALPTSPHWGRGFDEDKDEDEGSPGGCNPAGGNGGDFHRLVF

SEQ ID NO: 94902 - protein, 298 aa, Homo sapiens
  Payload ID: 18929
  Gene Name: ubiquitin specific peptidase 35
  ENSP ID: ENSP00000436001
MDGVVRNLSNDDSVTDSQMLTAISRMIDWVSWPLGKNIDKWIIALLKGLAAVKKFSILIEVSLTKIEKVFSKLLYPIVRGAALSVLKYMLLTFQHSHEAFHLLLPHIPPMVASLVKEDSNSGTSCLEQLAELVHCMVFRFPGFPDLYEPVMEAIKDLHVPNEDRIKQLLGQDAWTSQKSELAGFYPRLMAKSDTGKIGLINLGNTCYVNSILQALFMASDFRHCVLRLTENNSQPLMTKLQWLFGFLEHSQRPAISPENFLSASWTPWFSPGTQQDCSEYLKYLLDRLHEEEKTGTRI

SEQ ID NO: 94903 - protein, 108 aa, Homo sapiens
  Payload ID: 18929
  Gene Name: ubiquitin specific peptidase 35
  ENSP ID: ENSP00000436253
  MOD_RES (1)..(1): Any amino acid
XAVEFLEQAQQVSGLLAQLWRAQPAAILPCLKELFAVISCAEEEPPSSALASVVQHLPLELMDGVVRNLSNDDSVTDSQMLTAISRFSLSCCTPSSGELPCLCSSTCS

SEQ ID NO: 94904 - protein, 1123 aa, Homo sapiens
  Payload ID: 18930
  Gene Name: ubiquitin specific peptidase 36
  Uniprot ID: Q9P275
  ENSP ID: ENSP00000310590
MPIVDKLKEALKPGRKDSADDGELGKLLASSAKKVLLQKIEFEPASKSFSYQLEALKSKYVLLNPKTEGASRHKSGDDPPARRQGSEHTYESCGDGVPAPQKVLFPTERLSLRWERVFRVGAGLHNLGNTCFLNATIQCLTYTPPLANYLLSKEHARSCHQGSFCMLCVMQNHIVQAFANSGNAIKPVSFIRDLKKIARHFRFGNQEDAHEFLRYTIDAMQKACLNGCAKLDRQTQATTLVHQIFGGYLRSRVKCSVCKSVSDTYDPYLDVALEIRQAANIVRALELFVKADVLSGENAYMCAKCKKKVPASKRFTIHRTSNVLTLSLKRFANFSGGKITKDVGYPEFLNIRPYMSQNNGDPVMYGLYAVLVHSGYSCHAGHYYCYVKASNGQWYQMNDSLVHSSNVKVVLNQQAYVLFYLRIPGSKKSPEGLISRTGSSSLPGRPSVIPDHSKKNIGNGIISSPLTGKRQDSGTMKKPHTTEEIGVPISRNGSTLGLKSQNGCIPPKLPSGSPSPKLSQTPTHMPTILDDPGKKVKKPAPPQHFSPRTAQGLPGTSNSNSSRSGSQRQGSWDSRDVVLSTSPKLLATATANGHGLKGNDESAGLDRRGSSSSSPEHSASSDSTKAPQTPRSGAAHLCDSQETNCSTAGHSKTPPSGADSKTVKLKSPVLSNTTTEPASTMSPPPAKKLALSAKKASTLWRATGNDLRPPPPSPSSDLTHPMKTSHPVVASTWPVHRARAVSPAPQSSSRLQPPFSPHPTLLSSTPKPPGTSEPRSCSSISTALPQVNEDLVSLPHQLPEASEPPQSPSEKRKKTFVGEPQRLGSETRLPQHIREATAAPHGKRKRKKKKRPEDTAASALQEGQTQRQPGSPMYRREGQAQLPAVRRQEDGTQPQVNGQQVGCVTDGHHASSRKRRRKGAEGLGEEGGLHQDPLRHSCSPMGDGDPEAMEESPRKKKKKKRKQETQRAVEEDGHLKCPRSAKPQDAVVPESSSCAPSANGWCPGDRMGLSQAPPVSWNGERESDVVQELLKYSSDKAYGRKVLTWDGKMSAVSQDAIEDSRQARTETVVDDWDEEFDRGKEKKIKKFKREKRRNFNAFQKLQTRRNFWSVTHPAKAASLSYRR

SEQ ID NO: 94905 - protein, 548 aa, Homo sapiens
  Payload ID: 18930
  Gene Name: ubiquitin specific peptidase 36
  ENSP ID: ENSP00000401119
MPIVDKLKEALKPGRKDSADDGELGKLLASSAKKVLLQKIEFEPASKSFSYQLEALKSKYVLLNPKTEGASRHKSGDDPPARRQGSEHTYESCGDGVPAPQKVLFPTERLSLRWERVFRVGAGLHNLGNTCFLNATIQCLTYTPPLANYLLSKEHARSCHQGSFCMLCVMQNHIVQAFANSGNAIKPVSFIRDLKKIARHFRFGNQEDAHEFLRYTIDAMQKACLNGCAKLDRQTQATTLVHQIFGGYLRSRVKCSVCKSVSDTYDPYLDVALEIRQAANIVRALELFVKADVLSGENAYMCAKCKKKVPASKRFTIHRTSNVLTLSLKRFANFSGGKITKDVGYPEFLNIRPYMSQNNGDPVMYGLYAVLVHSGYSCHAGHYYCYVKASNGQWYQMNDSLVHSSNVKVVLNQQAYVLFYLRIPGSKKSPEGLISRTGSSSLPGRPSVIPDHSKKNIGNGIISSPLTGKRQDSGTMKKPHTTEEIGVPISRNGSTLGLKSQNGCIPPKLPSGSPSPKLSQTPTHMPTILDDPGKKVKKPAPPLPTGMG

SEQ ID NO: 94906 - protein, 1123 aa, Homo sapiens; identical to SEQ ID NO: 94904
  Payload ID: 18930
  Gene Name: ubiquitin specific peptidase 36
  Uniprot ID: Q9P275
  ENSP ID: ENSP00000441214

SEQ ID NO: 94907 - protein, 101 aa, Homo sapiens
  Payload ID: 18930
  Gene Name: ubiquitin specific peptidase 36
  ENSP ID: ENSP00000464746
  MOD_RES (1)..(1): Any amino acid
XDVVQELLKYSSDKAYGRKVLTWDGKMSAVSQDAIEDSRQARTETVVDDWDEEFDRGKEKKIKKFKREKRRNFNAFQKLQTRRNFWSVTHPAKAASLSYRR

SEQ ID NO: 94908 - protein, 24 aa, Homo sapiens
  Payload ID: 18930
  Gene Name: ubiquitin specific peptidase 36
  ENSP ID: ENSP00000464886
  MOD_RES (1)..(1): Any amino acid
XLQTRRNFWSVTHPAKAASLSYRR

SEQ ID NO: 94909 - protein, 52 aa, Homo sapiens
  Payload ID: 18930
  Gene Name: ubiquitin specific peptidase 36
  ENSP ID: ENSP00000465183
MPIVDKLKEALKPGRKDSADDGELGKLLASSAKKVLLQKIEFEPASKSFSYQ

SEQ ID NO: 94910 - protein, 71 aa, Homo sapiens
  Payload ID: 18930
  Gene Name: ubiquitin specific peptidase 36
  ENSP ID: ENSP00000465679
  MOD_RES (1)..(1): Any amino acid
XQDAIEDSRQARTETVVDDWDEEFDRGKEKKIKKFKREKRRNFNAFQKLQTRRNFWSVTHPAKAASLSYRR

SEQ ID NO: 94911 - protein, 69 aa, Homo sapiens
  Payload ID: 18930
  Gene Name: ubiquitin specific peptidase 36
  ENSP ID: ENSP00000465698
  MOD_RES (1)..(1): Any amino acid
XAIEDSRQARTETVVDDWDEEFDRGKEKKIKKFKREKRRNFNAFQKLQTRRNFWSVTHPAKAASLSYRR

SEQ ID NO: 94912 - protein, 234 aa, Homo sapiens
  Payload ID: 18930
  Gene Name: ubiquitin specific peptidase 36
  ENSP ID: ENSP00000466187
MPIVDKLKEALKPGRKDSADDGELGKLLASSAKKVLLQKIEFEPASKSFSYQLEALKSKYVLLNPKTEGASRHKSGDDPPARRQGSEHTYESCGDGVPAPQKVLFPTERLSLRWERVFRVGAGLHNLGNTCFLNATIQCLTYTPPLANYLLSKEHARSCHQGSFCMLCVMQNHIVQAFANSGNAIKPVSFIRDLKKIARHFRFGNQEDAHEFLRYTIDAMQKACLNGCAKIKIE

SEQ ID NO: 94913 - protein, 80 aa, Homo sapiens
  Payload ID: 18930
  Gene Name: ubiquitin specific peptidase 36
  ENSP ID: ENSP00000466212
MPIVDKLKEALKPGRKDSADDGELGKLLASSAKKVLLQKIEFEPASKSFSYQLEALKSKYVLLNPKTEGASRHKSGDDPP

SEQ ID NO: 94914 - protein, 259 aa, Homo sapiens
  Payload ID: 18930
  Gene Name: ubiquitin specific peptidase 36
  ENSP ID: ENSP00000466567
MILYWSPKYFRAPGVWEVPWLDRQTQATTLVHQIFGGYLRSRVKCSVCKSVSDTYDPYLDVALEIRQAANIVRALELFVKADVLSGENAYMCAKCKKKVPASKRFTIHRTSNVLTLSLKRFANFSGGKITKDVGYPEFLNIRPYMSQNNGDPVMYGLYAVLVHSGYSCHAGHYYCYVKASNGQWYQMNDSLVHSSNVKVVLNQQAYVLFYLRIPGSKKSPEGLISRTGSSSLPGRPSVIPDHSKKNIGNGIISSPLTGK

SEQ ID NO: 94915 - protein, 1123 aa, Homo sapiens; identical to SEQ ID NO: 94904
  Payload ID: 18930
  Gene Name: ubiquitin specific peptidase 36
  Uniprot ID: Q9P275
  ENSP ID: ENSP00000467280

SEQ ID NO: 94916 - protein, 179 aa, Homo sapiens
  Payload ID: 18930
  Gene Name: ubiquitin specific peptidase 36
  ENSP ID: ENSP00000467520
MPIVDKLKEALKPGRKDSADDGELGKLLASSAKKVLLQKIEFEPASKSFSYQLEALKSKYVLLNPKTEGASRHKSGDDPPARRQGSEHTYESCGDGVPAPQKVLFPTERLSLRWERVFRVGAGLHNLGNTCFLNATIQCLTYTPPLANYLLSKEHARSCHQGSFCMLCVMQNHIVQAFA

SEQ ID NO: 94917 - protein, 285 aa, Homo sapiens
  Payload ID: 18930
  Gene Name: ubiquitin specific peptidase 36
  ENSP ID: ENSP00000467682
MPIVDKLKEALKPGRKDSADDGELGKLLASSAKKVLLQKIEFEPASKSFSYQLEALKSKYVLLNPKTEGASRHKSGDDPPARRQGSEHTYESCGDGVPAPQKVLFPTERLSLRWERVFRVGAGLHNLGNTCFLNATIQCLTYTPPLANYLLSKEHARSCHQGSFCMLCVMQNHIVQAFANSGNAIKPVSFIRDLKKIARHFRFGNQEDAHEFLRYTIDAMQKACLNGCAKCVLPHPPSQGFGHLFYMVAAEHSYGNSQPGTFLPRLPLGRRGRICLWVLKLLEPK

SEQ ID NO: 94918 - protein, 159 aa, Homo sapiens
  Payload ID: 18930
  Gene Name: ubiquitin specific peptidase 36
  ENSP ID: ENSP00000467951
MPIVDKLKEALKPGRKDSADDGELGKLLASSAKKVLLQKIEFEPASKSFSYQLEALKSKYVLLNPKTEGASRHKSGDDPPARRQGSEHTYESCGDGVPAPQKVLFPTERLSLRWERVFRVGAGLHNLGNTCFLNATIQCLTYTPPLANYLLSKEHARSC

SEQ ID NO: 94919 - protein, 66 aa, Homo sapiens
  Payload ID: 18930
  Gene Name: ubiquitin specific peptidase 36
  ENSP ID: ENSP00000468194
MPIVDKLKEALKPGRKDSADDGELGKLLASSAKKVLLQKIEFEPASKSFSYQLEALKSKYVLLNPK

SEQ ID NO: 94920 - protein, 11 aa, Homo sapiens
  Payload ID: 18930
  Gene Name: ubiquitin specific peptidase 36
  ENSP ID: ENSP00000468356
PAKAASLSYRR

SEQ ID NO: 94921 - protein, 961 aa, Homo sapiens
  Payload ID: 18930
  Gene Name: ubiquitin specific peptidase 36
  ENSP ID: ENSP00000468549
MPIVDKLKEALKPGRKDSADDGELGKLLASSAKKVLLQKIEFEPASKSFSYQLEALKSKYVLLNPKTEGASRHKSGDDPPARRQGSEHTYESCGDGVPAPQKVLFPTERLSLRWERVFRVGAGLHNLGNTCFLNATIQCLTYTPPLANYLLSKEHARSCHQGSFCMLCVMQNHIVQAFANSGNAIKPVSFIRDLKKIARHFRFGNQEDAHEFLRYTIDAMQKACLNGCAKLDRQTQATTLVHQIFGGYLRSRVKCSVCKSVSDTYDPYLDVALEIRQAANIVRALELFVKADVLSGENAYMCAKCKKKVPASKRFTIHRTSNVLTLSLKRFANFSGGKITKDVGYPEFLNIRPYMSQNNGDPVMYGLYAVLVHSGYSCHAGHYYCYVKASNGQWYQMNDSLVHSSNVKVVLNQQAYVLFYLRIPGSKKSPEGLISRTGSSSLPGRPSVIPDHSKKNIGNGIISSPLTGKRQDSGTMKKPHTTEEIGVPISRNGSTLGLKSQNGCIPPKLPSGSPSPKLSQTPTHMPTILDDPGKKVKKPAPPQHFSPRTAQGLPGTSNSNSSRSGSQRQGSWDSRDVVLSTSPKLLATATANGHGLKGNDESAGLDRRGSSSSSPEHSASSDSTKAPQTPRSGAAHLCDSQETNCSTAGHSKTPPSGADSKTVKLKSPVLSNTTTEPASTMSPPPAKKLALSAKKASTLWRATGNDLRPPPPSPSSDLTHPMKTSHPVVASTWPVHRARAVSPAPQSSSRLQPPFSPHPTLLSSTPKPPGTSEPRSCSSISTALPQVNEDLVSLPHQLPEASEPPQSPSEKRKKTFVGEPQRLGSETRLPQHIREATAAPHGKRKRKKKKRPEDTAASALQEGQTQRQPGSPMYRREGQAQLPAVRRQEDGTQPQVNGQQVGCVTDGHHASSRKRRRKGAEGLGEEGGLHQDPLRHSCSPMGDGDPEAMEESPRKKKKKKR

SEQ ID NO: 94922 - protein, 61 aa, Homo sapiens
  Payload ID: 18930
  Gene Name: ubiquitin specific peptidase 36
  ENSP ID: ENSP00000475654
MPIVDKLKEALKPGRKDSADDGELGKLLASSAKKAVSTRMRAVVTESQPRRKCFSPRSDCL

SEQ ID NO: 94923 - protein, 979 aa, Homo sapiens
  Payload ID: 18931
  Gene Name: ubiquitin specific peptidase 37
  Uniprot ID: Q86T82
  ENSP ID: ENSP00000258399
MSPLKIHGPIRIRSMQTGITKWKEGSFEIVEKENKVSLVVHYNTGGIPRIFQLSHNIKNVVLRPSGAKQSRLMLTLQDNSFLSIDKVPSKDAEEMRLFLDAVHQNRLPAAMKPSQGSGSFGAILGSRTSQKETSRQLSYSDNQASAKRGSLETKDDIPFRKVLGNPGRGSIKTVAGSGIARTIPSLTSTSTPLRSGLLENRTEKRKRMISTGSELNEDYPKENDSSSNNKAMTDPSRKYLTSSREKQLSLKQSEENRTSGLLPLQSSSFYGSRAGSKEHSSGGTNLDRTNVSSQTPSAKRSLGFLPQPVPLSVKKLRCNQDYTGWNKPRVPLSSHQQQQLQGFSNLGNTCYMNAILQSLFSLQSFANDLLKQGIPWKKIPLNALIRRFAHLLVKKDICNSETKKDLLKKVKNAISATAERFSGYMQNDAHEFLSQCLDQLKEDMEKLNKTWKTEPVSGEENSPDISATRAYTCPVITNLEFEVQHSIICKACGEIIPKREQFNDLSIDLPRRKKPLPPRSIQDSLDLFFRAEELEYSCEKCGGKCALVRHKFNRLPRVLILHLKRYSFNVALSLNNKIGQQVIIPRYLTLSSHCTENTKPPFTLGWSAHMAISRPLKASQMVNSCITSPSTPSKKFTFKSKSSLALCLDSDSEDELKRSVALSQRLCEMLGNEQQQEDLEKDSKLCPIEPDKSELENSGFDRMSEEELLAAVLEISKRDASPSLSHEDDDKPTSSPDTGFAEDDIQEMPENPDTMETEKPKTITELDPASFTEITKDCDENKENKTPEGSQGEVDWLQQYDMEREREEQELQQALAQSLQEQEAWEQKEDDDLKRATELSLQEFNNSFVDALGSDEDSGNEDVFDMEYTEAEAEELKRNAETGNLPHSYRLISVVSHIGSTSSSGHYISDVYDIKKQAWFTYNDLEVSKIQEAAVQSDRDRSGYIFFYMHKEIFDELLETEKNSQSLSTEVGKTTRQAL

SEQ ID NO: 94924 - protein, 302 aa, Homo sapiens
  Payload ID: 18931
  Gene Name: ubiquitin specific peptidase 37
  ENSP ID: ENSP00000345043
MSPLKIHGPIRIRSMQTGITKWKEGSFEIVEKENKVSLVVHYNTGGIPRIFQLSHNIKNVVLRPSGAKQSRLMLTLQDNSFLSIDKVPSKDAEEMRLFLDAVHQNRLPAAMKPSQGSGSFGAILGSRTSQKETSRQLSYSDNQASAKRGSLETKDDIPFRKVLGNPGRGSIKTVAGSGIARTIPSLTSTSTPLRSGLLENRTEKRKRMISTGSELNEDYPKENDSSSNNKAMTDPSRKYLTSSREKQLSLKQSEENRTSGLLPLQSSSFYGSRAGSKEHSSGGTNLDRFIGYKYIRYLLSTC

SEQ ID NO: 94925 - protein, 979 aa, Homo sapiens; identical to SEQ ID NO: 94923
  Payload ID: 18931
  Gene Name: ubiquitin specific peptidase 37
  Uniprot ID: Q86T82
  ENSP ID: ENSP00000393662

SEQ ID NO: 94926 - protein, 979 aa, Homo sapiens; identical to SEQ ID NO: 94923
  Payload ID: 18931
  Gene Name: ubiquitin specific peptidase 37
  Uniprot ID: Q86T82
  ENSP ID: ENSP00000396585

SEQ ID NO: 94927 - protein, 885 aa, Homo sapiens
  Payload ID: 18931
  Gene Name: ubiquitin specific peptidase 37
  Uniprot ID: Q86T82
  ENSP ID: ENSP00000400902
MLTLQDNSFLSIDKVPSKDAEEMRLFLDAVHQNRLPAAMKPSQGSGSFGAILGSRTSQKETSRQLSYSDNQASAKRGSLETKDDIPFRKVLGNPGRGSIKTVAGSGIARTIPSLTSTSTPLRSGLLENRTEKRKRMISTGSELNEDYPKENDSSSNNKAMTDPSRKYLTSSREKQLSLKQSEENRTSGLLPLQSSSFYGSRAGSKEHSSGGTNLDRTNVSSQTPSAKRSLGFLPQPVPLSVKKLRCNQDYTGWNKPRVPLSSHQQQQLQGFSNLGNTCYMNAILQSLFSLQSFANDLLKQGIPWKKIPLNALIRRFAHLLVKKDICNSETKKDLLKKVKNAISATAERFSGYMQNDAHEFLSQCLDQLKEDMEKLNKTWKTEPVSGEENSPDISATRAYTCPVITNLEFEVQHSIICKACGEIIPKREQFNDLSIDLPRRKKPLPPRSIQDSLDLFFRAEELEYSCEKCGGKCALVRHKFNRLPRVLILHLKRYSFNVALSLNNKIGQQVIIPRYLTLSSHCTENTKPPFTLGWSAHMAMKFTFKSKSSLALCLDSDSEDELKRSVALSQRLCEMLGNEQQQEDLEKDSKLCPIEPDKSELENSGFDRMSEEELLAAVLEISKRDASPSLSHEDDDKPTSSPDTGFAEDDIQEMPENPDTMETEKPKTITELDPASFTEITKDCDENKENKTPEGSQGEVDWLQQYDMEREREEQELQQALAQSLQEQEAWEQKEDDDLKRATELSLQEFNNSFVDALGSDEDSGNEDVFDMEYTEAEAEELKRNAETGNLPHSYRLISVVSHIGSTSSSGHYISDVYDIKKQAWFTYNDLEVSKIQEAAVQSDRDRSGYIFFYMHKEIFDELLETEKNSQSLSTEVGKTTRQAL

SEQ ID NO: 94928 - protein, 1042 aa, Homo sapiens
  Payload ID: 18932
  Gene Name: ubiquitin specific peptidase 38
  Uniprot ID: Q8NB14
  ENSP ID: ENSP00000303434
MDKILEGLVSSSHPLPLKRVIVRKVVESAEHWLDEAQCEAMFDLTTRLILEGQDPFQRQVGHQVLEAYARYHRPEFESFFNKTFVLGLLHQGYHSLDRKDVAILDYIHNGLKLIMSCPSVLDLFSLLQVEVLRMVCERPEPQLCARLSDLLTDFVQCIPKGKLSITFCQQLVRTIGHFQCVSTQERELREYVSQVTKVSNLLQNIWKAEPATLLPSLQEVFASISSTDASFEPSVALASLVQHIPLQMITVLIRSLTTDPNVKDASMTQALCRMIDWLSWPLAQHVDTWVIALLKGLAAVQKFTILIDVTLLKIELVFNRLWFPLVRPGALAVLSHMLLSFQHSPEAFHLIVPHVVNLVHSFKNDGLPSSTAFLVQLTELIHCMMYHYSGFPDLYEPILEAIKDFPKPSEEKIKLILNQSAWTSQSNSLASCLSRLSGKSETGKTGLINLGNTCYMNSVIQALFMATDFRRQVLSLNLNGCNSLMKKLQHLFAFLAHTQREAYAPRIFFEASRPPWFTPRSQQDCSEYLRFLLDRLHEEEKILKVQASHKPSEILECSETSLQEVASKAAVLTETPRTSDGEKTLIEKMFGGKLRTHIRCLNCRSTSQKVEAFTDLSLAFCPSSSLENMSVQDPASSPSIQDGGLMQASVPGPSEEPVVYNPTTAAFICDSLVNEKTIGSPPNEFYCSENTSVPNESNKILVNKDVPQKPGGETTPSVTDLLNYFLAPEILTGDNQYYCENCASLQNAEKTMQITEEPEYLILTLLRFSYDQKYHVRRKILDNVSLPLVLELPVKRITSFSSLSESWSVDVDFTDLSENLAKKLKPSGTDEASCTKLVPYLLSSVVVHSGISSESGHYYSYARNITSTDSSYQMYHQSEALALASSQSHLLGRDSPSAVFEQDLENKEMSKEWFLFNDSRVTFTSFQSVQKITSRFPKDTAYVLLYKKQHSTNGLSGNNPTSGLWINGDPPLQKELMDAITKDNKLYLQEQELNARARALQAASASCSFRPNGFDDNDPPGSCGPTGGGGGGGFNTVGRLVF

SEQ ID NO: 94929 - protein, 347 aa, Homo sapiens
  Payload ID: 18932
  Gene Name: ubiquitin specific peptidase 38
  ENSP ID: ENSP00000424158
KTFVLGLLHQGYHSLDRKDVAILDYIHNGLKLIMSCPSVLDLFSLLQVEVLRMVCERPEPQLCARLSDLLTDFVQCIPKGKLSITFCQQLVRTIGHFQCVSTQERELREYVSQVTKVSNLLQNIWKAEPATLLPSLQEVFASISSTDASFEPSVALASLVQHIPLQMITVLIRSLTTDPNVKDASMTQALCRMIDWLSWPLAQHVDTWVIALLKGLAAVQKFTILIDVTLLKIELVFNRLWFPLVRPGALAVLSHMLLSFQHSPEAFHLIVPHVVNLVHSFKNDGLPSSTAFLVQLTELIHCMMYHYSGFPDLYEPILEAIKSCSVAQAEVQWHDHGSLQPLHLELK

SEQ ID NO: 94930 - protein, 1004 aa, Homo sapiens
  Payload ID: 18932
  Gene Name: ubiquitin specific peptidase 38
  Uniprot ID: Q8NB14
  ENSP ID: ENSP00000427647
MDKILEGLVSSSHPLPLKRVIVRKVVESAEHWLDEAQCEAMFDLTTRLILEGQDPFQRQVGHQVLEAYARYHRPEFESFFNKTFVLGLLHQGYHSLDRKDVAILDYIHNGLKLIMSCPSVLDLFSLLQVEVLRMVCERPEPQLCARLSDLLTDFVQCIPKGKLSITFCQQLVRTIGHFQCVSTQERELREYVSQVTKVSNLLQNIWKAEPATLLPSLQEVFASISSTDASFEPSVALASLVQHIPLQMITVLIRSLTTDPNVKDASMTQALCRMIDWLSWPLAQHVDTWVIALLKGLAAVQKFTILIDVTLLKIELVFNRLWFPLVRPGALAVLSHMLLSFQHSPEAFHLIVPHVVNLVHSFKNDGLPSSTAFLVQLTELIHCMMYHYSGFPDLYEPILEAIKDFPKPSEEKIKLILNQSAWTSQSNSLASCLSRLSGKSETGKTGLINLGNTCYMNSVIQALFMATDFRRQVLSLNLNGCNSLMKKLQHLFAFLAHTQREAYAPRIFFEASRPPWFTPRSQQDCSEYLRFLLDRLHEEEKILKVQASHKPSEILECSETSLQEVASKAAVLTETPRTSDGEKTLIEKMFGGKLRTHIRCLNCRSTSQKVEAFTDLSLAFCPSSSLENMSVQDPASSPSIQDGGLMQASVPGPSEEPVVYNPTTAAFICDSLVNEKTIGSPPNEFYCSENTSVPNESNKILVNKDVPQKPGGETTPSVTDLLNYFLAPEILTGDNQYYCENCASLQNAEKTMQITEEPEYLILTLLRFSYDQKYHVRRKILDNVSLPLVLELPVKRITSFSSLSESWSVDVDFTDLSENLAKKLKPSGTDEASCTKLVPYLLSSVVVHSGISSESGHYYSYARNITSTDSSYQMYHQSEALALASSQSHLLGRDSPSAVFEQDLENKEMSKEWFLFNDSRVTFTSFQSVQKITSRFPKDTAYVLLYKKQHSTNGLSGNNPTSGLWINGDPPLQKELMDAITKDNKLYLQVSWKYKLYLLKILNN

SEQ ID NO: 94931 - protein, 565 aa, Homo sapiens
  Payload ID: 18933
  Gene Name: ubiquitin specific peptidase 39
  Uniprot ID: Q53GS9
  ENSP ID: ENSP00000312981
MSGRSKRESRGSTRGKRESESRGSSGRVKRERDREREPEAASSRGSPVRVKREFEPASAREAPASVVPFVRVKREREVDEDSEPEREVRAKNGRVDSEDRRSRHCPYLDTINRSVLDFDFEKLCSISLSHINAYACLVCGKYFQGRGLKSHAYIHSVQFSHHVFLNLHTLKFYCLPDNYEIIDSSLEDITYVLKPTFTKQQIANLDKQAKLSRAYDGTTYLPGIVGLNNIKANDYANAVLQALSNVPPLRNYFLEEDNYKNIKRPPGDIMFLLVQRFGELMRKLWNPRNFKAHVSPHEMLQAVVLCSKKTFQITKQGDGVDFLSWFLNALHSALGGTKKKKKTIVTDVFQGSMRIFTKKLPHPDLPAEEKEQLLHNDEYQETMVESTFMYLTLDLPTAPLYKDEKEQLIIPQVPLFNILAKFNGITEKEYKTYKENFLKRFQLTKLPPYLIFCIKRFTKNNFFVEKNPTIVNFPITNVDLREYLSEEVQAVHKNTTYDLIANIVHDGKPSEGSYRIHVLHHGTGKWYELQDLQVTDILPQMITLSEAYIQIWKRRDNDETNQQGA

SEQ ID NO: 94932 - protein, 536 aa, Homo sapiens
  Payload ID: 18933
  Gene Name: ubiquitin specific peptidase 39
  ENSP ID: ENSP00000386572
MSGRSKRESRGSTRGKRESESRGSSGRVKRERDREREPEAASSRGSPVRVKREFEPASAREAPASVVPFVRVKREREVDEDSEPEREVRAKNGRVDSEDRRSRHCPYLDTINRSVLDFDFEKLCSISLSHINAYACLVCGKYFQGRGLKSHAYIHSVQFSHHVFLNLHTLKFYCLPDNYEIIDSSLEDITYVLKPTFTKQQIANLDKQAKLSRAYDGTTYLPGIVGLNNIKANDYANAVLQALSNVPPLRNYFLEEDNYKNIKRPPGDIMFLLVQRFGELMRKLWNPRNFKAHVSPHEMLQAVVLCSKKTFQITKQGDGVDFLSWFLNALHSALGGTKKKKKTIVTDVFQGSMRIFTKKLPHPDLPAEEKEQLLHNDEYQETMVESTFMYLTLDLPTAPLYKDEKEQLIIPQVPLFNILAKFNGITEKEYKTYKENFLKRFQLTKLPPYLIFCIKRFTKNNFFVEKNPTIVNFPITNVDLREYLSEEVQAVHKNTTYDLIANIVHDGKPSEGSYRIHVLHHIWKRRDNDETNQQGA

SEQ ID NO: 94933 - protein, 488 aa, Homo sapiens
  Payload ID: 18933
  Gene Name: ubiquitin specific peptidase 39
  Uniprot ID: Q53GS9
  ENSP ID: ENSP00000386803
MSGRSKRESRGSTRGKRESESRGSSGRVKRERDREREPEAASSRGSPVRVKREFEPASAREAPASVVPFVRVKREREVDEDSEPEREVRAKNGRVDSEDRRSRHCPYLDTINRSVLDFDFEKLCSISLSHINAYACLVCGKYFQGRGLKSHAYIHSVQFSHHVFLNLHTLKFYCLPDNYEIIDSSLEDITYVLKPTFTKQQIANLDKQAKLSRAYDGTTYLPGIVGLNNIKANDYANAVLQALSNVPPLRNYFLEEDNYKNIKRPPGDIMFLLVQRFGELMRKLWNPRNFKAHVSPHEMLQAVVLCSKKTFQITKQGDGVDFLSWFLNALHSALGGTKKKKKTIVTDVFQGSMRIFTKKLPHPDLPAEEKEQLLHNDEYQETMVESTFMYLTLDLPTAPLYKDEKEQLIIPQVPLFNILAKFNGITEKEYKTYKENFLKRFQLTKLPPYLIFCIKRFTKNNFFVEKNPTIVNFPITGQANGMNYKTSR

SEQ ID NO: 94934 - protein, 565 aa, Homo sapiens; identical to SEQ ID NO: 94931
  Payload ID: 18933
  Gene Name: ubiquitin specific peptidase 39
  Uniprot ID: Q53GS9
  ENSP ID: ENSP00000386864

SEQ ID NO: 94935 - protein, 113 aa, Homo sapiens
  Payload ID: 18933
  Gene Name: ubiquitin specific peptidase 39
  ENSP ID: ENSP00000392911
MLTAVPSHLFSAKNGRVDSEDRRSRHCPYLDTINSFSPFPTGRGLKSHAYIHSVQFSHHVFLNLHTLKFYCLPDNYEIIDSSLEDITYVLKPTFTKQQIANLDKQAKLSRAYD

SEQ ID NO: 94936 - protein, 462 aa, Homo sapiens
  Payload ID: 18933
  Gene Name: ubiquitin specific peptidase 39
  Uniprot ID: Q53GS9
  ENSP ID: ENSP00000396133
MLTAVPSHLFSAKNGRVDSEDRRSRHCPYLDTINSFSPFPTGRGLKSHAYIHSVQFSHHVFLNLHTLKFYCLPDNYEIIDSSLEDITYVLKPTFTKQQIANLDKQAKLSRAYDGTTYLPGIVGLNNIKANDYANAVLQALSNVPPLRNYFLEEDNYKNIKRPPGDIMFLLVQRFGELMRKLWNPRNFKAHVSPHEMLQAVVLCSKKTFQITKQGDGVDFLSWFLNALHSALGGTKKKKKTIVTDVFQGSMRIFTKKLPHPDLPAEEKEQLLHNDEYQETMVESTFMYLTLDLPTAPLYKDEKEQLIIPQVPLFNILAKFNGITEKEYKTYKENFLKRFQLTKLPPYLIFCIKRFTKNNFFVEKNPTIVNFPITNVDLREYLSEEVQAVHKNTTYDLIANIVHDGKPSEGSYRIHVLHHGTGKWYELQDLQVTDILPQMITLSEAYIQIWKRRDNDETNQQGA

SEQ ID NO: 94937 - protein, 129 aa, Homo sapiens
  Payload ID: 18933
  Gene Name: ubiquitin specific peptidase 39
  ENSP ID: ENSP00000396854
MLTAVPSHLFSAKNGRVDSEDRRSRHCPYLDTINRSVLDFDFEKLCSISLSHINAYACLVCGKYFQGRGLKSHAYIHSVQFSHHVFLNLHTLKFYCLPDNYEIIDSSLEDITYVLKPTFTKQQIANLDK

SEQ ID NO: 94938 - protein, 154 aa, Homo sapiens
  Payload ID: 18933
  Gene Name: ubiquitin specific peptidase 39
  ENSP ID: ENSP00000400690
MSGRSKRESRGSTRGKRESESRGSSGRVKRERDREREPEAASSRGSPVRVKREFEPASAREAPASVVPFVRVKREREVDEDSEPEREVRAKNGRVDSEDRRSRHCPYLDTINRSVLDFDFEKLCSISLSHINAYACLVCGKYFQAFHPSLQAGV

SEQ ID NO: 94939 - protein, 61 aa, Homo sapiens
  Payload ID: 18933
  Gene Name: ubiquitin specific peptidase 39
  ENSP ID: ENSP00000479885
YVLKPTFTKQQIANLDKQAKLSRAYDGTTYLPGIVGLNNIKANDYANAVLQEMALTFCLGF

SEQ ID NO: 94940 - protein, 487 aa, Homo sapiens
  Payload ID: 18933
  Gene Name: ubiquitin specific peptidase 39
  ENSP ID: ENSP00000484024
MLTAVPSHLFSAKNGRVDSEDRRSRHCPYLDTINRSVLDFDFEKLCSISLSHINAYACLVCGKYFQGRGLKSHAYIHSVQFSHHVFLNLHTLKFYCLPDNYEIIDSSLEDITYVLKPTFTKQQIANLDKQAKLSRAYDGTTYLPGIVGLNNIKANDYANAVLQALSNVPPLRNYFLEEDNYKNIKRPPGDIMFLLVQRFGELMRKLWNPRNFKAHVSPHEMLQAVVLCSKKTFQITKQGDGVDFLSWFLNALHSALGGTKKKKKTIVTDVFQGSMRIFTKKLPHPDLPAEEKEQLLHNDEYQETMVESTFMYLTLDLPTAPLYKDEKEQLIIPQVPLFNILAKFNGITEKEYKTYKENFLKRFQLTKLPPYLIFCIKRFTKNNFFVEKNPTIVNFPITNVDLREYLSEEVQAVHKNTTYDLIANIVHDGKPSEGSYRIHVLHHGTGKWYELQDLQVTDILPQMITLSEAYIQIWKRRDNDETNQQGA

SEQ ID NO: 94941 - protein, 963 aa, Homo sapiens
  Payload ID: 18934
  Gene Name: ubiquitin specific peptidase 4 (proto-oncogene)
  Uniprot ID: Q13107
  ENSP ID: ENSP00000265560
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSKSSTAPSRNFTTSPKSSASPYSSVSASLIANGDSTSTCGMHSSGVSRGGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVKKKPYLELKDANGRPDAVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLTLESLYQAVCDRISRYVKQPLPDEFGSSPLEPGACNGSRNSCEGEDEEEMEHQEEGKEQLSETEGSGEDEPGNDPSETTQKKIKGQPCPKRLFTFSLVNSYGTADINSLAADGKLLKLNSRSTLAMDWDSETRRLYYDEQESEAYEKHVSMLQPQKKKKTTVALRDCIELFTTMETLGEHDPWYCPNCKKHQQATKKFDLWSLPKILVVHLKRFSYNRYWRDKLDTVVEFPIRGLNMSEFVCNLSARPYVYDLIAVSNHYGAMGVGHYTAYAKNKLNGKWYYFDDSNVSLASEDQIVTKAAYVLFYQRRDDEFYKTPSLSSSGSSDGGTRPSSSQQGFGDDEACSMDTN

SEQ ID NO: 94942 - protein, 916 aa, Homo sapiens
  Payload ID: 18934
  Gene Name: ubiquitin specific peptidase 4 (proto-oncogene)
  Uniprot ID: Q13107
  ENSP ID: ENSP00000341028
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSNGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVKKKPYLELKDANGRPDAVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLTLESLYQAVCDRISRYVKQPLPDEFGSSPLEPGACNGSRNSCEGEDEEEMEHQEEGKEQLSETEGSGEDEPGNDPSETTQKKIKGQPCPKRLFTFSLVNSYGTADINSLAADGKLLKLNSRSTLAMDWDSETRRLYYDEQESEAYEKHVSMLQPQKKKKTTVALRDCIELFTTMETLGEHDPWYCPNCKKHQQATKKFDLWSLPKILVVHLKRFSYNRYWRDKLDTVVEFPIRGLNMSEFVCNLSARPYVYDLIAVSNHYGAMGVGHYTAYAKNKLNGKWYYFDDSNVSLASEDQIVTKAAYVLFYQRRDDEFYKTPSLSSSGSSDGGTRPSSSQQGFGDDEACSMDTN

SEQ ID NO: 94943 - protein, 621 aa, Homo sapiens
  Payload ID: 18934
  Gene Name: ubiquitin specific peptidase 4 (proto-oncogene)
  ENSP ID: ENSP00000399079
  MOD_RES (1)..(1): Any amino acid
XPKSSASPYSSVSASLIANGDSTSTCGMHSSGVSRGGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLTLESLYQAVCDRISRYVKQPLPDEFGSSPLEPGACNGSRNSCEGEDEEEMEHQEEGKEQLSETEGSGEDEPGNDPSETTQKKIKGQPCPKRLFTFSLVNSYGTADINSLAADGKLLKLNSRSTLAMDWDSETRRLYYDEQESEAYEKHVSMLQPQKKKKTTVALRDCIELFTTMETLGEHDPWYCPNCKKHQQATKKFDLWSLPKILVVHLKRFSYNRYWRDKLDTVVEFPIRGLNMSEFVCNLSARPYVYDLIAVSNHYGAMGVGHY

SEQ ID NO: 94944 - protein, 313 aa, Homo sapiens
  Payload ID: 18934
  Gene Name: ubiquitin specific peptidase 4 (proto-oncogene)
  Uniprot ID: Q13107
  ENSP ID: ENSP00000400623
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSKVSFFLPRLECNGAILAHCNFCLPGSSNSPASASRVAPSHLANFFFFEMESHSVTKLECGGAVSAYSRVQVMLLPQPPEWLG

SEQ ID NO: 94945 - protein, 363 aa, Homo sapiens
  Payload ID: 18934
  Gene Name: ubiquitin specific peptidase 4 (proto-oncogene)
  ENSP ID: ENSP00000408274
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSKGPQEMLTQQGMALQNYDNKLVKCIEELCQKQEELCWQIQQEEDKKQRLQNEVRQLTEKLACVNEKLARVNENLARKIASCSKFYQTIAETEATYLKMLESSQTLLSVLKREAGNLTKATASDQKSSGGRDS

SEQ ID NO: 94946 - protein, 1235 aa, Homo sapiens
  Payload ID: 18935
  Gene Name: ubiquitin specific peptidase 40
  Uniprot ID: Q9NVE5
  ENSP ID: ENSP00000251722
MFGDLFEEEYSTVSNNQYGKGKKLKTKALEPPAPREFTNLSGIRNQGGTCYLNSLLQTLHFTPEFREALFSLGPEELGLFEDKDKPDAKVRIIPLQLQRLFAQLLLLDQEAASTADLTDSFGWTSNEEMRQHDVQELNRILFSALETSLVGTSGHDLIYRLYHGTIVNQIVCKECKNVSERQEDFLDLTVAVKNVSGLEDALWNMYVEEEVFDCDNLYHCGTCDRLVKAAKSAKLRKLPPFLTVSLLRFNFDFVKCERYKETSCYTFPLRINLKPFCEQSELDDLEYIYDLFSVIIHKGGCYGGHYHVYIKDVDHLGNWQFQEEKSKPDVNLKDLQSEEEIDHPLMILKAILLEENNLIPVDQLGQKLLKKIGISWNKKYRKQHGPLRKFLQLHSQIFLLSSDESTVRLLKNSSLQAESDFQRNDQQIFKMLPPESPGLNNSISCPHWFDINDSKVQPIREKDIEQQFQGKESAYMLFYRKSQLQRPPEARANPRYGVPCHLLNEMDAANIELQTKRAECDSANNTFELHLHLGPQYHFFNGALHPVVSQTESVWDLTFDKRKTLGDLRQSIFQLLEFWEGDMVLSVAKLVPAGLHIYQSLGGDELTLCETEIADGEDIFVWNGVEVGGVHIQTGIDCEPLLLNVLHLDTSSDGEKCCQVIESPHVFPANAEVGTVLTALAIPAGVIFINSAGCPGGEGWTAIPKEDMRKTFREQGLRNGSSILIQDSHDDNSLLTKEEKWVTSMNEIDWLHVKNLCQLESEEKQVKISATVNTMVFDIRIKAIKELKLMKELADNSCLRPIDRNGKLLCPVPDSYTLKEAELKMGSSLGLCLGKAPSSSQLFLFFAMGSDVQPGTEMEIVVEETISVRDCLKLMLKKSGLQGDAWHLRKMDWCYEAGEPLCEEDATLKELLICSGDTLLLIEGQLPPLGFLKVPIWWYQLQGPSGHWESHQDQTNCTSSWGRVWRATSSQGASGNEPAQVSLLYLGDIEISEDATLAELKSQAMTLPPFLEFGVPSPAHLRAWTVERKRPGRLLRTDRQPLREYKLGRRIEICLEPLQKGENLGPQDVLLRTQVRIPGERTYAPALDLVWNAAQGGTAGSLRQRVADFYRLPVEKIEIAKYFPEKFEWLPISSWNQQITKRKKKKKQDYLQGAPYYLKDGDTIGVKNLLIDDDDDFSTIRDDTGKEKQKQRALGRRKSQEALHEQSSYILSSAETPARPRAPETSLSIHVGSFR

SEQ ID NO: 94947 - protein, 163 aa, Homo sapiens
  Payload ID: 18935
  Gene Name: ubiquitin specific peptidase 40
  Uniprot ID: Q9NVE5
  ENSP ID: ENSP00000386664
MGSSLGLCLGKAPSSSQLFLFFAMGSDVQPGTEMEIVVEETISVRDCLKLMLKKSGLQGDAWHLRKMDWCYEAGEPLCEEDATLKELLICSGDTLLLIEGQLPPLGFLKVPIWWYQLQGPSGHWESHQDQTNCTSSWGRVWRATSSQGENRMGFQQPVHHKEK

SEQ ID NO: 94948 - protein, 1235 aa, Homo sapiens; identical to SEQ ID NO: 94946
  Payload ID: 18935
  Gene Name: ubiquitin specific peptidase 40
  Uniprot ID: Q9NVE5
  ENSP ID: ENSP00000387898

SEQ ID NO: 94949 - protein, 246 aa, Homo sapiens
  Payload ID: 18935
  Gene Name: ubiquitin specific peptidase 40
  ENSP ID: ENSP00000388121
  MOD_RES (1)..(1): Any amino acid
XGSSLGLCLGKAPSSSQLFLFFAMGSDVQPGTEMEIVVEETISVRDCLKLMLKKSGLQGDAWHLRKMDWCYEAGEPLCEEDATLKELLICSGDTLLLIEGQLPPLGFLKVPIWWYQLQGPSGHWESHQDQTNCTSSWGRVWRATSSQGASGNEPAQVSLLYLGDIEISEDATLAELKSQAMTLPPFLEFGVPSPAHLRAWTVERKRPGRLLRTDRQPLREYKLGRRIEICLEPLQKGENLGCILTP

SEQ ID NO: 94950 - protein, 116 aa, Homo sapiens
  Payload ID: 18935
  Gene Name: ubiquitin specific peptidase 40
  ENSP ID: ENSP00000394133
  MOD_RES (1)..(1): Any amino acid
XEFGVPSPAHLRAWTVERKRPGRLLRTDRQPLSPQDVLLRTQVRIPGERTYAPALDLVWNAAQGGTAGSLRQRVADFYRLPVEKIEIAKYFPEKFEWLPISSWNQQITKRKKKKKQ

SEQ ID NO: 94951 - protein, 98 aa, Homo sapiens
  Payload ID: 18935
  Gene Name: ubiquitin specific peptidase 40
  ENSP ID: ENSP00000394154
MFGDLFEEEYSTVSNNQYGKGKKLKTKALEPPAPREFTNLSGIRNQGGTCYLNSLLQTLHFTPEFREALFSLGPEELGLFEDKDKPDAKKVTWPIPYG

SEQ ID NO: 94952 - protein, 97 aa, Homo sapiens
  Payload ID: 18935
  Gene Name: ubiquitin specific peptidase 40
  ENSP ID: ENSP00000407696
  MOD_RES (1)..(1): Any amino acid
XTNCTSSWGRVWRATSSQGASGNEPAQVSLLYLGDIEISEDATLAELKSQSVLIWHLSYAMFSGHDLASFPGVRCPVPSPPQSLDGGEEAPRQAFTN

SEQ ID NO: 94953 - protein, 98 aa, Homo sapiens
  Payload ID: 18935
  Gene Name: ubiquitin specific peptidase 40
  ENSP ID: ENSP00000408853
EDMRKTFREQGLRNGSSILIQDSHDDNSLLTKEEKWVTSMNEIDWLHVKNLCQLESEEKQVKISATVNTMVFDIRIKAIKELKLMKELGNHLHFLFGS

SEQ ID NO: 94954 - protein, 1247 aa, Homo sapiens
  Payload ID: 18935
  Gene Name: ubiquitin specific peptidase 40
  Uniprot ID: Q9NVE5
  ENSP ID: ENSP00000415434
MSLFLRVVFSFTMFGDLFEEEYSTVSNNQYGKGKKLKTKALEPPAPREFTNLSGIRNQGGTCYLNSLLQTLHFTPEFREALFSLGPEELGLFEDKDKPDAKVRIIPLQLQRLFAQLLLLDQEAASTADLTDSFGWTSNEEMRQHDVQELNRILFSALETSLVGTSGHDLIYRLYHGTIVNQIVCKECKNVSERQEDFLDLTVAVKNVSGLEDALWNMYVEEEVFDCDNLYHCGTCDRLVKAAKSAKLRKLPPFLTVSLLRFNFDFVKCERYKETSCYTFPLRINLKPFCEQSELDDLEYIYDLFSVIIHKGGCYGGHYHVYIKDVDHLGNWQFQEEKSKPDVNLKDLQSEEEIDHPLMILKAILLEENNLIPVDQLGQKLLKKIGISWNKKYRKQHGPLRKFLQLHSQIFLLSSDESTVRLLKNSSLQAESDFQRNDQQIFKMLPPESPGLNNSISCPHWFDINDSKVQPIREKDIEQQFQGKESAYMLFYRKSQLQRPPEARANPRYGVPCHLLNEMDAANIELQTKRAECDSANNTFELHLHLGPQYHFFNGALHPVVSQTESVWDLTFDKRKTLGDLRQSIFQLLEFWEGDMVLSVAKLVPAGLHIYQSLGGDELTLCETEIADGEDIFVWNGVEVGGVHIQTGIDCEPLLLNVLHLDTSSDGEKCCQVIESPHVFPANAEVGTVLTALAIPAGVIFINSAGCPGGEGWTAIPKEDMRKTFREQGLRNGSSILIQDSHDDNSLLTKEEKWVTSMNEIDWLHVKNLCQLESEEKQVKISATVNTMVFDIRIKAIKELKLMKELADNSCLRPIDRNGKLLCPVPDSYTLKEAELKMGSSLGLCLGKAPSSSQLFLFFAMGSDVQPGTEMEIVVEETISVRDCLKLMLKKSGLQGDAWHLRKMDWCYEAGEPLCEEDATLKELLICSGDTLLLIEGQLPPLGFLKVPIWWYQLQGPSGHWESHQDQTNCTSSWGRVWRATSSQGASGNEPAQVSLLYLGDIEISEDATLAELKSQAMTLPPFLEFGVPSPAHLRAWTVERKRPGRLLRTDRQPLREYKLGRRIEICLEPLQKGENLGPQDVLLRTQVRIPGERTYAPALDLVWNAAQGGTAGSLRQRVADFYRLPVEKIEIAKYFPEKFEWLPISSWNQQITKRKKKKKQDYLQGAPYYLKDGDTIGVKNLLIDDDDDFSTIRDDTGKEKQKQRALGRRKSQEALHEQSSYILSSAETPARPRAPETSLSIHVGSFR

SEQ ID NO: 94955 - protein, 306 aa, Homo sapiens
  Payload ID: 18936
  Gene Name: ubiquitin specific peptidase 41
  ENSP ID: ENSP00000292729
  MOD_RES (1)..(1): Any amino acid
XLVGLHNIGQTCCLNSLIQVFVMNVDFARILKRITVPRGADEQRRSVPFQMLLLLEKMQDSRQKAVWPLELAYCLQKYNVPLFVQHDAAQLYLKLWNLIKDQIADVHLVERLQALYMIRMKDSLICLDCAMESSRNSSMLTLRLSFFDVDSKPLKTLEDALHCFFQPRELSSKSKCFCENCGKKTRGKQVLKLTHLPQTLTIHLMRFSIRNSQTRKICHSLYFPQSLDFSQILPMKRESCDAEEQSGGQYELFAVIAHVGMADSGHYCVYIRNAVDGKWFCFNDSNICLVSWEDIQCTYGNPNYHW

SEQ ID NO: 94956 - protein, 358 aa, Homo sapiens
  Payload ID: 18936
  Gene Name: ubiquitin specific peptidase 41
  Uniprot ID: Q3LFD5
  ENSP ID: ENSP00000414922
MDGVLFRAHQCQYVHPCVHVYVTVGLMDPLCRRKSKSRKQNKLQPNLRICPWSLVGLHNIGQTCCLNSLIQVFVMNVDFARILKRITVPRGADEQRRSVPFQMLLLLEKMQDSRQKAVWPLELAYCLQKYNVPLFVQHDAAQLYLKLWNLIKDQIADVHLVERLQALYMIRMKDSLICLDCAMESSRNSSMLTLRLSFFDVDSKPLKTLEDALHCFFQPRELSSKSKCFCENCGKKTRGKQVLKLTHLPQTLTIHLMRFSIRNSQTRKICHSLYFPQSLDFSQILPMKRESCDAEEQSGGQYELFAVIAHVGMADSGHYCVYIRNAVDGKWFCFNDSNICLVSWEDIQCTYGNPNYHW

SEQ ID NO: 94957 - protein, 1316 aa, Homo sapiens
  Payload ID: 18937
  Gene Name: ubiquitin specific peptidase 42
  Uniprot ID: Q9H9J4
  ENSP ID: ENSP00000301962
MTIVDKASESSDPSAYQNQPGSSEAVSPGDMDAGSASWGAVSSLNDVSNHTLSLGPVPGAVVYSSSSVPDKSKPSPQKDQALGDGIAPPQKVLFPSEKICLKWQQTHRVGAGLQNLGNTCFANAALQCLTYTPPLANYMLSHEHSKTCHAEGFCMMCTMQAHITQALSNPGDVIKPMFVINEMRRIARHFRFGNQEDAHEFLQYTVDAMQKACLNGSNKLDRHTQATTLVCQIFGGYLRSRVKCLNCKGVSDTFDPYLDITLEIKAAQSVNKALEQFVKPEQLDGENSYKCSKCKKMVPASKRFTIHRSSNVLTLSLKRFANFTGGKIAKDVKYPEYLDIRPYMSQPNGEPIVYVLYAVLVHTGFNCHAGHYFCYIKASNGLWYQMNDSIVSTSDIRSVLSQQAYVLFYIRSHDVKNGGELTHPTHSPGQSSPRPVISQRVVTNKQAAPGFIGPQLPSHMIKNPPHLNGTGPLKDTPSSSMSSPNGNSSVNRASPVNASASVQNWSVNRSSVIPEHPKKQKITISIHNKLPVRQCQSQPNLHSNSLENPTKPVPSSTITNSAVQSTSNASTMSVSSKVTKPIPRSESCSQPVMNGKSKLNSSVLVPYGAESSEDSDEESKGLGKENGIGTIVSSHSPGQDAEDEEATPHELQEPMTLNGANSADSDSDPKENGLAPDGASCQGQPALHSENPFAKANGLPGKLMPAPLLSLPEDKILETFRLSNKLKGSTDEMSAPGAERGPPEDRDAEPQPGSPAAESLEEPDAAAGLSSTKKAPPPRDPGTPATKEGAWEAMAVAPEEPPPSAGEDIVGDTAPPDLCDPGSLTGDASPLSQDAKGMIAEGPRDSALAEAPEGLSPAPPARSEEPCEQPLLVHPSGDHARDAQDPSQSLGAPEAAERPPAPVLDMAPAGHPEGDAEPSPGERVEDAAAPKAPGPSPAKEKIGSLRKVDRGHYRSRRERSSSGEPARESRSKTEGHRHRRRRTCPRERDRQDRHAPEHHPGHGDRLSPGERRSLGRCSHHHSRHRSGVELDWVRHHYTEGERGWGREKFYPDRPRWDRCRYYHDRYALYAARDWKPFHGGREHERAGLHERPHKDHNRGRRGCEPARERERHRPSSPRAGAPHALAPHPDRFSHDRTALVAGDNCNLSDRFHEHENGKSRKRRHDSVENSDSHVEKKARRSEQKDPLEEPKAKKHKKSKKKKKSKDKHRDRDSRHQQDSDLSAACSDADLHRHKKKKKKKKRHSRKSEDFVKDSELHLPRVTSLETVAQFRRAQGGFPLSGGPPLEGVGPFREKTKHLRMESRDDRCRLFEYGQGD

SEQ ID NO: 94958 - protein, 174 aa, Homo sapiens
  Payload ID: 18937
  Gene Name: ubiquitin specific peptidase 42
  ENSP ID: ENSP00000385964
MTIVDKASESSDPSAYQNQPGSSEAVSPGDMDAGSASWGAVSSLNDVSNHTLSLGPVPGAVVYSSSSVPDKSKPSPQKDQALGDGIAPPQKVLFPSEKICLKWQQTHRVGAGLQNLGNTCFANAALQCLTYTPPLANYMLSHEHSKTFHNSFPTDSFPITFALNESRVWMKTQH

SEQ ID NO: 94959 - protein, 1043 aa, Homo sapiens
  Payload ID: 18937
  Gene Name: ubiquitin specific peptidase 42
  ENSP ID: ENSP00000408217
MMCTMQAHITQALSNPGDVIKPMFVINEMRRIARHFRFGNQEDAHEFLQYTVDAMQKACLNGSNKLDRHTQATTLVCQIFGGYLRSRVKCLNCKGVSDTFDPYLDITLEIKAAQSVNKALEQFVKPEQLDGENSYKCSKCKKMVPASKRFTIHRSSNVLTLSLKRFANFTGGKIAKDVKYPEYLDIRPYMSQPNGEPIVYVLYAVLVHTGFNCHAGHYFCYIKASNGLWYQMNDSIVSTSDIRSVLSQQAYVLFYIRSHDVKNGGELTHPTHSPGQSSPRPVISQRVVTNKQAAPGFIGPQLPSHMIKNPPHLNGTGPLKDTPSSSMSSPNGNSSVNRASPVNASASVQNWSVNRSSVIPEHPKKQKITISIHNKLPVRQCQSQPNLHSNSLENPTKPVPSSTITNSAVQSTSNASTMSVSSKVTKPIPRSESCSQPVMNGKSKLNSSVLVPYGAESSEDSDEESKGLGKENGIGTIVSSHSPGQDAEDEEATPHELQEPMTLNGANSADSDSDPKENGLAPDGASCQGQPALHSENPFAKANGLPGKLMPAPLLSLPEDKILETFRLSNKLKGSTDEMSAPGAERGPPEDRDAEPQPGSPAAESLEEPDAAAGLSSTKKAPPPRDPGTPATKEGAWEAMAVAPEEPPPSAGEDIVGDTAPPDLCDPGSLTGDASPLSQDAKGMIAEGPRDSALAEAPEGLSPAPPARSEEPCEQPLLVHPSGDHARDAQDPSQSLGAPEAAERPPAPVLDMAPAGHPEGDAEPSPGERVEDAAAPKAPGPSPAKEKIGSLRKVDRGHYRSRRERSSSGEPARESRSKTEGHRHRRRRTCPRERDRQDRHAPEHHPGHGDRLSPGERRSLGRCSHHHSRHRSGVELDWVRHHYTEGERGWGREKFYPDRPRWDRCRYYHDRYALYAARDWKPFHGGREHERAGLHERPHKDHNRGRRGCEPARERERHRPSSPRAGAPHALAPHPDRFSHDRTALVAGDNCNLSDRFHEHENGKSRKRRHDSVENSDSHVEKKARRSEQKDPLEEPKAKKHKK

SEQ ID NO: 94960 - protein, 98 aa, Homo sapiens
  Payload ID: 18937
  Gene Name: ubiquitin specific peptidase 42
  ENSP ID: ENSP00000416910
MTIVDKASESSDPSAYQNQPGSSEAVSPGDMDAGSASWGAVSSLNDVSNHTLSLGPVPGAVVYSSSSVPDKSKPSPQKDQVETGVHHVSQDGLDLLTS

SEQ ID NO: 94961 - protein, 475 aa, Homo sapiens
  Payload ID: 18937
  Gene Name: ubiquitin specific peptidase 42
  ENSP ID: ENSP00000430568
MTIVDKASESSDPSAYQNQPGSSEAVSPGDMDAGSASWGAVSSLNDVSNHTLSLGPVPGAVVYSSSSVPDKSKPSPQKDQGHAEGFCMMCTMQAHITQALSNPGDVIKPMFVINEMRRIARHFRFGNQEDAHEFLQYTVDAMQKACLNGSNKLDRHTQATTLVCQIFGGYLRSRVKCLNCKGVSDTFDPYLDITLEIKAAQSVNKALEQFVKPEQLDGENSYKCSKCKKMVPASKRFTIHRSSNVLTLSLKRFANFTGGKIAKDVKYPEYLDIRPYMSQPNGEPIVYVLYAVLVHTGFNCHAGHYFCYIKASNGLWYQMNDSIVSTSDIRSVLSQQAYVLFYIRSHDVKNGGELTHPTHSPGQSSPRPVISQRVVTNKQAAPGFIGPQLPSHMIKNPPHLNGTGPLKDTPSSSMSSPNGNSSVNRASPVNASASVQNWSVNRSSVIPEHPKKQKITISIHNKLPVRQCQSQPNLH

SEQ ID NO: 94962 - protein, 219 aa, Homo sapiens
  Payload ID: 18937
  Gene Name: ubiquitin specific peptidase 42
  ENSP ID: ENSP00000431127
MTIVDKASESSDPSAYQNQPGSSEAVSPGDMDAGSASWGAVSSLNDVSNHTLSLGPVPGAVVYSSSSVPDKSKPSPQKDQALGDGIAPPQKVLFPSEKICLKWQQTHRVGAGLQNLGNTCFANAALQCLTYTPPLANYMLSHEHSKTCHAEGFCMMCTMQAHITQALSNPGDVIKPMFVINEMRRIARHFRFGNQEDAHEFLQYTVDAMQKACLNGSNK

SEQ ID NO: 94963 - protein, 1123 aa, Homo sapiens
  Payload ID: 18938
  Gene Name: ubiquitin specific peptidase 43
  Uniprot ID: Q70EL4
  ENSP ID: ENSP00000285199
MDLGPGDAAGGGPLAPRPRRRRSLRRLFSRFLLALGSRSRPGDSPPRPQPGHCDGDGEGGFACAPGPVPAAPGSPGEERPPGPQPQLQLPAGDGARPPGAQGLKNHGNTCFMNAVVQCLSNTDLLAEFLALGRYRAAPGRAEVTEQLAALVRALWTREYTPQLSAEFKNAVSKYGSQFQGNSQHDALEFLLWLLDRVHEDLEGSSRGPVSEKLPPEATKTSENCLSPSAQLPLGQSFVQSHFQAQYRSSLTCPHCLKQSNTFDPFLCVSLPIPLRQTRFLSVTLVFPSKSQRFLRVGLAVPILSTVAALRKMVAEEGGVPADEVILVELYPSGFQRSFFDEEDLNTIAEGDNVYAFQVPPSPSQGTLSAHPLGLSASPRLAAREGQRFSLSLHSESKVLILFCNLVGSGQQASRFGPPFLIREDRAVSWAQLQQSILSKVRHLMKSEAPVQNLGSLFSIRVVGLSVACSYLSPKDSRPLCHWAVDRVLHLRRPGGPPHVKLAVEWDSSVKERLFGSLQEERAQDADSVWQQQQAHQQHSCTLDECFQFYTKEEQLAQDDAWKCPHCQVLQQGMVKLSLWTLPDILIIHLKRFCQVGERRNKLSTLVKFPLSGLNMAPHVAQRSTSPEAGLGPWPSWKQPDCLPTSYPLDFLYDLYAVCNHHGNLQGGHYTAYCRNSLDGQWYSYDDSTVEPLREDEVNTRGAYILFYQKRNSIPPWSASSSMRGSTSSSLSDHWLLRLGSHAGSTRGSLLSWSSAPCPSLPQVPDSPIFTNSLCNQEKGGLEPRRLVRGVKGRSISMKAPTTSRAKQGPFKTMPLRWSFGSKEKPPGASVELVEYLESRRRPRSTSQSIVSLLTGTAGEDEKSASPRSNVALPANSEDGGRAIERGPAGVPCPSAQPNHCLAPGNSDGPNTARKLKENAGQDIKLPRKFDLPLTVMPSVEHEKPARPEGQKAMNWKESFQMGSKSSPPSPYMGFSGNSKDSRRGTSELDRPLQGTLTLLRSVFRKKENRRNERAEVSPQVPPVSLVSGGLSPAMDGQAPGSPPALRIPEGLARGLGSRLERDVWSAPSSLRLPRKASRAPRGSALGMSQRTVPGEQASYGTFQRVKYHTLSLGRKKTLPESSF

SEQ ID NO: 94964 - protein, 1118 aa, Homo sapiens
  Payload ID: 18938
  Gene Name: ubiquitin specific peptidase 43
  Uniprot ID: Q70EL4
  ENSP ID: ENSP00000458963
MDLGPGDAAGGGPLAPRPRRRRSLRRLFSRFLLALGSRSRPGDSPPRPQPGHCDGDGEGGFACAPGPVPAAPGSPGEERPPGPQPQLQLPAGDGARPPGAQGLKNHGNTCFMNAVVQCLSNTDLLAEFLALGRYRAAPGRAEVTEQLAALVRALWTREYTPQLSAEFKNAVSKYGSQFQGNSQHDALEFLLWLLDRVHEDLEGSSRGPVSEKLPPEATKTSENCLSPSAQLPLGQSFVQSHFQAQYRSSLTCPHCLKQSNTFDPFLCVSLPIPLRQTRFLSVTLVFPSKSQRFLRVGLAVPILSTVAALRKMVAEEGGVPADEVILVELYPSGFQRSFFDEEDLNTIAEGDNVYAFQVPPSPSQGTLSAHPLGLSASPRLAAREGQRFSLSLHSESKVLILFCNLVGSGQQASRFGPPFLIREDRAVSWAQLQQSILSKVRHLMKSEAPVQNLGSLFSIRVVGLSVACSYLSPKDSRPLCHWAVDRVLHLRRPGGPPHVKLAVEWDSSVKERLFGSLQEERAQDADSVWQQQQAHQQHSCTLDECFQFYTKEEQLAQDDAWKCPHCQVLQQGMVKLSLWTLPDILIIHLKRFCQVGERRNKLSTLVKFPLSGLNMAPHVAQRSTSPEAGLGPWPSWKQPDCLPTSYPLDFLYDLYAVCNHHGNLQAYCRNSLDGQWYSYDDSTVEPLREDEVNTRGAYILFYQKRNSIPPWSASSSMRGSTSSSLSDHWLLRLGSHAGSTRGSLLSWSSAPCPSLPQVPDSPIFTNSLCNQEKGGLEPRRLVRGVKGRSISMKAPTTSRAKQGPFKTMPLRWSFGSKEKPPGASVELVEYLESRRRPRSTSQSIVSLLTGTAGEDEKSASPRSNVALPANSEDGGRAIERGPAGVPCPSAQPNHCLAPGNSDGPNTARKLKENAGQDIKLPRKFDLPLTVMPSVEHEKPARPEGQKAMNWKESFQMGSKSSPPSPYMGFSGNSKDSRRGTSELDRPLQGTLTLLRSVFRKKENRRNERAEVSPQVPPVSLVSGGLSPAMDGQAPGSPPALRIPEGLARGLGSRLERDVWSAPSSLRLPRKASRAPRGSALGMSQRTVPGEQASYGTFQRVKYHTLSLGRKKTLPESSF

SEQ ID NO: 94965 - protein, 910 aa, Homo sapiens
  Payload ID: 18938
  Gene Name: ubiquitin specific peptidase 43
  ENSP ID: ENSP00000459328
  MOD_RES (1)..(1): Any amino acid
XAIPSTTPWNSCSGCWIVYMRTWRVHPEGRCRRRSSLTCPHCLKQSNTFDPFLCVSLPIPLRQTRFLSVTLVFPSKSQRFLRVGLAVPILSTVAALRKMVAEEGGVPADEVILVELYPSGFQRSFFDEEDLNTIAEGDNVYAFQVPPSPSQGTLSAHPLGLSASPRLAAREGQRFSLSLHSESKVLILFCNLVGSGQQASRFGPPFLIREDRAVSWAQLQQSILSKVRHLMKSEAPVQNLGSLFSIRVVGLSVACSYLSPKDSRPLCHWAVDRVLHLRRPGGPPHVKLAVEWDSSVKERLFGSLQEERAQDADSVWQQQQAHQQHSCTLDECFQFYTKEEQLAQDDAWKCPHCQVLQQGMVKLSLWTLPDILIIHLKRFCQVGERRNKLSTLVKFPLSGLNMAPHVAQRSTSPEAGLGPWPSWKQPDCLPTSYPLDFLYDLYAVCNHHGNLQGGHYTAYCRNSLDGQWYSYDDSTVEPLREDEVNTRGAYILFYQKRNSIPPWSASSSMRGSTSSSLSDHWLLRLGSHAGSTRGSLLSWSSAPCPSLPQVPDSPIFTNSLCNQEKGGLEPRRLVRGVKGRSISMKAPTTSRAKQGPFKTMPLRWSFGSKEKPPGASVELVEYLESRRRPRSTSQSIVSLLTGTAGEDEKSASPRSNVALPANSEDGGRAIERGPAGVPCPSAQPNHCLAPGNSDGPNTARKLKENAGQDIKLPRKFDLPLTVMPSVEHEKPARPEGQKAMNWKESFQMGSKSSPPSPYMGFSGNSKDSRRGTSELDRPLQGTLTLLRSVFRKKENRRNERAEVSPQVPPVSLVSGGLSPAMDGQAPGSPPALRIPEGLARGLGSRLERDVWSAPSSLRLPRKASRAPRGSALGMSQRTVPGEQASYGTFQRVKYHTLSLGRKKTLPESSF

SEQ ID NO: 94966 - protein, 648 aa, Homo sapiens
  Payload ID: 18938
  Gene Name: ubiquitin specific peptidase 43
  ENSP ID: ENSP00000477318
AACSGASRRSERRMPTVCGSSSRRISSTAVPWMNVFSSTPRRSRSRPGGPCPGREGGWLPLVGWPRAAGASQSGWFAFQLAQDDAWKCPHCQVLQQGMVKLSLWTLPDILIIHLKRFCQVGERRNKLSTLVKFPLSGLNMAPHVAQRSTSPEAGLGPWPSWKQPDCLPTSYPLDFLYDLYAVCNHHGNLQGGHYTAYCRNSLDGQWYSYDDSTVEPLREDEVNTRGAYILFYQKRNSIPPWSASSSMRGSTSSSLSDHWLLRLGSHAGSTRGSLLSWSSAPCPSLPQVPDSPIFTNSLCNQEKGGLEPRRLVRGVKGRSISMKAPTTSRAKQGPFKTMPLRWSFGSKEKPPGASVELVEYLESRRRPRSTSQSIVSLLTGTAGEDEKSASPRSNVALPANSEDGGRAIERGPAGVPCPSAQPNHCLAPGNSDGPNTARKLKENAGQDIKLPRKFDLPLTVMPSVEHEKPARPEGQKAMNWKESFQMGSKSSPPSPYMGFSGNSKDSRRGTSELDRPLQGTLTLLRSVFRKKENRRNERAEVSPQVPPVSLVSGGLSPAMDGQAPGSPPALRIPEGLARGLGSRLERDVWSAPSSLRLPRKASRAPRGSALGMSQRTVPGEQASYGTFQRVKYHTLSLGRKKTLPESSF

SEQ ID NO: 94967 - protein, 712 aa, Homo sapiens
  Payload ID: 18939
  Gene Name: ubiquitin specific peptidase 44
  Uniprot ID: Q9H0E7
  ENSP ID: ENSP00000258499
MLAMDTCKHVGQLQLAQDHSSLNPQKWHCVDCNTTESIWACLSCSHVACGRYIEEHALKHFQESSHPVALEVNEMYVFCYLCDDYVLNDNTTGDLKLLRRTLSAIKSQNYHCTTRSGRFLRSMGTGDDSYFLHDGAQSLLQSEDQLYTALWHRRRILMGKIFRTWFEQSPIGRKKQEEPFQEKIVVKREVKKRRQELEYQVKAELESMPPRKSLRLQGLAQSTIIEIVSVQVPAQTPASPAKDKVLSTSENEISQKVSDSSVKRRPIVTPGVTGLRNLGNTCYMNSVLQVLSHLLIFRQCFLKLDLNQWLAMTASEKTRSCKHPPVTDTVVYQMNECQEKDTGFVCSRQSSLSSGLSGGASKGRKMELIQPKEPTSQYISLCHELHTLFQVMWSGKWALVSPFAMLHSVWRLIPAFRGYAQQDAQEFLCELLDKIQRELETTGTSLPALIPTSQRKLIKQVLNVVNNIFHGQLLSQVTCLACDNKSNTIEPFWDLSLEFPERYQCSGKDIASQPCLVTEMLAKFTETEALEGKIYVCDQCNSKRRRFSSKPVVLTEAQKQLMICHLPQVLRLHLKRFRWSGRNNREKIGVHVGFEEILNMEPYCCRETLKSLRPECFIYDLSAVVMHHGKGFGSGHYTAYCYNSEGGFWVHCNDSKLSMCTMDEVCKAQAYILFYTQRVTENGHSKLLPPELLLGSQHPNEDADTSSNEILS

SEQ ID NO: 94968 - protein, 712 aa, Homo sapiens; identical to SEQ ID NO: 94967
  Payload ID: 18939
  Gene Name: ubiquitin specific peptidase 44
  Uniprot ID: Q9H0E7
  ENSP ID: ENSP00000376806

SEQ ID NO: 94969 - protein, 712 aa, Homo sapiens; identical to SEQ ID NO: 94967
  Payload ID: 18939
  Gene Name: ubiquitin specific peptidase 44
  Uniprot ID: Q9H0E7
  ENSP ID: ENSP00000442629

SEQ ID NO: 94970 - protein, 164 aa, Homo sapiens
  Payload ID: 18939
  Gene Name: ubiquitin specific peptidase 44
  ENSP ID: ENSP00000448601
MLAMDTCKHVGQLQLAQDHSSLNPQKWHCVDCNTTESIWACLSCSHVACGRYIEEHALKHFQESSHPVALEVNEMYVFCYLCDDYVLNDNTTGDLKLLRRTLSAIKSQNYHCTTRSGRFLRSMGTGDDSYFLHDGAQSLLQSEDQLYTALWHRRRILMGKIFRT

SEQ ID NO: 94971 - protein, 496 aa, Homo sapiens
  Payload ID: 18939
  Gene Name: ubiquitin specific peptidase 44
  ENSP ID: ENSP00000448670
MLAMDTCKHVGQLQLAQDHSSLNPQKWHCVDCNTTESIWACLSCSHVACGRYIEEHALKHFQESSHPVALEVNEMYVFCYLCDDYVLNDNTTGDLKLLRRTLSAIKSQNYHCTTRSGRFLRSMGTGDDSYFLHDGAQSLLQSEDQLYTALWHRRRILMGKIFRTWFEQSPIGRKKQEEPFQEKIVVKREVKKRRQELEYQVKAELESMPPRKSLRLQGLAQSTIIEIVSVQVPAQTPASPAKDKVLSTSENEISQKVSDSSVKRRPIVTPGVTGLRNLGNTCYMNSVLQVLSHLLIFRQCFLKLDLNQWLAMTASEKTRSCKHPPVTDTVVYQMNECQEKDTGFVCSRQSSLSSGLSGGASKGRKMELIQPKEPTSQYISLCHELHTLFQVMWSGKWALVSPFAMLHSVWRLIPAFRGYAQQDAQEFLCELLDKIQRELETTGTSLPALIPTSQRKLIKQVLNVVNNIFHGQLLSQQSVEGFPPNQLYSQKPRNNL

SEQ ID NO: 94972 - protein, 111 aa, Homo sapiens
  Payload ID: 18939
  Gene Name: ubiquitin specific peptidase 44
  ENSP ID: ENSP00000449635
MLAMDTCKHVGQLQLAQDHSSLNPQKWHCVDCNTTESIWACLSCSHVACGRYIEEHALKHFQESSHPVALEVNEMYVFCYLCDDYVLNDNTTGDLKLLRRTLSAIKSQNYH

SEQ ID NO: 94973 - protein, 289 aa, Homo sapiens
  Payload ID: 18940
  Gene Name: ubiquitin specific peptidase 45
  ENSP ID: ENSP00000330540
MRVKDPTKALPEKAKRSKRPTVPHDEDSSDDIAVGLTCQHVSHAISVNHVKRAIAENLWSVCSECLKERRFYDGQLVLTSDIWLCLKCGFQGCGKNSESQHSLKHFKSSRTEPHCIIINLSTWIIWCYECDEKLSTHCNKKVLAQIVDFLQKHASKTQTSAFSRIMKLCEEKCETDEIQKGGKCRNLSVRGITNLGNTCFFNAVMQNLAQTYTLTDLMNEIKESSTKLKIFPSSDSQLDPLVVELSRPGPLTSALFLFLHSMKETEKGPLSPKVLFNQLCQKWVHLHLI

SEQ ID NO: 94974 - protein, 814 aa, Homo sapiens
  Payload ID: 18940
  Gene Name: ubiquitin specific peptidase 45
  Uniprot ID: Q70EL2
  ENSP ID: ENSP00000333376
MRVKDPTKALPEKAKRSKRPTVPHDEDSSDDIAVGLTCQHVSHAISVNHVKRAIAENLWSVCSECLKERRFYDGQLVLTSDIWLCLKCGFQGCGKNSESQHSLKHFKSSRTEPHCIIINLSTWIIWCYECDEKLSTHCNKKVLAQIVDFLQKHASKTQTSAFSRIMKLCEEKCETDEIQKGGKCRNLSVRGITNLGNTCFFNAVMQNLAQTYTLTDLMNEIKESSTKLKIFPSSDSQLDPLVVELSRPGPLTSALFLFLHSMKETEKGPLSPKVLFNQLCQKAPRFKDFQQQDSQELLHYLLDAVRTEETKRIQASILKAFNNPTTKTADDETRKKVKAYGKEGVKMNFIDRIFIGELTSTVMCEECANISTVKDPFIDISLPIIEERVSKPLLWGRMNKYRSLRETDHDRYSGNVTIENIHQPRAAKKHSSSKDKSQLIHDRKCIRKLSSGETVTYQKNENLEMNGDSLMFASLMNSESRLNESPTDDSEKEASHSESNVDADSEPSESESASKQTGLFRSSSGSGVQPDGPLYPLSAGKLLYTKETDSGDKEMAEAISELRLSSTVTGDQDFDRENQPLNISNNLCFLEGKHLRSYSPQNAFQTLSQSYITTSKECSIQSCLYQFTSMELLMGNNKLLCENCTKNKQKYQEETSFAEKKVEGVYTNARKQLLISAVPAVLILHLKRFHQAGLSLRKVNRHVDFPLMLDLAPFCSATCKNASVGDKVLYGLYGIVEHSGSMREGHYTAYVKVRTPSRKLSEHNTKKKNVPGLKAADNESAGQWVHVSDTYLQVVPESRALSAQAYLLFYERVL

SEQ ID NO: 94975 - protein, 766 aa, Homo sapiens
  Payload ID: 18940
  Gene Name: ubiquitin specific peptidase 45
  ENSP ID: ENSP00000358236
MRVKDPTKALPEKAKRSKRPTVPHDEDSSDDIAVGLTCQHVSHAISVNHVKRAIAENLWSVCSECLKERRFYDGQLVLTSDIWLCLKCGFQGCGKNSESQHSLKHFKSSRTEPHCIIINLSTWIIWCYECDEKLSTHCNKKVLAQIVDFLQKHASKTQTSAFSRIMKLCEEKCETDEIQKGGKCRNLSVRGITNLGNTCFFNAVMQNLAQTYTLTDLMNEIKESSTKLKIFPSSDSQLDPLVVELSRPGPLTSALFLFLHSMKETEKGPLSPKVLFNQLCQKAPRFKDFQQQDSQELLHYLLDAVRTEETKRIQASILKAFNNPTTKTADDETRKKVKAYGKEGVKMNFIDRIFIGELTSTVMCEECANISTVKDPFIDISLPIIEERSQLIHDRKCIRKLSSGETVTYQKNENLEMNGDSLMFASLMNSESRLNESPTDDSEKEASHSESNVDADSEPSESESASKQTGLFRSSSGSGVQPDGPLYPLSAGKLLYTKETDSGDKEMAEAISELRLSSTVTGDQDFDRENQPLNISNNLCFLEGKHLRSYSPQNAFQTLSQSYITTSKECSIQSCLYQFTSMELLMGNNKLLCENCTKNKQKYQEETSFAEKKVEGVYTNARKQLLISAVPAVLILHLKRFHQAGLSLRKVNRHVDFPLMLDLAPFCSATCKNASVGDKVLYGLYGIVEHSGSMREGHYTAYVKVRTPSRKLSEHNTKKKNVPGLKAADNESAGQWVHVSDTYLQVVPESRALSAQAYLLFYERVL

SEQ ID NO: 94976 - protein, 209 aa, Homo sapiens
  Payload ID: 18940
  Gene Name: ubiquitin specific peptidase 45
  ENSP ID: ENSP00000421248
  MOD_RES (1)..(1): Any amino acid
XGLTCQHVSHAISVNHVKRAIAENLWSVCSECLKERRFYDGQLVLTSDIWLCLKCGFQGCGKNSESQHSLKHFKSSRTEPHCIIINLSTWIIWCYECDEKLSTHCNKKVLAQIVDFLQKHASKTQTSAFSRIMKLCEEKCETDEIQKGGKCRNLSVRGITNLGNTCFFNAVMQNLAQTYTLTDLMNEIKESSTKLKIFPSSDSQLGTSI

SEQ ID NO: 94977 - protein, 148 aa, Homo sapiens
  Payload ID: 18940
  Gene Name: ubiquitin specific peptidase 45
  ENSP ID: ENSP00000421706
  MOD_RES (1)..(1): Any amino acid
XQQDSQELLHYLLDAVRTEETKRIQASILKAFNNPTTKTADDETRKKVKAYGKEGVKMNFIDRIFIGELTSTVMCEECANISTVKDPFIDISLPIIEERVSKPLLWGRMNKYRSLRETDHDRYSGNVTIENIHQPRAAKKHSSSKDKR

SEQ ID NO: 94978 - protein, 345 aa, Homo sapiens
  Payload ID: 18940
  Gene Name: ubiquitin specific peptidase 45
  ENSP ID: ENSP00000422460
MRVKDPTKALPEKAKRSKRPTVPHDEDSSDDIAVGLTCQHVSHAISVNHVKRAIAENLWSVCSECLKERRFYDGQLVLTSDIWLCLKCGFQGCGKNSESQHSLKHFKSSRTEPHCIIINLSTWIIWCYECDEKLSTHCNKKVLAQIVDFLQKHASKTQTSAFSRIMKLCEEKCETDEIQKGGKCRNLSVRGITNLGNTCFFNAVMQNLAQTYTLTDLMNEIKESSTKLKIFPSSDSQLDPLVVELSRPGPLTSALFLFLHSMKETEKGPLSPKVLFNQLCQKAPRFKDFQQQDSQELLHYLLDAVRTEETKRIQASILKAFNNPTTKTADDETRKKVKDVTRQNV

SEQ ID NO: 94979 - protein, 135 aa, Homo sapiens
  Payload ID: 18940
  Gene Name: ubiquitin specific peptidase 45
  ENSP ID: ENSP00000423374
LSRPGPLTSALFLFLHSMKETEKGPLSPKVLFNQLCQKAPRFKDFQQQDSQELLHYLLDAVRTEETKISTVKDPFIDISLPIIEERVSKPLLWGRMNKYRSLRETDHDRYSGNVTIENIHQPRAAKKHSSSKDKR

SEQ ID NO: 94980 - protein, 289 aa, Homo sapiens; identical to SEQ ID NO: 94973
  Payload ID: 18940
  Gene Name: ubiquitin specific peptidase 45
  ENSP ID: ENSP00000423993

SEQ ID NO: 94981 - protein, 814 aa, Homo sapiens; identical to SEQ ID NO: 94974
  Payload ID: 18940
  Gene Name: ubiquitin specific peptidase 45
  Uniprot ID: Q70EL2
  ENSP ID: ENSP00000424372

SEQ ID NO: 94982 - protein, 191 aa, Homo sapiens
  Payload ID: 18940
  Gene Name: ubiquitin specific peptidase 45
  ENSP ID: ENSP00000425876
  MOD_RES (1)..(1): Any amino acid
XQTSAFSRIMKLCEEKCETDEIQKGGKCRNLSVRGITNLGNTCFFNAVMQNLAQTYTLTDLMNEIKESSTKLKIFPSSDSQLDPLVVELSRPGPLTSALFLFLHSMKETEKGPLSPKVLFNQLCQKAPRFKDFQQQDSQELLHYLLDAVRTEETKRIQASILKAFNNPTTKTADDETRKKVKDLHGERSIH

SEQ ID NO: 94983 - protein, 52 aa, Homo sapiens
  Payload ID: 18940
  Gene Name: ubiquitin specific peptidase 45
  ENSP ID: ENSP00000426861
MRVKDPTKALPEKAKRSKRPTVPHDEDSSDDIAVGLTCQHVSHAISVNHVKR

SEQ ID NO: 94984 - protein, 339 aa, Homo sapiens
  Payload ID: 18941
  Gene Name: ubiquitin specific peptidase 46
  ENSP ID: ENSP00000390102
MTVRNIASICNMFGNTCYCNSVLQALYFCRPFRENVLAYKAQQKKKENLLTCLADLFHSIATQKKKVGVIPPKKFISRLRKENDLFDNYMQQDAHEFLNYLLNTIADILQEEKKQEKQNGKLKNGNMNEPAENNKPELTWVHEIFQGTLTNETRCLNCETVSSKDEDFLDLSVDVEQNTSITHCLRDFSNTETLCSEQKYYCETCCSKQEAQKRMRVKKLPMILALHLKRFKYMEQLHRYTKLSYRVVFPLELRLFNTSSDAVNLDRMYDLVAVVVHCGSGPNRGHYITIVKSHGFWLLFDDDIVEKIDAQAIEEFYGLTSDISKNSESGYILFYQSRE

SEQ ID NO: 94985 - protein, 366 aa, Homo sapiens
  Payload ID: 18941
  Gene Name: ubiquitin specific peptidase 46
  Uniprot ID: P62068
  ENSP ID: ENSP00000407818
MTVRNIASICNMGTNASALEKDIGPEQFPINEHYFGLVNFGNTCYCNSVLQALYFCRPFRENVLAYKAQQKKKENLLTCLADLFHSIATQKKKVGVIPPKKFISRLRKENDLFDNYMQQDAHEFLNYLLNTIADILQEEKKQEKQNGKLKNGNMNEPAENNKPELTWVHEIFQGTLTNETRCLNCETVSSKDEDFLDLSVDVEQNTSITHCLRDFSNTETLCSEQKYYCETCCSKQEAQKRMRVKKLPMILALHLKRFKYMEQLHRYTKLSYRVVFPLELRLFNTSSDAVNLDRMYDLVAVVVHCGSGPNRGHYITIVKSHGFWLLFDDDIVEKIDAQAIEEFYGLTSDISKNSESGYILFYQSRE

SEQ ID NO: 94986 - protein, 40 aa, Homo sapiens
  Payload ID: 18941
  Gene Name: ubiquitin specific peptidase 46
  ENSP ID: ENSP00000422018
MTVRNIASICNMEEPPALGSPGWTLLAPPLVRAFGELRLE

SEQ ID NO: 94987 - protein, 359 aa, Homo sapiens
  Payload ID: 18941
  Gene Name: ubiquitin specific peptidase 46
  Uniprot ID: P62068
  ENSP ID: ENSP00000423244
MNCFQGTNASALEKDIGPEQFPINEHYFGLVNFGNTCYCNSVLQALYFCRPFRENVLAYKAQQKKKENLLTCLADLFHSIATQKKKVGVIPPKKFISRLRKENDLFDNYMQQDAHEFLNYLLNTIADILQEEKKQEKQNGKLKNGNMNEPAENNKPELTWVHEIFQGTLTNETRCLNCETVSSKDEDFLDLSVDVEQNTSITHCLRDFSNTETLCSEQKYYCETCCSKQEAQKRMRVKKLPMILALHLKRFKYMEQLHRYTKLSYRVVFPLELRLFNTSSDAVNLDRMYDLVAVVVHCGSGPNRGHYITIVKSHGFWLLFDDDIVEKIDAQAIEEFYGLTSDISKNSESGYILFYQSRE

SEQ ID NO: 94988 - protein, 56 aa, Homo sapiens
  Payload ID: 18941
  Gene Name: ubiquitin specific peptidase 46
  ENSP ID: ENSP00000425806
MNCFQGTNASALEKDIGPEQFPINEHYFGLVNELSTELGPSVTEGCLGKVWKHMLL

SEQ ID NO: 94989 - protein, 40 aa, Homo sapiens; identical to SEQ ID NO: 94986
  Payload ID: 18941
  Gene Name: ubiquitin specific peptidase 46
  ENSP ID: ENSP00000426970

SEQ ID NO: 94990 - protein, 1287 aa, Homo sapiens
  Payload ID: 18942
  Gene Name: ubiquitin specific peptidase 47
  Uniprot ID: Q96K76
  ENSP ID: ENSP00000339957
MVPGEENQLVPKEAPLDHTSDKSLLDANFEPGKKNFLHLTDKDGEQPQILLEDSSAGEDSVHDRFIGPLPREGSGGSTSDYVSQSYSYSSILNKSETGYVGLVNQAMTCYLNSLLQTLFMTPEFRNALYKWEFEESEEDPVTSIPYQLQRLFVLLQTSKKRAIETTDVTRSFGWDSSEAWQQHDVQELCRVMFDALEQKWKQTEQADLINELYQGKLKDYVRCLECGYEGWRIDTYLDIPLVIRPYGSSQAFASVEEALHAFIQPEILDGPNQYFCERCKKKCDARKGLRFLHFPYLLTLQLKRFDFDYTTMHRIKLNDRMTFPEELDMSTFIDVEDEKSPQTESCTDSGAENEGSCHSDQMSNDFSNDDGVDEGICLETNSGTEKISKSGLEKNSLIYELFSVMVHSGSAAGGHYYACIKSFSDEQWYSFNDQHVSRITQEDIKKTHGGSSGSRGYYSSAFASSTNAYMLIYRLKDPARNAKFLEVDEYPEHIKNLVQKERELEEQEKRQREIERNTCKIKLFCLHPTKQVMMENKLEVHKDKTLKEAVEMAYKMMDLEEVIPLDCCRLVKYDEFHDYLERSYEGEEDTPMGLLLGGVKSTYMFDLLLETRKPDQVFQSYKPGEVMVKVHVVDLKAESVAAPITVRAYLNQTVTEFKQLISKAIHLPAETMRIVLERCYNDLRLLSVSSKTLKAEGFFRSNKVFVESSETLDYQMAFADSHLWKLLDRHANTIRLFVLLPEQSPVSYSKRTAYQKAGGDSGNVDDDCERVKGPVGSLKSVEAILEESTEKLKSLSLQQQQDGDNGDSSKSTETSDFENIESPLNERDSSASVDNRELEQHIQTSDPENFQSEERSDSDVNNDRSTSSVDSDILSSSHSSDTLCNADNAQIPLANGLDSHSITSSRRTKANEGKKETWDTAEEDSGTDSEYDESGKSRGEMQYMYFKAEPYAADEGSGEGHKWLMVHVDKRITLAAFKQHLEPFVGVLSSHFKVFRVYASNQEFESVRLNETLSSFSDDNKITIRLGRALKKGEYRVKVYQLLVNEQEPCKFLLDAVFAKGMTVRQSKEELIPQLREQCGLELSIDRFRLRKKTWKNPGTVFLDYHIYEEDINISSNWEVFLEVLDGVEKMKSMSQLAVLSRRWKPSEMKLDPFQEVVLESSSVDELREKLSEISGIPLDDIEFAKGRGTFPCDISVLDIHQDLDWNPKVSTLNVWPLYICDDGAVIFYRDKTEELMELTDEQRNELMKKESSRLQKTGHRVTYSPRKEKALKIYLDGAPNKDLTQD

SEQ ID NO: 94991 - protein, 1375 aa, Homo sapiens
  Payload ID: 18942
  Gene Name: ubiquitin specific peptidase 47
  Uniprot ID: Q96K76
  ENSP ID: ENSP00000382382
MVPGEENQLVPKEDVFWRCRQNIFDEMKKKFLQIENAAEEPRVLCIIQDTTNSKTVNERITLNLPASTPVRKLFEDVANKVGYINGTFDLVWGNGINTADMAPLDHTSDKSLLDANFEPGKKNFLHLTDKDGEQPQILLEDSSAGEDSVHDRFIGPLPREGSGGSTSDYVSQSYSYSSILNKSETGYVGLVNQAMTCYLNSLLQTLFMTPEFRNALYKWEFEESEEDPVTSIPYQLQRLFVLLQTSKKRAIETTDVTRSFGWDSSEAWQQHDVQELCRVMFDALEQKWKQTEQADLINELYQGKLKDYVRCLECGYEGWRIDTYLDIPLVIRPYGSSQAFASVEEALHAFIQPEILDGPNQYFCERCKKKCDARKGLRFLHFPYLLTLQLKRFDFDYTTMHRIKLNDRMTFPEELDMSTFIDVEDEKSPQTESCTDSGAENEGSCHSDQMSNDFSNDDGVDEGICLETNSGTEKISKSGLEKNSLIYELFSVMVHSGSAAGGHYYACIKSFSDEQWYSFNDQHVSRITQEDIKKTHGGSSGSRGYYSSAFASSTNAYMLIYRLKDPARNAKFLEVDEYPEHIKNLVQKERELEEQEKRQREIERNTCKIKLFCLHPTKQVMMENKLEVHKDKTLKEAVEMAYKMMDLEEVIPLDCCRLVKYDEFHDYLERSYEGEEDTPMGLLLGGVKSTYMFDLLLETRKPDQVFQSYKPGEVMVKVHVVDLKAESVAAPITVRAYLNQTVTEFKQLISKAIHLPAETMRIVLERCYNDLRLLSVSSKTLKAEGFFRSNKVFVESSETLDYQMAFADSHLWKLLDRHANTIRLFVLLPEQSPVSYSKRTAYQKAGGDSGNVDDDCERVKGPVGSLKSVEAILEESTEKLKSLSLQQQQDGDNGDSSKSTETSDFENIESPLNERDSSASVDNRELEQHIQTSDPENFQSEERSDSDVNNDRSTSSVDSDILSSSHSSDTLCNADNAQIPLANGLDSHSITSSRRTKANEGKKETWDTAEEDSGTDSEYDESGKSRGEMQYMYFKAEPYAADEGSGEGHKWLMVHVDKRITLAAFKQHLEPFVGVLSSHFKVFRVYASNQEFESVRLNETLSSFSDDNKITIRLGRALKKGEYRVKVYQLLVNEQEPCKFLLDAVFAKGMTVRQSKEELIPQLREQCGLELSIDRFRLRKKTWKNPGTVFLDYHIYEEDINISSNWEVFLEVLDGVEKMKSMSQLAVLSRRWKPSEMKLDPFQEVVLESSSVDELREKLSEISGIPLDDIEFAKGRGTFPCDISVLDIHQDLDWNPKVSTLNVWPLYICDDGAVIFYRDKTEELMELTDEQRNELMKKESSRLQKTGHRVTYSPRKEKALKIYLDGAPNKDLTQD

SEQ ID NO: 94992 - protein, 1355 aa, Homo sapiens
  Payload ID: 18942
  Gene Name: ubiquitin specific peptidase 47
  Uniprot ID: Q96K76
  ENSP ID: ENSP00000433146
MVPGEENQLVPKEIENAAEEPRVLCIIQDTTNSKTVNERITLNLPASTPVRKLFEDVANKVGYINGTFDLVWGNGINTADMAPLDHTSDKSLLDANFEPGKKNFLHLTDKDGEQPQILLEDSSAGEDSVHDRFIGPLPREGSGGSTSDYVSQSYSYSSILNKSETGYVGLVNQAMTCYLNSLLQTLFMTPEFRNALYKWEFEESEEDPVTSIPYQLQRLFVLLQTSKKRAIETTDVTRSFGWDSSEAWQQHDVQELCRVMFDALEQKWKQTEQADLINELYQGKLKDYVRCLECGYEGWRIDTYLDIPLVIRPYGSSQAFASVEEALHAFIQPEILDGPNQYFCERCKKKCDARKGLRFLHFPYLLTLQLKRFDFDYTTMHRIKLNDRMTFPEELDMSTFIDVEDEKSPQTESCTDSGAENEGSCHSDQMSNDFSNDDGVDEGICLETNSGTEKISKSGLEKNSLIYELFSVMVHSGSAAGGHYYACIKSFSDEQWYSFNDQHVSRITQEDIKKTHGGSSGSRGYYSSAFASSTNAYMLIYRLKDPARNAKFLEVDEYPEHIKNLVQKERELEEQEKRQREIERNTCKIKLFCLHPTKQVMMENKLEVHKDKTLKEAVEMAYKMMDLEEVIPLDCCRLVKYDEFHDYLERSYEGEEDTPMGLLLGGVKSTYMFDLLLETRKPDQVFQSYKPGEVMVKVHVVDLKAESVAAPITVRAYLNQTVTEFKQLISKAIHLPAETMRIVLERCYNDLRLLSVSSKTLKAEGFFRSNKVFVESSETLDYQMAFADSHLWKLLDRHANTIRLFVLLPEQSPVSYSKRTAYQKAGGDSGNVDDDCERVKGPVGSLKSVEAILEESTEKLKSLSLQQQQDGDNGDSSKSTETSDFENIESPLNERDSSASVDNRELEQHIQTSDPENFQSEERSDSDVNNDRSTSSVDSDILSSSHSSDTLCNADNAQIPLANGLDSHSITSSRRTKANEGKKETWDTAEEDSGTDSEYDESGKSRGEMQYMYFKAEPYAADEGSGEGHKWLMVHVDKRITLAAFKQHLEPFVGVLSSHFKVFRVYASNQEFESVRLNETLSSFSDDNKITIRLGRALKKGEYRVKVYQLLVNEQEPCKFLLDAVFAKGMTVRQSKEELIPQLREQCGLELSIDRFRLRKKTWKNPGTVFLDYHIYEEDINISSNWEVFLEVLDGVEKMKSMSQLAVLSRRWKPSEMKLDPFQEVVLESSSVDELREKLSEISGIPLDDIEFAKGRGTFPCDISVLDIHQDLDWNPKVSTLNVWPLYICDDGAVIFYRDKTEELMELTDEQRNELMKKESSRLQKTGHRVTYSPRKEKALKIYLDGAPNKDLTQD

SEQ ID NO: 94993 - protein, 1035 aa, Homo sapiens
  Payload ID: 18943
  Gene Name: ubiquitin specific peptidase 48
  Uniprot ID: Q86UV5
  ENSP ID: ENSP00000309262
MAPRLQLEKAAWRWAETVRPEEVSQEHIETAYRIWLEPCIRGVCRRNCKGNPNCLVGIGEHIWLGEIDENSFHNIDDPNCERRKKNSFVGLTNLGATCYVNTFLQVWFLNLELRQALYLCPSTCSDYMLGDGIQEEKDYEPQTICEHLQYLFALLQNSNRRYIDPSGFVKALGLDTGQQQDAQEFSKLFMSLLEDTLSKQKNPDVRNIVQQQFCGEYAYVTVCNQCGRESKLLSKFYELELNIQGHKQLTDCISEFLKEEKLEGDNRYFCENCQSKQNATRKIRLLSLPCTLNLQLMRFVFDRQTGHKKKLNTYIGFSEILDMEPYVEHKGGSYVYELSAVLIHRGVSAYSGHYIAHVKDPQSGEWYKFNDEDIEKMEGKKLQLGIEEDLAEPSKSQTRKPKCGKGTHCSRNAYMLVYRLQTQEKPNTTVQVPAFLQELVDRDNSKFEEWCIEMAEMRKQSVDKGKAKHEEVKELYQRLPAGAEPYEFVSLEWLQKWLDESTPTKPIDNHACLCSHDKLHPDKISIMKRISEYAADIFYSRYGGGPRLTVKALCKECVVERCRILRLKNQLNEDYKTVNNLLKAAVKGSDGFWVGKSSLRSWRQLALEQLDEQDGDAEQSNGKMNGSTLNKDESKEERKEEEELNFNEDILCPHGELCISENERRLVSKEAWSKLQQYFPKAPEFPSYKECCSQCKILEREGEENEALHKMIANEQKTSLPNLFQDKNRPCLSNWPEDTDVLYIVSQFFVEEWRKFVRKPTRCSPVSSVGNSALLCPHGGLMFTFASMTKEDSKLIALIWPSEWQMIQKLFVVDHVIKITRIEVGDVNPSETQYISEPKLCPECREGLLCQQQRDLREYTQATIYVHKVVDNKKVMKDSAPELNVSSSETEEDKEEAKPDGEKDPDFNQSNGGTKRQKISHQNYIAYQKQVIRRSMRHRKVRGEKALLVSANQTLKELKIQIMHAFSVAPFDQNLSIDGKILSDDCATLGTLGVIPESVILLKADEPIADYAAMDDVMQVCMPEEGFKGTGLLGH

SEQ ID NO: 94994 - protein, 115 aa, Homo sapiens
  Payload ID: 18943
  Gene Name: ubiquitin specific peptidase 48
  ENSP ID: ENSP00000363862
  MOD_RES (1)..(1): Any amino acid
XLSLPCTLNLQLMRFVFDRQTGHKKKLNTYIGFSEILDMEPYVEHKGGSYVYELSAVLIHRGVSAYSGHYIAHVKDPQSGEWYKFNDEDIEKMEGKKLQLGIEEDLGKTFKFRTF

SEQ ID NO: 94995 - protein, 521 aa, Homo sapiens
  Payload ID: 18943
  Gene Name: ubiquitin specific peptidase 48
  ENSP ID: ENSP00000363864
MNVSLSQKTVKIHRLFPMLAFSEPYEFVSLEWLQKWLDESTPTKPIDNHACLCSHDKLHPDKISIMKRISEYAADIFYSRYGGGPRLTVKALCKECVVERCRILRLKNQLNEDYKTVNNLLKAAVKGDGFWVGKSSLRSWRQLALEQLDEQDGDAEQSNGKMNGSTLNKDESKEERKEEEELNFNEDILCPHGELCISENERRLVSKEAWSKLQQYFPKAPEFPSYKECCSQCKILEREGEENEALHKMIANEQKTSLPNLFQDKNRPCLSNWPEDTDVLYIVSQFFVEEWRKFVRKPTRCSPVSSVGNSALLCPHGGLMFTFASMTKEDSKLIALIWPSEWQMIQKLFVVDHVIKITRIEVGDVNPSETQYISEPKLCPECREGLLCQQQRDLREYTQATIYVHKVVDNKKVMKDSAPELNVSSSETEEDKEEAKPDGEKDPDFNQIMHAFSVAPFDQNLSIDGKILSDDCATLGTLGVIPESVILLKADEPIADYAAMDDVMQVCMPEEGFKGTGLLGH

SEQ ID NO: 94996 - protein, 983 aa, Homo sapiens
  Payload ID: 18943
  Gene Name: ubiquitin specific peptidase 48
  Uniprot ID: Q86UV5
  ENSP ID: ENSP00000383157
MAPRLQLEKAAWRWAETVRPEEVSQEHIETAYRIWLEPCIRGVCRRNCKGNPNCLVGIGEHIWLGEIDENSFHNIDDPNCERRKKNSFVGLTNLGATCYVNTFLQVWFLNLELRQALYLCPSTCSDYMLGDGIQEEKDYEPQTICEHLQYLFALLQNSNRRYIDPSGFVKALGLDTGQQQDAQEFSKLFMSLLEDTLSKQKNPDVRNIVQQQFCGEYAYVTVCNQCGRESKLLSKFYELELNIQGHKQLTDCISEFLKEEKLEGDNRYFCENCQSKQNATRKIRLLSLPCTLNLQLMRFVFDRQTGHKKKLNTYIGFSEILDMEPYVEHKGGSYVYELSAVLIHRGVSAYSGHYIAHVKDPQSGEWYKFNDEDIEKMEGKKLQLGIEEDLAEPSKSQTRKPKCGKGTHCSRNAYMLVYRLQTQEKPNTTVQVPAFLQELVDRDNSKFEEWCIEMAEMRKQSVDKGKAKHEEVKELYQRLPAGAEPYEFVSLEWLQKWLDESTPTKPIDNHACLCSHDKLHPDKISIMKRISEYAADIFYSRYGGGPRLTVKALCKECVVERCRILRLKNQLNEDYKTVNNLLKAAVKGSDGFWVGKSSLRSWRQLALEQLDEQDGDAEQSNGKMNGSTLNKDESKEERKEEEELNFNEDILCPHGELCISENERRLVSKEAWSKLQQYFPKAPEFPSYKECCSQCKILEREGEENEALHKMIANEQKTSLPNLFQDKNRPCLSNWPEDTDVLYIVSQFFVEEWRKFVRKPTRCSPVSSVGNSALLCPHGGLMFTFASMTKEDSKLIALIWPSEWQMIQKLFVVDHVIKITRIEVGDVNPSETQYISEPKLCPECREGLLCQQQRDLREYTQATIYVHKVVDNKKVMKDSAPELNVSSSETEEDKEEAKPDGEKDPDFNQIMHAFSVAPFDQNLSIDGKILSDDCATLGTLGVIPESVILLKADEPIADYAAMDDVMQVCMPEEGFKGTGLLGH

SEQ ID NO: 94997 - protein, 485 aa, Homo sapiens
  Payload ID: 18943
  Gene Name: ubiquitin specific peptidase 48
  Uniprot ID: Q86UV5
  ENSP ID: ENSP00000406256
MAPRLQLEKAAWRWAETVRPEEVSQEHIETAYRIWLEPCIRGVCRRNCKGNPNCLVGIGEHIWLGEIDENSFHNIDDPNCERRKKNSFVGLTNLGATCYVNTFLQVWFLNLELRQALYLCPSTCSDYMLGDGIQEEKDYEPQTICEHLQYLFALLQNSNRRYIDPSGFVKALGLDTGQQQDAQEFSKLFMSLLEDTLSKQKNPDVRNIVQQQFCGEYAYVTVCNQCGRESKLLSKFYELELNIQGHKQLTDCISEFLKEEKLEGDNRYFCENCQSKQNATRKIRLLSLPCTLNLQLMRFVFDRQTGHKKKLNTYIGFSEILDMEPYVEHKGGSYVYELSAVLIHRGVSAYSGHYIAHVKDPQSGEWYKFNDEDIEKMEGKKLQLGIEEDLAEPSKSQTRKPKCGKGTHCSRNAYMLVYRLQTQEKPNTTVQVPAFLQELVDRDNSKFEEWCIEMAEMRKQSVDKGKAKHEEVKELYQRLPAGAGL

SEQ ID NO: 94998 - protein, 135 aa, Homo sapiens
  Payload ID: 18943
  Gene Name: ubiquitin specific peptidase 48
  ENSP ID: ENSP00000431832
MLVYRLQTQEKPNTTVQVPAFLQELVDRDNSKFEEWCIEMAEMRKQSVDKGKAKHEEVKELYQRLPAGAEPYEFVSLEWLQKWLDESTPTKPIDNHACLCSHDKLHPDKISIMKRISEYAADIFYSRYGGGPRLT

SEQ ID NO: 94999 - protein, 1047 aa, Homo sapiens
  Payload ID: 18943
  Gene Name: ubiquitin specific peptidase 48
  Uniprot ID: Q86UV5
  ENSP ID: ENSP00000431949
MAPRLQLEKAAWRWAETVRPEEVSQEHIETAYRIWLEPCIRGVCRRNCKGNPNCLVGIGEHIWLGEIDENSFHNIDDPNCERRKKNSFVGLTNLGATCYVNTFLQVWFLNLELRQALYLCPSTCSDYMLGDGIQEEKDYEPQTICEHLQYLFALLQNSNRRYIDPSGFVKALGLDTGQQQDAQEFSKLFMSLLEDTLSKQKNPDVRNIVQQQFCGEYAYVTVCNQCGRESKLLSKFYELELNIQGHKQLTDCISEFLKEEKLEGDNRYFCENCQSKQNATRKIRLLSLPCTLNLQLMRFVFDRQTGHKKKLNTYIGFSEILDMEPYVEHKGGSYVYELSAVLIHRGVSAYSGHYIAHVKDPQSGEWYKFNDEDIEKMEGKKLQLGIEEDLEPSKSQTRKPKCGKGTHCSRNAYMLVYRLQTQEKPNTTVQVPAFLQELVDRDNSKFEEWCIEMAEMRKQSVDKGKAKHEEVKELYQRLPAGAEPYEFVSLEWLQKWLDESTPTKPIDNHACLCSHDKLHPDKISIMKRISEYAADIFYSRYGGGPRLTVKALCKECVVERCRILRLKNQLNEDYKTVNNLLKAAVKGSDGFWVGKSSLRSWRQLALEQLDEQDGDAEQSNGKMNGSTLNKDESKEERKEEEELNFNEDILCPHAVFFFSKYIFLNSGELCISENERRLVSKEAWSKLQQYFPKAPEFPSYKECCSQCKILEREGEENEALHKMIANEQKTSLPNLFQDKNRPCLSNWPEDTDVLYIVSQFFVEEWRKFVRKPTRCSPVSSVGNSALLCPHGGLMFTFASMTKEDSKLIALIWPSEWQMIQKLFVVDHVIKITRIEVGDVNPSETQYISEPKLCPECREGLLCQQQRDLREYTQATIYVHKVVDNKKVMKDSAPELNVSSSETEEDKEEAKPDGEKDPDFNQSNGGTKRQKISHQNYIAYQKQVIRRSMRHRKVRGEKALLVSANQTLKELKIQIMHAFSVAPFDQNLSIDGKILSDDCATLGTLGVIPESVILLKADEPIADYAAMDDVMQVCMPEEGFKGTGLLGH

SEQ ID NO: 95000 - protein, 48 aa, Homo sapiens
  Payload ID: 18943
  Gene Name: ubiquitin specific peptidase 48
  ENSP ID: ENSP00000434073
MLGDGIQEEKDYEPQTICEHLQYLFALLQNSNRRYIDPSGFVKALGLD

SEQ ID NO: 95001 - protein, 146 aa, Homo sapiens
  Payload ID: 18943
  Gene Name: ubiquitin specific peptidase 48
  ENSP ID: ENSP00000435604
MFTLQNFILMEYTEPSKSQTRKPKCGKGTHCSRNAYMLVYRLQTQEKPNTTVQVPAFLQELVDRDNSKFEEWCIEMAEMRKQSVDKGKAKHEEVKELYQRLPAGAEPYEFVSLEWLQKWLDESTPTKPIDNHACLCSHDKLHPDKI

SEQ ID NO: 95002 - protein, 38 aa, Homo sapiens
  Payload ID: 18943
  Gene Name: ubiquitin specific peptidase 48
  ENSP ID: ENSP00000435612
MLGDGIQEEKDYEPQTICEHLQYLFALLQNSNRRYIDP

SEQ ID NO: 95003 - protein, 640 aa, Homo sapiens
  Payload ID: 18944
  Gene Name: ubiquitin specific peptidase 49
  Uniprot ID: Q70CQ1
  ENSP ID: ENSP00000362097
MDRCKHVGRLRLAQDHSILNPQKWCCLECATTESVWACLKCSHVACGRYIEDHALKHFEETGHPLAMEVRDLYVFCYLCKDYVLNDNPEGDLKLLRSSLLAVRGQKQDTPVRRGRTLRSMASGEDVVLPQRAPQGQPQMLTALWYRRQRLLARTLRLWFEKSSRGQAKLEQRRQEEALERKKEEARRRRREVKRRLLEELASTPPRKSARLLLHTPRDAGPAASRPAALPTSRRVPAATLKLRRQPAMAPGVTGLRNLGNTCYMNSILQVLSHLQKFRECFLNLDPSKTEHLFPKATNGKTQLSGKPTNSSATELSLRNDRAEACEREGFCWNGRASISRSLELIQNKEPSSKHISLCRELHTLFRVMWSGKWALVSPFAMLHSVWSLIPAFRGYDQQDAQEFLCELLHKVQQELESEGTTRRILIPFSQRKLTKQVLKVVNTIFHGQLLSQVTCISCNYKSNTIEPFWDLSLEFPERYHCIEKGFVPLNQTECLLTEMLAKFTETEALEGRIYACDQCNSKRRKSNPKPLVLSEARKQLMIYRLPQVLRLHLKRFRWSGRNHREKIGVHVVFDQVLTMEPYCCRDMLSSLDKETFAYDLSAVVMHHGKGFGSGHYTAYCYNTEGGACALLCGVGDTERG

SEQ ID NO: 95004 - protein, 688 aa, Homo sapiens
  Payload ID: 18944
  Gene Name: ubiquitin specific peptidase 49
  Uniprot ID: Q70CQ1
  ENSP ID: ENSP00000362100
MDRCKHVGRLRLAQDHSILNPQKWCCLECATTESVWACLKCSHVACGRYIEDHALKHFEETGHPLAMEVRDLYVFCYLCKDYVLNDNPEGDLKLLRSSLLAVRGQKQDTPVRRGRTLRSMASGEDVVLPQRAPQGQPQMLTALWYRRQRLLARTLRLWFEKSSRGQAKLEQRRQEEALERKKEEARRRRREVKRRLLEELASTPPRKSARLLLHTPRDAGPAASRPAALPTSRRVPAATLKLRRQPAMAPGVTGLRNLGNTCYMNSILQVLSHLQKFRECFLNLDPSKTEHLFPKATNGKTQLSGKPTNSSATELSLRNDRAEACEREGFCWNGRASISRSLELIQNKEPSSKHISLCRELHTLFRVMWSGKWALVSPFAMLHSVWSLIPAFRGYDQQDAQEFLCELLHKVQQELESEGTTRRILIPFSQRKLTKQVLKVVNTIFHGQLLSQVTCISCNYKSNTIEPFWDLSLEFPERYHCIEKGFVPLNQTECLLTEMLAKFTETEALEGRIYACDQCNSKRRKSNPKPLVLSEARKQLMIYRLPQVLRLHLKRFRWSGRNHREKIGVHVVFDQVLTMEPYCCRDMLSSLDKETFAYDLSAVVMHHGKGFGSGHYTAYCYNTEGGFWVHCNDSKLNVCSVEEVCKTQAYILFYTQRTVQGNARISETHLQAQVQSSNNDEGRPQTFS

SEQ ID NO: 95005 - protein, 585 aa, Homo sapiens
  Payload ID: 18944
  Gene Name: ubiquitin specific peptidase 49
  ENSP ID: ENSP00000362101
MDRCKHVGRLRLAQDHSILNPQKWCCLECATTESVWACLKCSHVACGRYIEDHALKHFEETGHPLAMEVRDLYVFCYLCKDYVLNDNPEGDLKLLRSSLLAVRGQKQDTPVRRGRTLRSMASGEDVVLPQRAPQGQPQMLTALWYRRQRLLARTLRLWFEKSSRGQAKLEQRRQEEALERKKEEARRRRREVKRRLLEELASTPPRKSARLLLHTPRDAGPAASRPAALPTSRRVPAATLKLRRQPAMAPGVTGLRNLGNTCYMNSILQVLSHLQKFRECFLNLDPSKTEHLFPKATNGKTQLSGKPTNSSATELSLRNDRAEACEREGFCWNGRASISRSLELIQNKEPSSKHISLCRELHTLFRVMWSGKWALVSPFAMLHSVWSLIPAFRGYDQQDAQEFLCELLHKVQQELESEGTTRRILIPFSQRKLTKQVLKVVNTIFHGQLLSQVTCISCNYKSNTIEPFWDLSLEFPERYHCIEKGFVPLNQTECLLTEMLAKFTETEALEGRIYACDQCNSKRRKSNPKPLVLSEARKQLMIYRLPQVLRLHLKRFRWSGRNHREKIGVHVVFDQVFGSTAMTQS

SEQ ID NO: 95006 - protein, 688 aa, Homo sapiens; identical to SEQ ID NO: 95004
  Payload ID: 18944
  Gene Name: ubiquitin specific peptidase 49
  Uniprot ID: Q70CQ1
  ENSP ID: ENSP00000377797

SEQ ID NO: 95007 - protein, 52 aa, Homo sapiens
  Payload ID: 18944
  Gene Name: ubiquitin specific peptidase 49
  ENSP ID: ENSP00000389842
  MOD_RES (1)..(1): Any amino acid
XELESEGTTRRILIPFSQRKLTKQVLKVVNTIFHGQLLSQANDENPIPNPLF

SEQ ID NO: 95008 - protein, 15 aa, Homo sapiens
  Payload ID: 18944
  Gene Name: ubiquitin specific peptidase 49
  ENSP ID: ENSP00000411603
MDRCKHVGRLRLAQD

SEQ ID NO: 95009 - protein, 858 aa, Homo sapiens
  Payload ID: 18945
  Gene Name: ubiquitin specific peptidase 5 (isopeptidase T)
  Uniprot ID: P45974
  ENSP ID: ENSP00000229268
MAELSEEALLSVLPTIRVPKAGDRVHKDECAFSFDTPESEGGLYICMNTFLGFGKQYVERHFNKTGQRVYLHLRRTRRPKEEDPATGTGDPPRKKPTRLAIGVEGGFDLSEEKFELDEDVKIVILPDYLEIARDGLGGLPDIVRDRVTSAVEALLSADSASRKQEVQAWDGEVRQVSKHAFSLKQLDNPARIPPCGWKCSKCDMRENLWLNLTDGSILCGRRYFDGSGGNNHAVEHYRETGYPLAVKLGTITPDGADVYSYDEDDMVLDPSLAEHLSHFGIDMLKMQKTDKTMTELEIDMNQRIGEWELIQESGVPLKPLFGPGYTGIRNLGNSCYLNSVVQVLFSIPDFQRKYVDKLEKIFQNAPTDPTQDFSTQVAKLGHGLLSGEYSKPVPESGDGERVPEQKEVQDGIAPRMFKALIGKGHPEFSTNRQQDAQEFFLHLINMVERNCRSSENPNEVFRFLVEEKIKCLATEKVKYTQRVDYIMQLPVPMDAALNKEELLEYEEKKRQAEEEKMALPELVRAQVPFSSCLEAYGAPEQVDDFWSTALQAKSVAVKTTRFASFPDYLVIQIKKFTFGLDWVPKKLDVSIEMPEELDISQLRGTGLQPGEEELPDIAPPLVTPDEPKGSLGFYGNEDEDSFCSPHFSSPTSPMLDESVIIQLVEMGFPMDACRKAVYYTGNSGAEAAMNWVMSHMDDPDFANPLILPGSSGPGSTSAAADPPPEDCVTTIVSMGFSRDQALKALRATNNSLERAVDWIFSHIDDLDAEAAMDISEGRSAADSISESVPVGPKVRDGPGKYQLFAFISHMGTSTMCGHYVCHIKKEGRWVIYNDQKVCASEKPPKDLGYIYFYQRVAS

SEQ ID NO: 95010 - protein, 835 aa, Homo sapiens
  Payload ID: 18945
  Gene Name: ubiquitin specific peptidase 5 (isopeptidase T)
  Uniprot ID: P45974
  ENSP ID: ENSP00000373883
MAELSEEALLSVLPTIRVPKAGDRVHKDECAFSFDTPESEGGLYICMNTFLGFGKQYVERHFNKTGQRVYLHLRRTRRPKEEDPATGTGDPPRKKPTRLAIGVEGGFDLSEEKFELDEDVKIVILPDYLEIARDGLGGLPDIVRDRVTSAVEALLSADSASRKQEVQAWDGEVRQVSKHAFSLKQLDNPARIPPCGWKCSKCDMRENLWLNLTDGSILCGRRYFDGSGGNNHAVEHYRETGYPLAVKLGTITPDGADVYSYDEDDMVLDPSLAEHLSHFGIDMLKMQKTDKTMTELEIDMNQRIGEWELIQESGVPLKPLFGPGYTGIRNLGNSCYLNSVVQVLFSIPDFQRKYVDKLEKIFQNAPTDPTQDFSTQVAKLGHGLLSGEYSKPVPESGDGERVPEQKEVQDGIAPRMFKALIGKGHPEFSTNRQQDAQEFFLHLINMVERNCRSSENPNEVFRFLVEEKIKCLATEKVKYTQRVDYIMQLPVPMDAALNKEELLEYEEKKRQAEEEKMALPELVRAQVPFSSCLEAYGAPEQVDDFWSTALQAKSVAVKTTRFASFPDYLVIQIKKFTFGLDWVPKKLDVSIEMPEELDISQLRGTGLQPGEEELPDIAPPLVTPDEPKAPMLDESVIIQLVEMGFPMDACRKAVYYTGNSGAEAAMNWVMSHMDDPDFANPLILPGSSGPGSTSAAADPPPEDCVTTIVSMGFSRDQALKALRATNNSLERAVDWIFSHIDDLDAEAAMDISEGRSAADSISESVPVGPKVRDGPGKYQLFAFISHMGTSTMCGHYVCHIKKEGRWVIYNDQKVCASEKPPKDLGYIYFYQRVAS

SEQ ID NO: 95011 - protein, 137 aa, Homo sapiens
  Payload ID: 18945
  Gene Name: ubiquitin specific peptidase 5 (isopeptidase T)
  ENSP ID: ENSP00000444668
MAELSEEALLSVLPTIRVPKAGDRVHKDECAFSFDTPESEGGLYICMNTFLGFGKQYVERHFNKTGQRVYLHLRRTRRPKEEDPATGTGDPPRKKPTRLAIGVEGGFDLSEEKFELDEDVKYTQRVDYIMQLPVPMD

SEQ ID NO: 95012 - protein, 85 aa, Homo sapiens
  Payload ID: 18946
  Gene Name: ubiquitin specific peptidase 50
  ENSP ID: ENSP00000434014
FFQQDALTWNNEIHCSFCETKQETAVRASISKAPKIIIFHLKRSMRRFVSNIYRASVVGLLEGKFTKCGPPVTGFFGVFNSQTLH

SEQ ID NO: 95013 - protein, 334 aa, Homo sapiens
  Payload ID: 18946
  Gene Name: ubiquitin specific peptidase 50
  Uniprot ID: Q70EL3
  ENSP ID: ENSP00000434676
MTSQPSLPADDFDIYHVLAECTDYYDTLPVKEADGNQPHFQGVTGLWNLGNTCCVNAISQCLCSILPLVEYFLTGKYITALQNDCSEVATAFAYLMTDMWLGDSDCVSPEIFWSALGNLYPAFTKKMQQDAQEFLICVLNELHEALKKYHYSRRRSYEKGSTQRCCRKWITTETSIITQLFEEQLNYSIVCLKCEKCTYKNEVFTVFSLPIPSKYECSLRDCLQCFFQQDALTWNNEIHCSFCETKQETAVRASISKAPKIIIFHLKRFDIQGTTKRKLRTDIHYPLTNLDLTPYICSIFRKYPKYNLCAVVNHFGDLDGGHYTAFCKNSVTQA

SEQ ID NO: 95014 - protein, 61 aa, Homo sapiens
  Payload ID: 18946
  Gene Name: ubiquitin specific peptidase 50
  ENSP ID: ENSP00000453946
MTSQPSLPADDFDIYHVLTTTPGEDHMRKDLLRDAAGSGLPLRHPSSPSCLKSSSIIASYV

SEQ ID NO: 95015 - protein, 343 aa, Homo sapiens
  Payload ID: 18946
  Gene Name: ubiquitin specific peptidase 50
  ENSP ID: ENSP00000483490
MTSQPSLPADDFDIYHVLAECTDYYDTLPVKEADGNQPHFQGVTGLWNLGNTCCVNAISQCLCSILPLVEYFLTGKYITALQNKTYPFLLPSDCSEVATAFAYLMTDMWLGDSDCVSPEIFWSALGNLYPAFTKKMQQDAQEFLICVLNELHEALKKYHYSRRRSYEKGSTQRCCRKWITTETSIITQLFEEQLNYSIVCLKCEKCTYKNEVFTVFSLPIPSKYECSLRDCLQCFFQQDALTWNNEIHCSFCETKQETAVRASISKAPKIIIFHLKRFDIQGTTKRKLRTDIHYPLTNLDLTPYICSIFRKYPKYNLCAVVNHFGDLDGGHYTAFCKNSVTQA

SEQ ID NO: 95016 - protein, 711 aa, Homo sapiens
  Payload ID: 18947
  Gene Name: ubiquitin specific peptidase 51
  Uniprot ID: Q70EK9
  ENSP ID: ENSP00000423333
MAQVRETSLPSGSGVRWISGGGGGASPEEAVEKAGKMEEAAAGATKASSRREAEEMKLEPLQEREPAPEENLTWSSSGGDEKVLPSIPLRCHSSSSPVCPRRKPRPRPQPRARSRSQPGLSAPPPPPARPPPPPPPPPPPAPRPRAWRGSRRRSRPGSRPQTRRSCSGDLDGSGDPGGLGDWLLEVEFGQGPTGCSHVESFKVGKNWQKNLRLIYQRFVWSGTPETRKRKAKSCICHVCSTHMNRLHSCLSCVFFGCFTEKHIHKHAETKQHHLAVDLYHGVIYCFMCKDYVYDKDIEQIAKETKEKILRLLTSTSTDVSHQQFMTSGFEDKQSTCETKEQEPKLVKPKKKRRKKSVYTVGLRGLINLGNTCFMNCIVQALTHIPLLKDFFLSDKHKCIMTSPSLCLVCEMSSLFHAMYSGSRTPHIPYKLLHLIWIHAEHLAGYRQQDAHEFLIAILDVLHRHSKDDSGGQEANNPNCCNCIIDQIFTGGLQSDVTCQACHSVSTTIDPCWDISLDLPGSCATFDSQNPERADSTVSRDDHIPGIPSLTDCLQWFTRPEHLGSSAKIKCNSCQSYQESTKQLTMKKLPIVACFHLKRFEHVGKQRRKINTFISFPLELDMTPFLASTKESRMKEGQPPTDCVPNENKYSLFAVINHHGTLESGHYTSFIRQQKDQWFSCDDAIITKATIEDLLYSEGYLLFYHKQGLEKD

SEQ ID NO: 95017 - protein, 1073 aa, Homo sapiens
  Payload ID: 18948
  Gene Name: ubiquitin specific peptidase 53
  Uniprot ID: Q70EK8
  ENSP ID: ENSP00000274030
MAWVKFLRKPGGNLGKVYQPGSMLSLAPTKGLLNEPGQNSCFLNSAVQVLWQLDIFRRSLRVLTGHVCQGDACIFCALKTIFAQFQHSREKALPSDNIRHALAESFKDEQRFQLGLMDDAAECFENMLERIHFHIVPSRDADMCTSKSCITHQKFAMTLYEQCVCRSCGASSDPLPFTEFVRYISTTALCNEVERMLERHERFKPEMFAELLQAANTTDDYRKCPSNCGQKIKIRRVLMNCPEIVTIGLVWDSEHSDLTEAVVRNLATHLYLPGLFYRVTDENAKNSELNLVGMICYTSQHYCAFAFHTKSSKWVFFDDANVKEIGTRWKDVVSKCIRCHFQPLLLFYANPDGTAVSTEDALRQVISWSHYKSVAENMGCEKPVIHKSDNLKENGFGDQAKQRENQKFPTDNISSSNRSHSHTGVGKGPAKLSHIDQREKIKDISRECALKAIEQKNLLSSQRKDLEKGQRKDLGRHRDLVDEDLSHFQSGSPPAPNGFKQHGNPHLYHSQGKGSYKHDRVVPQSRASAQIISSSKSQILAPGEKITGKVKSDNGTGYDTDSSQDSRDRGNSCDSSSKSRNRGWKPMRETLNVDSIFSESEKRQHSPRHKPNISNKPKSSKDPSFSNWPKENPKQKGLMTIYEDEMKQEIGSRSSLESNGKGAEKNKGLVEGKVHGDNWQMQRTESGYESSDHISNGSTNLDSPVIDGNGTVMDISGVKETVCFSDQITTSNLNKERGDCTSLQSQHHLEGFRKELRNLEAGYKSHEFHPESHLQIKNHLIKRSHVHEDNGKLFPSSSLQIPKDHNAREHIHQSDEQKLEKPNECKFSEWLNIENSERTGLPFHVDNSASGKRVNSNEPSSLWSSHLRTVGLKPETAPLIQQQNIMDQCYFENSLSTECIIRSASRSDGCQMPKLFCQNLPPPLPPKKYAITSVPQSEKSESTPDVKLTEVFKATSHLPKHSLSTASEPSLEVSTHMNDERHKETFQVRECFGNTPNCPSSSSTNDFQANSGAIDAFCQPELDSISTCPNETVSLTTYFSVDSCMTDTYRLKYHQRPKLSFPESSGFCNNSLS

SEQ ID NO: 95018 - protein, 1073 aa, Homo sapiens; identical to SEQ ID NO: 95017
  Payload ID: 18948
  Gene Name: ubiquitin specific peptidase 53
  Uniprot ID: Q70EK8
  ENSP ID: ENSP00000409906

SEQ ID NO: 95019 - protein, 64 aa, Homo sapiens
  Payload ID: 18948
  Gene Name: ubiquitin specific peptidase 53
  ENSP ID: ENSP00000421729
HYCAFAFHTKSSKWVFFDDANVKEIGTRWKDVVSKCIRCHFQPLLLFYANPDGTAVSTEDALRM

SEQ ID NO: 95020 - protein, 327 aa, Homo sapiens
  Payload ID: 18948
  Gene Name: ubiquitin specific peptidase 53
  ENSP ID: ENSP00000426628
MAWVKFLRKPGGNLGKVYQPGSMLSLAPTKGLLNEPGQNSCFLNSAVQVLWQLDIFRRSLRVLTGHVCQGDACIFCALKTIFAQFQHSREKALPSDNIRHALAESFKDEQRFQLGLMDDAAECFENMLERIHFHIVPSRDADMCTSKSCITHQKFAMTLYEQCVCRSCGASSDPLPFTEFVRYISTTALCNEVERMLERHERFKPEMFAELLQAANTTDDYRKCPSNCGQKIKIRRVLMNCPEIVTIGLVWDSEHSDLTEAVVRNLATHLYLPGLFYRVTDENAKNSELNLVGMICYTSQHYCAFAFHTKSSKWVFFDDANVKEIIP

SEQ ID NO: 95021 - protein, 1684 aa, Homo sapiens
  Payload ID: 18949
  Gene Name: ubiquitin specific peptidase 54
  Uniprot ID: Q70EL1
  ENSP ID: ENSP00000345216
MSWKRNYFSGGRGSVQGMFAPRSSTSIAPSKGLSNEPGQNSCFLNSALQVLWHLDIFRRSFRQLTTHKCMGDSCIFCALKGIFNQFQCSSEKVLPSDTLRSALAKTFQDEQRFQLGIMDDAAECFENLLMRIHFHIADETKEDICTAQHCISHQKFAMTLFEQCVCTSCGATSDPLPFIQMVHYISTTSLCNQAICMLERREKPSPSMFGELLQNASTMGDLRNCPSNCGERIRIRRVLMNAPQIITIGLVWDSDHSDLAEDVIHSLGTCLKLGDLFFRVTDDRAKQSELYLVGMICYYGKHYSTFFFQTKIRKWMYFDDAHVKEIGPKWKDVVTKCIKGHYQPLLLLYADPQGTPVSTQDLPPQAEFQSYSRTCYDSEDSGREPSISSDTRTDSSTESYPYKHSHHESVVSHFSSDSQGTVIYNVENDSMSQSSRDTGHLTDSECNQKHTSKKGSLIERKRSSGRVRRKGDEPQASGYHSEGETLKEKQAPRNASKPSSSTNRLRDFKETVSNMIHNRPSLASQTNVGSHCRGRGGDQPDKKPPRTLPLHSRDWEIESTSSESKSSSSSKYRPTWRPKRESLNIDSIFSKDKRKHCGYTQLSPFSEDSAKEFIPDEPSKPPSYDIKFGGPSPQYKRWGPARPGSHLLEQHPRLIQRMESGYESSERNSSSPVSLDAALPESSNVYRDPSAKRSAGLVPSWRHIPKSHSSSILEVDSTASMGGWTKSQPFSGEEISSKSELDELQEEVARRAQEQELRRKREKELEAAKGFNPHPSRFMDLDELQNQGRSDGFERSLQEAESVFEESLHLEQKGDCAAALALCNEAISKLRLALHGASCSTHSRALVDKKLQISIRKARSLQDRMQQQQSPQQPSQPSACLPTQAGTLSQPTSEQPIPLQVLLSQEAQLESGMDTEFGASSFFHSPASCHESHSSLSPESSAPQHSSPSRSALKLLTSVEVDNIEPSAFHRQGLPKAPGWTEKNSHHSWEPLDAPEGKLQGSRCDNSSCSKLPPQEGRGIAQEQLFQEKKDPANPSPVMPGIATSERGDEHSLGCSPSNSSAQPSLPLYRTCHPIMPVASSFVLHCPDPVQKTNQCLQGQSLKTSLTLKVDRGSEETYRPEFPSTKGLVRSLAEQFQRMQGVSMRDSTGFKDRSLSGSLRKNSSPSDSKPPFSQGQEKGHWPWAKQQSSLEGGDRPLSWEESTEHSSLALNSGLPNGETSSGGQPRLAEPDIYQEKLSQVRDVRSKDLGSSTDLGTSLPLDSWVNITRFCDSQLKHGAPRPGMKSSPHDSHTCVTYPERNHILLHPHWNQDTEQETSELESLYQASLQASQAGCSGWGQQDTAWHPLSQTGSADGMGRRLHSAHDPGLSKTSTAEMEHGLHEARTVRTSQATPCRGLSRECGEDEQYSAENLRRISRSLSGTVVSEREEAPVSSHSFDSSNVRKPLETGHRCSSSSSLPVIHDPSVFLLGPQLYLPQPQFLSPDVLMPTMAGEPNRLPGTSRSVQQFLAMCDRGETSQGAKYTGRTLNYQSLPHRSRTDNSWAPWSETNQHIGTRFLTTPGCNPQLTYTATLPERSKGLQVPHTQSWSDLFHSPSHPPIVHPVYPPSSSLHVPLRSAWNSDPVPGSRTPGPRRVDMPPDDDWRQSSYASHSGHRRTVGEGFLFVLSDAPRREQIRARVLQHSQW

SEQ ID NO: 95022 - protein, 1684 aa, Homo sapiens; identical to SEQ ID NO: 95021
  Payload ID: 18949
  Gene Name: ubiquitin specific peptidase 54
  Uniprot ID: Q70EL1
  ENSP ID: ENSP00000386080

SEQ ID NO: 95023 - protein, 635 aa, Homo sapiens
  Payload ID: 18949
  Gene Name: ubiquitin specific peptidase 54
  ENSP ID: ENSP00000399972
  MOD_RES (1)..(1): Any amino acid
XPSPSMFGELLQNASTMGDLRNCPSNCGERIRIRRVLMNAPQIITIGLVWDSDHSDLAEDVIHSLGTCLKLGDLFFRVTDDRAKQSELYLVGMICYYGKHYSTFFFQTKIRKWMYFDDAHVKEIGPKWKDVVTKCIKGHYQPLLLLYADPQGTPVSTQDLPPQAEFQSYSRTCYDSEDSGREPSISSDTRTDSSTESYPYKHSHHESVVSHFSSDSQGTVIYNVENDSMSQSSRDTGHLTDSECNQKHTSKKGSLIERKRSSGRVRRKGDEPQASGYHSEGETLKEKQAPRNASKPSSSTNRLRDFKETVSNMIHNRPSLASQTNVGSHCRGRGGDQPDKKPPRTLPLHSRDWEIESTSSESKSSSSSKYRPTWRPKRESLNIDSIFSKDKRKHCGYTQLSPFSEDSAKEFIPDEPSKPPSYDIKFGGPSPQYKRWGPARPGSHLLEQHPRLIQRMESGYESSERNSSSPVSLDAALPESSNVYRDPSAKRSAGLVPSWRHIPKSHSSSILEVDSTASMGGWTKSQPFSGEEISSKSELDELQEEVARRAQEQELRRKREKELEAAKGFNPHPSRFMDLDELQNQGRSDGFERSLQEAESVFEESLHLEQKGDCAAALALCNEAILNSLSRSKYC

SEQ ID NO: 95024 - protein, 143 aa, Homo sapiens
  Payload ID: 18949
  Gene Name: ubiquitin specific peptidase 54
  ENSP ID: ENSP00000402435
MSWKRNYFSGGRGSVQGMFAPRSSTSIAPSKGLSNEPGQNSCFLNSALQVLWHLDIFRRSFRQLTTHKCMGDSCIFCALKGIFNQFQCSSEKVLPSDTLRSALAKTFQDEQRFQLGIMDDAAECFLFFRVTDDRAKQSELYLV

SEQ ID NO: 95025 - protein, 358 aa, Homo sapiens
  Payload ID: 18949
  Gene Name: ubiquitin specific peptidase 54
  ENSP ID: ENSP00000404644
  MOD_RES (1)..(1): Any amino acid
XLTDSECNQKHTSKKGSLIERKRSSGRVRRKGDEPQASGYHSEGETLKEKQAPRNASKPSSSTNRLRDFKETVSNMIHNRPSLASQTNVGSHCRGRGGDQPDKKPPRTLPLHSRDWEIESTSSESKSSSSSKYRPTWRPKRESLNIDSIFSKDKRKHCGYTQLSPFSEDSAKEFIPDEPSKPPSYDIKFGGPSPQYKRWGPARPGSHLLEQHPRLIQRMESGYESSERNSSSPVSLDAALPESSNVYRDPSAKRSAGLVPSWRHIPKSHSSSILEVDSTASMGGWTKSQPFSGEEISSKSELDELQEEVARRAQEQELRRKREKELEAAKGFNPHPSRFMDLDELQNQVNSLSRSKYC

SEQ ID NO: 95026 - protein, 153 aa, Homo sapiens
  Payload ID: 18949
  Gene Name: ubiquitin specific peptidase 54
  ENSP ID: ENSP00000404710
MSWKRNYFSGGRGSVQGMFAPRSSTSIAPSKGLSNEPGQNSCFLNSALQVLWHLDIFRRSFRQLTTHKCMGDSCIFCALKGIFNQFQCSSEKVLPSDTLRSALAKTFQDEQRFQLGIMDDAAECFENLLMRIHFHIADETKEDICTAQHCISH

SEQ ID NO: 95027 - protein, 80 aa, Homo sapiens
  Payload ID: 18949
  Gene Name: ubiquitin specific peptidase 54
  ENSP ID: ENSP00000407245
MSWKRNYFSGGRGSVQGMFAPRSSTSIAPSKGLSNEPGQNSCFLNSALQVLWHLDIFRRSFRQLTTHKCMGDSCIFCALK

SEQ ID NO: 95028 - protein, 725 aa, Homo sapiens
  Payload ID: 18949
  Gene Name: ubiquitin specific peptidase 54
  Uniprot ID: Q70EL1
  ENSP ID: ENSP00000407368
MDTEFGASSFFHSPASCHESHSSLSPESSAPQHSSPSRSALKLLTSVEVDNIEPSAFHRQGLPKAPGWTEKNSHHSWEPLDAPEGKLQGSRCDNSSCSKLPPQEGRGIAQEQLFQEKKDPANPSPVMPGIATSERGDEHSLGCSPSNSSAQPSLPLYRTCHPIMPVASSFVLHCPDPVQKTNQCLQGQSLKTSLTLKVDRGSEETYRPEFPSTKGLVRSLAEQFQRMQGVSMRDSTGFKDRSLSGSLRKNSSPSDSKPPFSQGQEKGHWPWAKQQSSLEGGDRPLSWEESTEHSSLALNSGLPNGETSSGGQPRLAEPDIYQEKLSQVRDVRSKDLGSSTDLGTSLPLDSWVNITRFCDSQLKHGAPRPGMKSSPHDSHTCVTYPERNHILLHPHWNQDTEQETSELESLYQASLQASQAGCSGWGQQDTAWHPLSQTGSADGMGRRLHSAHDPGLSKTSTAEMEHGLHEARTVRTSQDSSNVRKPLETGHRCSSSSSLPVIHDPSVFLLGPQLYLPQPQFLSPDVLMPTMAGEPNRLPGTSRSVQQFLAMCDRGETSQGAKYTGRTLNYQSLPHRSRTDNSWAPWSETNQHIGTRFLTTPGCNPQLTYTATLPERSKGLQVPHTQSWSDLFHSPSHPPIVHPVYPPSSSLHVPLRSAWNSDPVPGSRTPGPRRVDMPPDDDWRQSSYASHSGHRRTVGEGFLFVLSDAPRREQIRARVLQHSQW

SEQ ID NO: 95029 - protein, 412 aa, Homo sapiens
  Payload ID: 18949
  Gene Name: ubiquitin specific peptidase 54
  ENSP ID: ENSP00000473466
  MOD_RES (1)..(1): Any amino acid
XREPSISSDTRTDSSTESYPYKHSHHESVVSHFSSDSQGTVIYNVENDSMSQSSRDTGETLKEKQAPRNASKPSSSTNRLRDFKETVSNMIHNRPSLASQTNVGSHCRGRGGDQPDKKPPRTLPLHSRDWEIESTSSESKSSSSSKYRPTWRPKRESLNIDSIFSKDKRKHCGYTQLSPFSEDSAKEFIPDEPSKPPSYDIKFGGPSPQYKRWGPARPGSHLLEQHPRLIQRMESGYESSERNSSSPVSLDAALPESSNVYRDPSAKRSAGLVPSWRHIPKSHSSSILEVDSTASMGGWTKSQPFSGEEISSKSELDELQEEVARRAQEQELRRKREKELEAAKGFNPHPSRFMDLDELQNQGRSDGFERSLQEAESVFEESLHLEQKGDCAAALALCNEAILNSLSRSKYC

SEQ ID NO: 95030 - protein, 1406 aa, Homo sapiens
  Payload ID: 18950
  Gene Name: ubiquitin specific peptidase 6
  Uniprot ID: P35125
  ENSP ID: ENSP00000250066
MDMVENADSLQAQERKDILMKYDKGHRAGLPEDKGPEPVGINSSIDRFGILHETELPPVTAREAKKIRREMTRTSKWMEMLGEWETYKHSSKLIDRVYKGIPMNIRGPVWSVLLNIQEIKLKNPGRYQIMKERGKRSSEHIHHIDLDVRTTLRNHVFFRDRYGAKQRELFYILLAYSEYNPEVGYCRDLSHITALFLLYLPEEDAFWALVQLLASERHSLPGFHSPNGGTVQGLQDQQEHVVPKSQPKTMWHQDKEGLCGQCASLGCLLRNLIDGISLGLTLRLWDVYLVEGEQVLMPITSIALKVQQKRLMKTSRCGLWARLRNQFFDTWAMNDDTVLKHLRASTKKLTRKQGDLPPPAKREQGSLAPRPVPASRGGKTLCKGYRQAPPGPPAQFQRPICSASPPWASRFSTPCPGGAVREDTYPVGTQGVPSLALAQGGPQGSWRFLEWKSMPRLPTDLDIGGPWFPHYDFEWSCWVRAISQEDQLATCWQAEHCGEVHNKDMSWPEEMSFTANSSKIDRQKVPTEKGATGLSNLGNTCFMNSSIQCVSNTQPLTQYFISGRHLYELNRTNPIGMKGHMAKCYGDLVQELWSGTQKSVAPLKLRRTIAKYAPKFDGFQQQDSQELLAFLLDGLHEDLNRVHEKPYVELKDSDGRPDWEVAAEAWDNHLRRNRSIIVDLFHGQLRSQVKCKTCGHISVRFDPFNFLSLPLPMDSYMDLEITVIKLDGTTPVRYGLRLNMDEKYTGLKKQLRDLCGLNSEQILLAEVHDSNIKNFPQDNQKVQLSVSGFLCAFEIPVPSSPISASSPTQIDFSSSPSTNGMFTLTTNGDLPKPIFIPNGMPNTVVPCGTEKNFTNGMVNGHMPSLPDSPFTGYIIAVHRKMMRTELYFLSPQENRPSLFGMPLIVPCTVHTRKKDLYDAVWIQVSWLARPLPPQEASIHAQDRDNCMGYQYPFTLRVVQKDGNSCAWCPQYRFCRGCKIDCGEDRAFIGNAYIAVDWHPTALHLRYQTSQERVVDKHESVEQSRRAQAEPINLDSCLRAFTSEEELGESEMYYCSKCKTHCLATKKLDLWRLPPFLIIHLKRFQFVNDQWIKSQKIVRFLRESFDPSAFLVPRDPALCQHKPLTPQGDELSKPRILAREVKKVDAQSSAGKEDMLLSKSPSSLSANISSSPKGSPSSSRKSGTSCPSSKNSSPNSSPRTLGRSKGRLRLPQIGSKNKPSSSKKNLDASKENGAGQICELADALSRGHMRGGSQPELVTPQDHEVALANGFLYEHEACGNGCGDGYSNGQLGNHSEEDSTDDQREDTHIKPIYNLYAISCHSGILSGGHYITYAKNPNCKWYCYNDSSCEELHPDEIDTDSAYILFYEQQGIDYAQFLPKIDGKKMADTSSTDEDSESDYEKYSMLQ

SEQ ID NO: 95031 - protein, 1406 aa, Homo sapiens; identical to SEQ ID NO: 95030
  Payload ID: 18950
  Gene Name: ubiquitin specific peptidase 6
  Uniprot ID: P35125
  ENSP ID: ENSP00000460380

SEQ ID NO: 95032 - protein, 786 aa, Homo sapiens
  Payload ID: 18950
  Gene Name: ubiquitin specific peptidase 6
  Uniprot ID: P35125
  ENSP ID: ENSP00000461581
MDMVENADSLQAQERKDILMKYDKGHRAGLPEDKGPEPVGINSSIDRFGILHETELPPVTAREAKKIRREMTRTSKWMEMLGEWETYKHSSKLIDRVYKGIPMNIRGPVWSVLLNIQEIKLKNPGRYQIMKERGKRSSEHIHHIDLDVRTTLRNHVFFRDRYGAKQRELFYILLAYSEYNPEVGYCRDLSHITALFLLYLPEEDAFWALVQLLASERHSLPGFHSPNGGTVQGLQDQQEHVVPKSQPKTMWHQDKEGLCGQCASLGCLLRNLIDGISLGLTLRLWDVYLVEGEQVLMPITSIALKVQQKRLMKTSRCGLWARLRNQFFDTWAMNDDTVLKHLRASTKKLTRKQGDLPPPAKREQGSLAPRPVPASRGGKTLCKGYRQAPPGPPAQFQRPICSASPPWASRFSTPCPGGAVREDTYPVGTQGVPSLALAQGGPQGSWRFLEWKSMPRLPTDLDIGGPWFPHYDFEWSCWVRAISQEDQLATCWQAEHCGEVHNKDMSWPEEMSFTANSSKIDRQKVPTEKGATGLSNLGNTCFMNSSIQCVSNTQPLTQYFISGRHLYELNRTNPIGMKGHMAKCYGDLVQELWSGTQKSVAPLKLRRTIAKYAPKFDGFQQQDSQELLAFLLDGLHEDLNRVHEKPYVELKDSDGRPDWEVAAEAWDNHLRRNRSIIVDLFHGQLRSQVKCKTCGHISVRFDPFNFLSLPLPMDSYMDLEITVIKLDGTTPVRYGLRLNMDEKYTGLKKQLRDLCGLNSEQILLAEVHDSNIKISPLHHLQMECSP

SEQ ID NO: 95033 - protein, 376 aa, Homo sapiens
  Payload ID: 18950
  Gene Name: ubiquitin specific peptidase 6
  ENSP ID: ENSP00000461817
MDMVENADSLQAQERKDILMKYDKGHRAGLPEDKGPEPVGINSSIDRFGILHETELPPVTAREAKKIRREMTRTSKWMEMLGEWETYKHSSKLIDRVYKGIPMNIRGPVWSVLLNIQEIKLKNPGRYQIMKERGKRSSEHIHHIDLDVRTTLRNHVFFRDRYGAKQRELFYILLAYSEYNPEVGYCRDLSHITALFLLYLPEEDAFWALVQLLASERHSLPGFHSPNGGTVQGLQDQQEHVVPKSQPKTMWHQDKEGLCGQCASLGCLLRNLIDGISLGLTLRLWDVYLVEGEQVLMPITSIALKVQQKRLMKTSRCGLWARLRNQFFDTWAMNDDTVLKHLRASTKKLTRKQGDLPPPGPTALGRRCVAGSPQPV

SEQ ID NO: 95034 - protein, 1102 aa, Homo sapiens
  Payload ID: 18951
  Gene Name: ubiquitin specific peptidase 7 (herpes virus-associated)
  Uniprot ID: Q93009
  ENSP ID: ENSP00000343535
MNHQQQQQQQKAGEQQLSEPEDMEMEAGDTDDPPRITQNPVINGNVALSDGHNTAEEDMEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQVAKTVAQRLNTDPMLLQFFKSQGYRDGPGNPLRHNYEGTLRDLLQFFKPRQPKKLYYQQLKMKITDFENRRSFKCIWLNSQFREEEITLYPDKHGCVRDLLEECKKAVELGEKASGKLRLLEIVSYKIIGVHQEDELLECLSPATSRTFRIEEIPLDQVDIDKENEMLVTVAHFHKEVFGTFGIPFLLRIHQGEHFREVMKRIQSLLDIQEKEFEKFKFAIVMMGRHQYINEDEYEVNLKDFEPQPGNMSHPRPWLGLDHFNKAPKRSRYTYLEKAIKIHN

SEQ ID NO: 95035 - protein, 1086 aa, Homo sapiens
  Payload ID: 18951
  Gene Name: ubiquitin specific peptidase 7 (herpes virus-associated)
  Uniprot ID: Q93009
  ENSP ID: ENSP00000371310
MAGNHRLGLEAGDTDDPPRITQNPVINGNVALSDGHNTAEEDMEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQVAKTVAQRLNTDPMLLQFFKSQGYRDGPGNPLRHNYEGTLRDLLQFFKPRQPKKLYYQQLKMKITDFENRRSFKCIWLNSQFREEEITLYPDKHGCVRDLLEECKKAVELGEKASGKLRLLEIVSYKIIGVHQEDELLECLSPATSRTFRIEEIPLDQVDIDKENEMLVTVAHFHKEVFGTFGIPFLLRIHQGEHFREVMKRIQSLLDIQEKEFEKFKFAIVMMGRHQYINEDEYEVNLKDFEPQPGNMSHPRPWLGLDHFNKAPKRSRYTYLEKAIKIHN

SEQ ID NO: 95036 - protein, 509 aa, Homo sapiens
  Payload ID: 18951
  Gene Name: ubiquitin specific peptidase 7 (herpes virus-associated)
  ENSP ID: ENSP00000439272
MEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLTVGGAITRREKDRGSEAEGAAGSPSLYASADSRRGPVLWPPRE

SEQ ID NO: 95037 - protein, 91 aa, Homo sapiens
  Payload ID: 18951
  Gene Name: ubiquitin specific peptidase 7 (herpes virus-associated)
  ENSP ID: ENSP00000454362
MNHQQQQQQQKAGEQQLSEPEDMEMEAGDTDDPPRITQNPVINGNVALSDGHNTAEEDMEDDTSWRSEATFQFTVERFSRLSHGLAMHKQC

SEQ ID NO: 95038 - protein, 909 aa, Homo sapiens
  Payload ID: 18951
  Gene Name: ubiquitin specific peptidase 7 (herpes virus-associated)
  ENSP ID: ENSP00000454795
MVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQVAKTVAQRLNTDPMLLQFFKSQGYRDGPGNPLRHNYEGTLRDLLQFFKPRQPKKLYYQQLKMKITDFENRRSFKCIWLNSQFREEEITLYPDKHGCVRDLLEECKKAVELGEKASGKLRLLEIVSYKIIGVHQEDELLECLSPATSRTFRIEEIPLDQVDIDKENEMLVTVAHFHKEVFGTFGIPFL

SEQ ID NO: 95039 - protein, 159 aa, Homo sapiens
  Payload ID: 18951
  Gene Name: ubiquitin specific peptidase 7 (herpes virus-associated)
  ENSP ID: ENSP00000455719
MAACIRIKPDSKAGDTDDPPRITQNPVINGNVALSDGHNTAEEDMEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAW

SEQ ID NO: 95040 - protein, 130 aa, Homo sapiens
  Payload ID: 18951
  Gene Name: ubiquitin specific peptidase 7 (herpes virus-associated)
  ENSP ID: ENSP00000456150
MEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDK

SEQ ID NO: 95041 - protein, 47 aa, Homo sapiens
  Payload ID: 18951
  Gene Name: ubiquitin specific peptidase 7 (herpes virus-associated)
  ENSP ID: ENSP00000456258
MAGNHRLGLEAGDTDDPPRITQNPVINGNVALSDGHNTAEEDMEDGE

SEQ ID NO: 95042 - protein, 117 aa, Homo sapiens
  Payload ID: 18951
  Gene Name: ubiquitin specific peptidase 7 (herpes virus-associated)
  ENSP ID: ENSP00000457237
MEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSE

SEQ ID NO: 95043 - protein, 109 aa, Homo sapiens
  Payload ID: 18951
  Gene Name: ubiquitin specific peptidase 7 (herpes virus-associated)
  ENSP ID: ENSP00000457815
MEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGF

SEQ ID NO: 95044 - protein, 17 aa, Homo sapiens
  Payload ID: 18951
  Gene Name: ubiquitin specific peptidase 7 (herpes virus-associated)
  ENSP ID: ENSP00000458027
  MOD_RES (1)..(1): Any amino acid
XNYCGHIYTPISCKIRS

SEQ ID NO: 95045 - protein, 68 aa, Homo sapiens
  Payload ID: 18951
  Gene Name: ubiquitin specific peptidase 7 (herpes virus-associated)
  ENSP ID: ENSP00000459594
DPKTRSLNYCGHIYTPISCKIRMTLKMITVNYPPQRSISEISTTALMSFSVIKQSLMILDLWLRYQIE

SEQ ID NO: 95046 - protein, 1118 aa, Homo sapiens
  Payload ID: 18952
  Gene Name: ubiquitin specific peptidase 8
  Uniprot ID: P40818
  ENSP ID: ENSP00000302239
MPAVASVPKELYLSSSLKDLNKKTEVKPEKISTKSYVHSALKIFKTAEECRLDRDEERAYVLYMKYVTVYNLIKKRPDFKQQQDYFHSILGPGNIKKAVEEAERLSESLKLRYEEAEVRKKLEEKDRQEEAQRLQQKRQETGREDGGTLAKGSLENVLDSKDKTQKSNGEKNEKCETKEKGAITAKELYTMMTDKNISLIIMDARRMQDYQDSCILHSLSVPEEAISPGVTASWIEAHLPDDSKDTWKKRGNVEYVVLLDWFSSAKDLQIGTTLRSLKDALFKWESKTVLRNEPLVLEGGYENWLLCYPQYTTNAKVTPPPRRQNEEVSISLDFTYPSLEESIPSKPAAQTPPASIEVDENIELISGQNERMGPLNISTPVEPVAASKSDVSPIIQPVPSIKNVPQIDRTKKPAVKLPEEHRIKSESTNHEQQSPQSGKVIPDRSTKPVVFSPTLMLTDEEKARIHAETALLMEKNKQEKELRERQQEEQKEKLRKEEQEQKAKKKQEAEENEITEKQQKAKEEMEKKESEQAKKEDKETSAKRGKEITGVKRQSKSEHETSDAKKSVEDRGKRCPTPEIQKKSTGDVPHTSVTGDSGSGKPFKIKGQPESGILRTGTFREDTDDTERNKAQREPLTRARSEEMGRIVPGLPSGWAKFLDPITGTFRYYHSPTNTVHMYPPEMAPSSAPPSTPPTHKAKPQIPAERDREPSKLKRSYSSPDITQAIQEEEKRKPTVTPTVNRENKPTCYPKAEISRLSASQIRNLNPVFGGSGPALTGLRNLGNTCYMNSILQCLCNAPHLADYFNRNCYQDDINRSNLLGHKGEVAEEFGIIMKALWTGQYRYISPKDFKITIGKINDQFAGYSQQDSQELLLFLMDGLHEDLNKADNRKRYKEENNDHLDDFKAAEHAWQKHKQLNESIIVALFQGQFKSTVQCLTCHKKSRTFEAFMYLSLPLASTSKCTLQDCLRLFSKEEKLTDNNRFYCSHCRARRDSLKKIEIWKLPPVLLVHLKRFSYDGRWKQKLQTSVDFPLENLDLSQYVIGPKNNLKKYNLFSVSNHYGGLDGGHYTAYCKNAARQRWFKFDDHEVSDISVSSVKSSAAYILFYTSLGPRVTDVAT

SEQ ID NO: 95047 - protein, 1118 aa, Homo sapiens; identical to SEQ ID NO: 95046
  Payload ID: 18952
  Gene Name: ubiquitin specific peptidase 8
  Uniprot ID: P40818
  ENSP ID: ENSP00000379721

SEQ ID NO: 95048 - protein, 1012 aa, Homo sapiens
  Payload ID: 18952
  Gene Name: ubiquitin specific peptidase 8
  Uniprot ID: P40818
  ENSP ID: ENSP00000412682
MPAVASVPKELYLSSSLKDLNKKTEVKPEKISTKRYEEAEVRKKLEEKDRQEEAQRLQQKRQETGREDGGTLAKGSLENVLDSKDKTQKSNGEKNEKCETKEKGAITAKELYTMMTDKNISLIIMDARRMQDYQDSCILHSLSVPEEAISPGVTASWIEAHLPDDSKDTWKKRGNVEYVVLLDWFSSAKDLQIGTTLRSLKDALFKWESKTVLRNEPLVLEGGYENWLLCYPQYTTNAKVTPPPRRQNEEVSISLDFTYPSLEESIPSKPAAQTPPASIEVDENIELISGQNERMGPLNISTPVEPVAASKSDVSPIIQPVPSIKNVPQIDRTKKPAVKLPEEHRIKSESTNHEQQSPQSGKVIPDRSTKPVVFSPTLMLTDEEKARIHAETALLMEKNKQEKELRERQQEEQKEKLRKEEQEQKAKKKQEAEENEITEKQQKAKEEMEKKESEQAKKEDKETSAKRGKEITGVKRQSKSEHETSDAKKSVEDRGKRCPTPEIQKKSTGDVPHTSVTGDSGSGKAQREPLTRARSEEMGRIVPGLPSGWAKFLDPITGTFRYYHSPTNTVHMYPPEMAPSSAPPSTPPTHKAKPQIPAERDREPSKLKRSYSSPDITQAIQEEEKRKPTVTPTVNRENKPTCYPKAEISRLSASQIRNLNPVFGGSGPALTGLRNLGNTCYMNSILQCLCNAPHLADYFNRNCYQDDINRSNLLGHKGEVAEEFGIIMKALWTGQYRYISPKDFKITIGKINDQFAGYSQQDSQELLLFLMDGLHEDLNKADNRKRYKEENNDHLDDFKAAEHAWQKHKQLNESIIVALFQGQFKSTVQCLTCHKKSRTFEAFMYLSLPLASTSKCTLQDCLRLFSKEEKLTDNNRFYCSHCRARRDSLKKIEIWKLPPVLLVHLKRFSYDGRWKQKLQTSVDFPLENLDLSQYVIGPKNNLKKYNLFSVSNHYGGLDGGHYTAYCKNAARQRWFKFDDHEVSDISVSSVKSSAAYILFYTSLGPRVTDVAT

SEQ ID NO: 95049 - protein, 136 aa, Homo sapiens
  Payload ID: 18952
  Gene Name: ubiquitin specific peptidase 8
  ENSP ID: ENSP00000452950
MPAVASVPKELYLSSSLKDLNKKTEVKPEKISTKSYVHSALKIFKTAEECRLDRDEERAYVLYMKYVTVYNLIKKRPDFKQQQDYFHSILGPGNIKKAVEEAERLSESLKLRAMVKRMKNVRPKRKEQSQQRNYTQ

SEQ ID NO: 95050 - protein, 96 aa, Homo sapiens
  Payload ID: 18952
  Gene Name: ubiquitin specific peptidase 8
  ENSP ID: ENSP00000453206
MPAVASVPKELYLSSSLKDLNKKTEVKPEKISTKSYVHSALKIFKTAEECRLDRDEERAYVLYMKYVTVYNLIKKRPDFKQQQDYFHSILGPGNIK

SEQ ID NO: 95051 - protein, 62 aa, Homo sapiens
  Payload ID: 18952
  Gene Name: ubiquitin specific peptidase 8
  ENSP ID: ENSP00000453320
MPAVASVPKELYLSSSLKDLNKKTEVKPEKISTKRIISIQYLDLETSKKLSKKLKDSLKALN

SEQ ID NO: 95052 - protein, 73 aa, Homo sapiens
  Payload ID: 18952
  Gene Name: ubiquitin specific peptidase 8
  ENSP ID: ENSP00000453427
MPAVASVPKELYLSSSLKDLNKKTEVKPEKISTKSYVHSALKIFKTAEECRLDRDEERAYVLYMKYVTVYNLI

SEQ ID NO: 95053 - protein, 125 aa, Homo sapiens
  Payload ID: 18952
  Gene Name: ubiquitin specific peptidase 8
  ENSP ID: ENSP00000453460
MPAVASVPKELYLSSSLKDLNKKTEVKPEKISTKSYVHSALKIFKTAEECRLDRDEERAYVLYMKYVTVYNLIKKRPDFKQQQDYFHSILGPGNIKKAVEEAERLSESLKLSGFYLSLIGRINSF

SEQ ID NO: 95054 - protein, 480 aa, Homo sapiens
  Payload ID: 18952
  Gene Name: ubiquitin specific peptidase 8
  ENSP ID: ENSP00000454003
MPAVASVPKELYLSSSLKDLNKKTEVKPEKISTKSYVHSALKIFKTAEECRLDRDEERAYVLYMKYVTVYNLIKKRPDFKQQQDYFHSILGPGNIKKAVEEAERLSESLKLRYEEAEVRKKLEEKDRQEEAQRLQQKRQETGREDGGTLAKGSLENVLDSKDKTQKSNGEKNEKCETKEKGAITAKELYTMMTDKNISLIIMDARRMQDYQDSCILHSLSVPEEAISPGVTASWIEAHLPDDSKDTWKKRGNVEYVVLLDWFSSAKDLQIGTTLRSLKDALFKWESKTVLRNEPLVLEGGYENWLLCYPQYTTNAKVTPPPRRQNEEVSISLDFTYPSLEESIPSKPAAQTPPASIEVDENIELISGQNERMGPLNISTPVEPVAASKSDVSPIIQPVPSIKNVPQIDRTKKPAVKLPEEHRIKSESTNHEQQSPQSGKVIPDRSTKPVVFSPTLMLTDEEKARIHAETALLMEKNKQEK

SEQ ID NO: 95055 - protein, 135 aa, Homo sapiens
  Payload ID: 18952
  Gene Name: ubiquitin specific peptidase 8
  ENSP ID: ENSP00000454059
MPAVASVPKELYLSSSLKDLNKKTEVKPEKISTKSYVHSALKIFKTAEECRLDRDEERAYVLYMKYVTVYNLIKKRPDFKQQQDYFHSILGPGNIKKAVEEAERLSESLKLRYEEAEVRKKLEEKDRQEEAQRLQ

SEQ ID NO: 95056 - protein, 62 aa, Homo sapiens; identical to SEQ ID NO: 95051
  Payload ID: 18952
  Gene Name: ubiquitin specific peptidase 8
  ENSP ID: ENSP00000457345

SEQ ID NO: 95057 - protein, 62 aa, Homo sapiens; identical to SEQ ID NO: 95051
  Payload ID: 18952
  Gene Name: ubiquitin specific peptidase 8
  ENSP ID: ENSP00000485810

SEQ ID NO: 95058 - protein, 2570 aa, Homo sapiens
  Payload ID: 18953
  Gene Name: ubiquitin specific peptidase 9, X-linked
  Uniprot ID: Q93008
  ENSP ID: ENSP00000316357
MTATTRGSPVGGNDNQGQAPDGQSQPPLQQNQTSSPDSSNENSPATPPDEQGQGDAPPQLEDEEPAFPHTDLAKLDDMINRPRWVVPVLPKGELEVLLEAAIDLSKKGLDVKSEACQRFFRDGLTISFTKILTDEAVSGWKFEIHRCIINNTHRLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHLFDCFKASWTNASKKQREKLLELIRRLAEDDKDGVMAHKVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLLNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGSTKYRLVGVLVHSGQASGGHYYSYIIQRNGGDGERNRWYKFDDGDVTECKMDDDEEMKNQCFGGEYMGEVFDHMMKRMSYRRQKRWWNAYILFYERMDTIDQDDELIRYISELAITTRPHQIIMPSAIERSVRKQNVQFMHNRMQYSMEYFQFMKKLLTCNGVYLNPPPGQDHLLPEAEEITMISIQLAARFLFTTGFHTKKVVRGSASDWYDALCILLRHSKNVRFWFAHNVLFNVSNRFSEYLLECPSAEVRGAFAKLIVFIAHFSLQDGPCPSPFASPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYTYELRPYLDLLLQILLIEDSWQTHRIHNALKGIPDDRDGLFDTIQRSKNHYQKRAYQCIKCMVALFSNCPVAYQILQGNGDLKRKWTWAVEWLGDELERRPYTGNPQYTYNNWSPPVQSNETSNGYFLERSHSARMTLAKACELCPEEVKKATSVQQIEMEESKEPDDQDAPDEHESPPPEDAPLYPHSPGSQYQQNNHVHGQPYTGPAAHHMNNPQRTGQRAQENYEGSEEVSPPQTKDQ

SEQ ID NO: 95059 - protein, 2554 aa, Homo sapiens
  Payload ID: 18953
  Gene Name: ubiquitin specific peptidase 9, X-linked
  Uniprot ID: Q93008
  ENSP ID: ENSP00000367558
MTATTRGSPVGGNDNQGQAPDGQSQPPLQQNQTSSPDSSNENSPATPPDEQGQGDAPPQLEDEEPAFPHTDLAKLDDMINRPRWVVPVLPKGELEVLLEAAIDLSKKGLDVKSEACQRFFRDGLTISFTKILTDEAVSGWKFEIHRCIINNTHRLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHLFDCFKASWTNASKKQREKLLELIRRLAEDDKDGVMAHKVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLLNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGSTKYRLVGVLVHSGQASGGHYYSYIIQRNGGDGERNRWYKFDDGDVTECKMDDDEEMKNQCFGGEYMGEVFDHMMKRMSYRRQKRWWNAYILFYERMDTIDQDDELIRYISELAITTRPHQIIMPSAIERSVRKQNVQFMHNRMQYSMEYFQFMKKLLTCNGVYLNPPPGQDHLLPEAEEITMISIQLAARFLFTTGFHTKKVVRGSASDWYDALCILLRHSKNVRFWFAHNVLFNVSNRFSEYLLECPSAEVRGAFAKLIVFIAHFSLQDGPCPSPFASPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYTYELRPYLDLLLQILLIEDSWQTHRIHNALKGIPDDRDGLFDTIQRSKNHYQKRAYQCIKCMVALFSNCPVAYQILQGNGDLKRKWTWAVEWLGDELERRPYTGNPQYTYNNWSPPVQSNETSNGYFLERSHSARMTLAKACELCPEEEPDDQDAPDEHESPPPEDAPLYPHSPGSQYQQNNHVHGQPYTGPAAHHMNNPQRTGQRAQENYEGSEEVSPPQTKDQ

SEQ ID NO: 95060 - protein, 46 aa, Homo sapiens
  Payload ID: 18953
  Gene Name: ubiquitin specific peptidase 9, X-linked
  ENSP ID: ENSP00000420570
  MOD_RES (1)..(1): Any amino acid
XILWKAKKMHKVIVVEHLVYRGTFPACSKKEVLEELFVRWHRSSSF

SEQ ID NO: 95061 - protein, 2555 aa, Homo sapiens
  Payload ID: 18954
  Gene Name: ubiquitin specific peptidase 9, Y-linked
  Uniprot ID: O00507
  ENSP ID: ENSP00000342812
MTAITHGSPVGGNDSQGQVLDGQSQHLFQQNQTSSPDSSNENSVATPPPEEQGQGDAPPQHEDEEPAFPHTELANLDDMINRPRWVVPVLPKGELEVLLEAAIDLSVKGLDVKSEACQRFFRDGLTISFTKILMDEAVSGWKFEIHRCIINNTHRLVELCVAKLSQDWFPLLELLAMALNPHCKFHIYNGTRPCELISSNAQLPEDELFARSSDPRSPKGWLVDLINKFGTLNGFQILHDRFFNGSALNIQIIAALIKPFGQCYEFLSQHTLKKYFIPVIEIVPHLLENLTDEELKKEAKNEAKNDALSMIIKSLKNLASRISGQDETIKNLEIFRLKMILRLLQISSFNGKMNALNEINKVISSVSYYTHRHSNPEEEEWLTAERMAEWIQQNNILSIVLQDSLHQPQYVEKLEKILRFVIKEKALTLQDLDNIWAAQAGKHEAIVKNVHDLLAKLAWDFSPGQLDHLFDCFKASWTNASKKQREKLLELIRRLAEDDKDGVMAHKVLNLLWNLAQSDDVPVDIMDLALSAHIKILDYSCSQDRDAQKIQWIDHFIEELRTNDKWVIPALKQIREICSLFGEASQNLSQTQRSPHIFYRHDLINQLQQNHALVTLVAENLATYMNSIRLYAGDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCRERKLIAKRRSYMMDDLELIGLDYLWRVVIQSSDEIANRAIDLLKEIYTNLGPRLKANQVVIHEDFIQSCFDRLKASYDTLCVFDGDKNSINCARQEAIRMVRVLTVIKEYINECDSDYHKERMILPMSRAFRGKHLSLIVRFPNQGRQVDELDIWSHTNDTIGSVRRCIVNRIKANVAHKKIELFVGGELIDSEDDRKLIGQLNLKDKSLITAKLTQINFNMPSSPDSSSDSSTASPGNHRNHYNDGPNLEVESCLPGVIMSVHPRYISFLWQVADLGSNLNMPPLRDGARVLMKLMPPDRTAVEKLRAVCLDHAKLGEGKLSPPLDSLFFGPSASQVLYLTEVVYALLMPAGVPLTDGSSDFQVHFLKSGGLPLVLSMLIRNNFLPNTDMETRRGAYLNALKIAKLLLTAIGYGHVRAVAEACQPVVDGTDPITQINQVTHDQAVVLQSALQSIPNPSSECVLRNESILLAQEISNEASRYMPDICVIRAIQKIIWASACGALGLVFSPNEEITKIYQMTTNGSNKLEVEDEQVCCEALEVMTLCFALLPTALDALSKEKAWQTFIIDLLLHCPSKTVRQLAQEQFFLMCTRCCMGHRPLLFFITLLFTILGSTAREKGKYSGDYFTLLRHLLNYAYNGNINIPNAEVLLVSEIDWLKRIRDNVKNTGETGVEEPILEGHLGVTKELLAFQTSEKKYHFGCEKGGANLIKELIDDFIFPASKVYLQYLRSGELPAEQAIPVCSSPVTINAGFELLVALAIGCVRNLKQIVDCLTEMYYMGTAITTCEALTEWEYLPPVGPRPPKGFVGLKNAGATCYMNSVIQQLYMIPSIRNSILAIEGTGSDLHDDMFGDEKQDSESNVDPRDDVFGYPHQFEDKPALSKTEDRKEYNIGVLRHLQVIFGHLAASQLQYYVPRGFWKQFRLWGEPVNLREQHDALEFFNSLVDSLDEALKALGHPAILSKVLGGSFADQKICQGCPHRYECEESFTTLNVDIRNHQNLLDSLEQYIKGDLLEGANAYHCEKCDKKVDTVKRLLIKKLPRVLAIQLKRFDYDWERECAIKFNDYFEFPRELDMGPYTVAGVANLERDNVNSENELIEQKEQSDNETAGGTKYRLVGVLVHSGQASGGHYYSYIIQRNGKDDQTDHWYKFDDGDVTECKMDDDEEMKNQCFGGEYMGEVFDHMMKRMSYRRQKRWWNAYILFYEQMDMIDEDDEMIRYISELTIARPHQIIMSPAIERSVRKQNVKFMHNRLQYSLEYFQFVKKLLTCNGVYLNPAPGQDYLLPEAEEITMISIQLAARFLFTTGFHTKKIVRGPASDWYDALCVLLRHSKNVRFWFTHNVLFNVSNRFSEYLLECPSAEVRGAFAKLIVFIAHFSLQDGSCPSPFASPGPSSQACDNLSLSDHLLRATLNLLRREVSEHGHHLQQYFNLFVMYANLGVAEKTQLLKLNVPATFMLVSLDEGPGPPIKYQYAELGKLYSVVSQLIRCCNVSSTMQSSINGNPPLPNPFGDLNLSQPIMPIQQNVLDILFVRTSYVKKIIEDCSNSEDTIKLLRFCSWENPQFSSTVLSELLWQVAYSYTYELRPYLDLLFQILLIEDSWQTHRIHNALKGIPDDRDGLFDTIQRSKNHYQKRAYQCIKCMVALFSSCPVAYQILQGNGDLKRKWTWAVEWLGDELERRPYTGNPQYSYNNWSPPVQSNETANGYFLERSHSARMTLAKACELCPEEEPDDQDAPDEHEPSPSEDAPLYPHSPASQYQQNNHVHGQPYTGPAAHHLNNPQKTGQRTQENYEGNEEVSSPQMKDQ

SEQ ID NO: 95062 - protein, 237 aa, Homo sapiens
  Payload ID: 18954
  Gene Name: ubiquitin specific peptidase 9, Y-linked
  ENSP ID: ENSP00000406876
  MOD_RES (1)..(1): Any amino acid
XLLKTAVTQRIPSNYFAFALGRILSSHLLSSANFSGRIHNALKGIPDDRDGLFDTIQRSKNHYQKRAYQCIKCMVALFSSCPVAYQILQGNGDLKRKWTWAVEWLGDELERRPYTGNPQYSYNNWSPPVQSNETANGYFLERSHSARMTLAKACELCPEEEPDDQDAPDEHEPSPSEDAPLYPHSPASQYQQNNHVHGQPYTGPAAHHLNNPQKTGQRTQENYEGNEEVSSPQMKDQ

SEQ ID NO: 95063 - protein, 1092 aa, Homo sapiens
  Payload ID: 18955
  Gene Name: ubiquitin specific peptidase like 1
  Uniprot ID: Q5W0Q7
  ENSP ID: ENSP00000255304
MMDSPKIGNGLPVIGPGTDIGISSLHMVGYLGKNFDSAKVPSDEYCPACREKGKLKALKTYRISFQESIFLCEDLQCIYPLGSKSLNNLISPDLEECHTPHKPQKRKSLESSYKDSLLLANSKKTRNYIAIDGGKVLNSKHNGEVYDETSSNLPDSSGQQNPIRTADSLERNEILEADTVDMATTKDPATVDVSGTGRPSPQNEGCTSKLEMPLESKCTSFPQALCVQWKNAYALCWLDCILSALVHSEELKNTVTGLCSKEESIFWRLLTKYNQANTLLYTSQLSGVKDGDCKKLTSEIFAEIETCLNEVRDEIFISLQPQLRCTLGDMESPVFAFPLLLKLETHIEKLFLYSFSWDFECSQCGHQYQNRHMKSLVTFTNVIPEWHPLNAAHFGPCNNCNSKSQIRKMVLEKVSPIFMLHFVEGLPQNDLQHYAFHFEGCLYQITSVIQYRANNHFITWILDADGSWLECDDLKGPCSERHKKFEVPASEIHIVIWERKISQVTDKEAACLPLKKTNDQHALSNEKPVSLTSCSVGDAASAETASVTHPKDISVAPRTLSQDTAVTHGDHLLSGPKGLVDNILPLTLEETIQKTASVSQLNSEAFLLENKPVAENTGILKTNTLLSQESLMASSVSAPCNEKLIQDQFVDISFPSQVVNTNMQSVQLNTEDTVNTKSVNNTDATGLIQGVKSVEIEKDAQLKQFLTPKTEQLKPERVTSQVSNLKKKETTADSQTTTSKSLQNQSLKENQKKPFVGSWVKGLISRGASFMPLCVSAHNRNTITDLQPSVKGVNNFGGFKTKGINQKASHVSKKARKSASKPPPISKPPAGPPSSNGTAAHPHAHAASEVLEKSGSTSCGAQLNHSSYGNGISSANHEDLVEGQIHKLRLKLRKKLKAEKKKLAALMSSPQSRTVRSENLEQVPQDGSPNDCESIEDLLNELPYPIDIASESACTTVPGVSLYSSQTHEEILAELLSPTPVSTELSENGEGDFRYLGMGDSHIPPPVPSEFNDVSQNTHLRQDHNYCSPTKKNPCEVQPDSLTNNACVRTLNLESPMKTDIFDEFFSSSALNALANDTLDLPHFDEYLFENY

SEQ ID NO: 95064 - protein, 763 aa, Homo sapiens
  Payload ID: 18955
  Gene Name: ubiquitin specific peptidase like 1
  Uniprot ID: Q5W0Q7
  ENSP ID: ENSP00000480656
MESPVFAFPLLLKLETHIEKLFLYSFSWDFECSQCGHQYQNRHMKSLVTFTNVIPEWHPLNAAHFGPCNNCNSKSQIRKMVLEKVSPIFMLHFVEGLPQNDLQHYAFHFEGCLYQITSVIQYRANNHFITWILDADGSWLECDDLKGPCSERHKKFEVPASEIHIVIWERKISQVTDKEAACLPLKKTNDQHALSNEKPVSLTSCSVGDAASAETASVTHPKDISVAPRTLSQDTAVTHGDHLLSGPKGLVDNILPLTLEETIQKTASVSQLNSEAFLLENKPVAENTGILKTNTLLSQESLMASSVSAPCNEKLIQDQFVDISFPSQVVNTNMQSVQLNTEDTVNTKSVNNTDATGLIQGVKSVEIEKDAQLKQFLTPKTEQLKPERVTSQVSNLKKKETTADSQTTTSKSLQNQSLKENQKKPFVGSWVKGLISRGASFMPLCVSAHNRNTITDLQPSVKGVNNFGGFKTKGINQKASHVSKKARKSASKPPPISKPPAGPPSSNGTAAHPHAHAASEVLEKSGSTSCGAQLNHSSYGNGISSANHEDLVEGQIHKLRLKLRKKLKAEKKKLAALMSSPQSRTVRSENLEQVPQDGSPNDCESIEDLLNELPYPIDIASESACTTVPGVSLYSSQTHEEILAELLSPTPVSTELSENGEGDFRYLGMGDSHIPPPVPSEFNDVSQNTHLRQDHNYCSPTKKNPCEVQPDSLTNNACVRTLNLESPMKTDIFDEFFSSSALNALANDTLDLPHFDEYLFENY

SEQ ID NO: 95065 - protein, 1066 aa, Homo sapiens
  Payload ID: 18956
  Gene Name: ubiquitination factor E4A
  Uniprot ID: Q14139
  ENSP ID: ENSP00000252108
MTDQENNNNISSNPFAALFGSLADAKQFAAIQKEQLKQQSDELPASPDDSDNSVSESLDEFDYSVAEISRSFRSQQEICEQLNINHMIQRIFLITLDNSDPSLKSGNGIPSRCVYLEEMAVELEDQDWLDMSNVEQALFARLLLQDPGNHLINMTSSTTLNLSADRDAGERHIFCYLYSCFQRAKEEITKVPENLLPFAVQCRNLTVSNTRTVLLTPEIYVDQNIHEQLVDLMLEAIQGAHFEDVTEFLEEVIEALILDEEVRTFPEVMIPVFDILLGRIKDLELCQILLYAYLDILLYFTRQKDMAKVFVEYIQPKDPTNGQMYQKTLLGVILSISCLLKTPGVVENHGYFLNPSRSSPQEIKVQEANIHQFMAQFHEKIYQMLKNLLQLSPETKHCILSWLGNCLHANAGRTKIWANQMPEIFFQMYASDAFFLNLGAALLKLCQPFCKPRSSRLLTFNPTYCALKELNDEERKIKNVHMRGLDKETCLIPAVQEPKFPQNYNLVTENLALTEYTLYLGFHRLHDQMVKINQNLHRLQVAWRDAQQSSSPAADNLREQFERLMTIYLSTKTAMTEPQMLQNCLNLQVSMAVLLVQLAIGNEGSQPIELTFPLPDGYSSLAYVPEFFADNLGDFLIFLRRFADDILETSADSLEHVLHFITIFTGSIERMKNPHLRAKLAEVLEAVMPHLDQTPNPLVSSVFHRKRVFCNFQYAPQLAEALIKVFVDIEFTGDPHQFEQKFNYRRPMYPILRYMWGTDTYRESIKDLADYASKNLEAMNPPLFLRFLNLLMNDAIFLLDEAIQYLSKIKIQQIEKDRGEWDSLTPEARREKEAGLQMFGQLARFHNIMSNETIGTLAFLTSEIKSLFVHPFLAERIISMLNYFLQHLVGPKMGALKVKDFSEFDFKPQQLVSDICTIYLNLGDEENFCATVPKDGRSYSPTLFAQTVRVLKKINKPGNMIMAFSNLAERIKSLADLQQQEEETYADACDEFLDPIMSTLMCDPVVLPSSRVTVDRSTIARHLLSDQTDPFNRSPLTMDQIRPNTELKEKIQRWLAERKQQKEQLE

SEQ ID NO: 95066 - protein, 1073 aa, Homo sapiens
  Payload ID: 18956
  Gene Name: ubiquitination factor E4A
  Uniprot ID: Q14139
  ENSP ID: ENSP00000387362
MTDQENNNNISSNPFAALFGSLADAKQFAAIQKEQLKQQSDELPASPDDSDNSVSESLDEFDYSVAEISRSFRSQQEICEQLNINHMIQRIFLITLDNSDPSLKSGNGIPSRCVYLEEMAVELEDQDWLDMSNVEQALFARLLLQDPGNHLINMTSSTTLNLSADRDAGERHIFCYLYSCFQRAKEEITKVPENLLPFAVQCRNLTVSNTRTVLLTPEIYVDQNIHEQLVDLMLEAIQGAREYMNKIYFEDVTEFLEEVIEALILDEEVRTFPEVMIPVFDILLGRIKDLELCQILLYAYLDILLYFTRQKDMAKVFVEYIQPKDPTNGQMYQKTLLGVILSISCLLKTPGVVENHGYFLNPSRSSPQEIKVQEANIHQFMAQFHEKIYQMLKNLLQLSPETKHCILSWLGNCLHANAGRTKIWANQMPEIFFQMYASDAFFLNLGAALLKLCQPFCKPRSSRLLTFNPTYCALKELNDEERKIKNVHMRGLDKETCLIPAVQEPKFPQNYNLVTENLALTEYTLYLGFHRLHDQMVKINQNLHRLQVAWRDAQQSSSPAADNLREQFERLMTIYLSTKTAMTEPQMLQNCLNLQVSMAVLLVQLAIGNEGSQPIELTFPLPDGYSSLAYVPEFFADNLGDFLIFLRRFADDILETSADSLEHVLHFITIFTGSIERMKNPHLRAKLAEVLEAVMPHLDQTPNPLVSSVFHRKRVFCNFQYAPQLAEALIKVFVDIEFTGDPHQFEQKFNYRRPMYPILRYMWGTDTYRESIKDLADYASKNLEAMNPPLFLRFLNLLMNDAIFLLDEAIQYLSKIKIQQIEKDRGEWDSLTPEARREKEAGLQMFGQLARFHNIMSNETIGTLAFLTSEIKSLFVHPFLAERIISMLNYFLQHLVGPKMGALKVKDFSEFDFKPQQLVSDICTIYLNLGDEENFCATVPKDGRSYSPTLFAQTVRVLKKINKPGNMIMAFSNLAERIKSLADLQQQEEETYADACDEFLDPIMSTLMCDPVVLPSSRVTVDRSTIARHLLSDQTDPFNRSPLTMDQIRPNTELKEKIQRWLAERKQQKEQLE

SEQ ID NO: 95067 - protein, 538 aa, Homo sapiens
  Payload ID: 18956
  Gene Name: ubiquitination factor E4A
  ENSP ID: ENSP00000438918
MVKINQNLHRLQVAWRDAQQSSSPAADNLREQFERLMTIYLSTKTAMTEPQMLQNCLNLQVSMAVLLVQLAIGNEGSQPIELTFPLPDGYSSLAYVPEFFADNLGDFLIFLRRFADDILETSADSLEHVLHFITIFTGSIERMKNPHLRAKLAEVLEAVMPHLDQTPNPLVSSVFHRKRVFCNFQYAPQLAEALIKVFVDIEFTGDPHQFEQKFNYRRPMYPILRYMWGTDTYRESIKDLADYASKNLEAMNPPLFLRFLNLLMNDAIFLLDEAIQYLSKIKIQQIEKDRGEWDSLTPEARREKEAGLQMFGQLARFHNIMSNETIGTLAFLTSEIKSLFVHPFLAERIISMLNYFLQHLVGPKMGALKVKDFSEFDFKPQQLVSDICTIYLNLGDEENFCATVPKDGRSYSPTLFAQTVRVLKKINKPGNMIMAFSNLAERIKSLADLQQQEEETYADACDEFLDPIMSTLMCDPVVLPSSRVTVDRSTIARHLLSDQTDPFNRSPLTMDQIRPNTELKEKIQRWLAERKQQKEQLE

SEQ ID NO: 95068 - protein, 1173 aa, Homo sapiens
  Payload ID: 18957
  Gene Name: ubiquitination factor E4B
  Uniprot ID: O95155
  ENSP ID: ENSP00000253251
MEELSADEIRRRRLARLAGGQTSQPTTPLTSPQRENPPGPPIAASAPGPSQSLGLNVHNMTPATSPIGASGVAHRSQSSEGVSSLSSSPSNSLETQSQSLSRSQSMDIDGVSCEKSMSQVDVDSGIENMEVDENDRREKRSLSDKEPSSGPEVSEEQALQLVCKIFRVSWKDRDRDVIFLSSLSAQFKQNPKEVFSDFKDLIGQILMEVLMMSTQTRDENPFASLTATSQPIAAAARSPDRNLLLNTGSNPGTSPMFCSVASFGASSLSSLGASGGASNWDSYSDHFTIETCKETDMLNYLIECFDRVGIEEKKAPKMCSQPAVSQLLSNIRSQCISHTALVLQGSLTQPRSLQQPSFLVPYMLCRNLPYGFIQELVRTTHQDEEVFKQIFIPILQGLALAAKECSLDSDYFKYPLMALGELCETKFGKTHPVCNLVASLRLWLPKSLSPGCGRELQRLSYLGAFFSFSVFAEDDVKVVEKYFSGPAITLENTRVVSQSLQHYLELGRQELFKILHSILLNGETREAALSYMAAVVNANMKKAQMQTDDRLVSTDGFMLNFLWVLQQLSTKIKLETVDPTYIFHPRCRITLPNDETRVNATMEDVNDWLTELYGDQPPFSEPKFPTECFFLTLHAHHLSILPSCRRYIRRLRAIRELNRTVEDLKNNESQWKDSPLATRHREMLKRCKTQLKKLVRCKACADAGLLDESFLRRCLNFYGLLIQLLLRILDPAYPDITLPLNSDVPKVFAALPEFYVEDVAEFLFFIVQYSPQALYEPCTQDIVMFLVVMLCNQNYIRNPYLVAKLVEVMFMTNPAVQPRTQKFFEMIENHPLSTKLLVPSLMKFYTDVEHTGATSEFYDKFTIRYHISTIFKSLWQNIAHHGTFMEEFNSGKQFVRYINMLINDTTFLLDESLESLKRIHEVQEEMKNKEQWDQLPRDQQQARQSQLAQDERVSRSYLALATETVDMFHILTKQVQKPFLRPELGPRLAAMLNFNLQQLCGPKCRDLKVENPEKYGFEPKKLLDQLTDIYLQLDCARFAKAIADDQRSYSKELFEEVISKMRKAGIKSTIAIEKFKLLAEKVEEIVAKNARAEIDYSDAPDEFRDPLMDTLMTDPVRLPSGTIMDRSIILRHLLNSPTDPFNRQTLTESMLEPVPELKEQIQAWMREKQNSDH

SEQ ID NO: 95069 - protein, 1302 aa, Homo sapiens
  Payload ID: 18957
  Gene Name: ubiquitination factor E4B
  Uniprot ID: O95155
  ENSP ID: ENSP00000343001
MEELSADEIRRRRLARLAGGQTSQPTTPLTSPQRENPPGPPIAASAPGPSQSLGLNVHNMTPATSPIGASGVAHRSQSSEGVSSLSSSPSNSLETQSQSLSRSQSMDIDGVSCEKSMSQVDVDSGIENMEVDENDRREKRSLSDKEPSSGPEVSEEQALQLVCKIFRVSWKDRDRDVIFLSSLSAQFKQNPKEVFSDFKDLIGQILMEVLMMSTQTRDENPFASLTATSQPIAAAARSPDRNLLLNTGSNPGTSPMFCSVASFGASSLSSLYESSPAPTPSFWSSVPVMGPSLASPSRAASQLAVPSTPLSPHSAASGTAAGSQPSSPRYRPYTVTHPWASSGVSILSSSPSPPALASSPQAVPASSSRQRPSSTGPPLPPASPSATSRRPSSLRISPSLGASGGASNWDSYSDHFTIETCKETDMLNYLIECFDRVGIEEKKAPKMCSQPAVSQLLSNIRSQCISHTALVLQGSLTQPRSLQQPSFLVPYMLCRNLPYGFIQELVRTTHQDEEVFKQIFIPILQGLALAAKECSLDSDYFKYPLMALGELCETKFGKTHPVCNLVASLRLWLPKSLSPGCGRELQRLSYLGAFFSFSVFAEDDVKVVEKYFSGPAITLENTRVVSQSLQHYLELGRQELFKILHSILLNGETREAALSYMAAVVNANMKKAQMQTDDRLVSTDGFMLNFLWVLQQLSTKIKLETVDPTYIFHPRCRITLPNDETRVNATMEDVNDWLTELYGDQPPFSEPKFPTECFFLTLHAHHLSILPSCRRYIRRLRAIRELNRTVEDLKNNESQWKDSPLATRHREMLKRCKTQLKKLVRCKACADAGLLDESFLRRCLNFYGLLIQLLLRILDPAYPDITLPLNSDVPKVFAALPEFYVEDVAEFLFFIVQYSPQALYEPCTQDIVMFLVVMLCNQNYIRNPYLVAKLVEVMFMTNPAVQPRTQKFFEMIENHPLSTKLLVPSLMKFYTDVEHTGATSEFYDKFTIRYHISTIFKSLWQNIAHHGTFMEEFNSGKQFVRYINMLINDTTFLLDESLESLKRIHEVQEEMKNKEQWDQLPRDQQQARQSQLAQDERVSRSYLALATETVDMFHILTKQVQKPFLRPELGPRLAAMLNFNLQQLCGPKCRDLKVENPEKYGFEPKKLLDQLTDIYLQLDCARFAKAIADDQRSYSKELFEEVISKMRKAGIKSTIAIEKFKLLAEKVEEIVAKNARAEIDYSDAPDEFRDPLMDTLMTDPVRLPSGTIMDRSIILRHLLNSPTDPFNRQTLTESMLEPVPELKEQIQAWMREKQNSDH

SEQ ID NO: 95070 - protein, 100 aa, Homo sapiens
  Payload ID: 18957
  Gene Name: ubiquitination factor E4B
  ENSP ID: ENSP00000366358
MEELSADEIRRRRLARLAGGQTSQPTTPLTSPQRENPPGPPIAASAPGPSQSLGLNVHNMTPATSPIGASGLGIISDDKMIKTEFGSADFMNLVDGFKIK

SEQ ID NO: 95071 - protein, 276 aa, Homo sapiens
  Payload ID: 18957
  Gene Name: ubiquitination factor E4B
  ENSP ID: ENSP00000467258
  MOD_RES (1)..(1): Any amino acid
XTTHQDEEVFKQIFIPILQGLALAAKECSLDSDYFKYPLMALGELCETKFGKTHPVCNLVKVVEKYFSGPAITLENTRVVSQSLQHYLELGRQELFKILHSILLNGETREAALSYMAAVVNANMKKAQMQTDDRLVSTDGFMLNFLWVLQQLSTKIKLETVDPTYIFHPRCRITLPNDETRVNATMEDVNDWLTELYGDQPPFSEPKFPTECFFLTLHAHHLSILPSCRRYIRRLRAIRELNRTVEDLKNNESQWKDSPLATRHREMLKRCKTQLK

SEQ ID NO: 95072 - protein, 98 aa, Homo sapiens
  Payload ID: 18957
  Gene Name: ubiquitination factor E4B
  ENSP ID: ENSP00000468178
  MOD_RES (1)..(1): Any amino acid
XDVEHTGATSEFYDKFTIRYHISTIFKSLWQNIAHHGTFMEEFNSGKQFVRYINMLINDTTFLLDESLESLKRIHEVQEEMKNKEQWDQLPRSLQCST

SEQ ID NO: 95073 - protein, 170 aa, Homo sapiens
  Payload ID: 18958
  Gene Name: ubiquitin-conjugating enzyme E2 variant 1
  Uniprot ID: Q13404
  ENSP ID: ENSP00000340305
MPGEVQASYLKSQSKLSDEGRLEPRKFHCKGVKVPRNFRLLEELEEGQKGVGDGTVSWGLEDDEDMTLTRWTGMIIGPPRTIYENRIYSLKIECGPKYPEAPPFVRFVTKINMNGVNSSNGVVDPRAISVLAKWQNSYSIKVVLQELRRLMMSKENMKLPQPPEGQCYSN

SEQ ID NO: 95074 - protein, 105 aa, Homo sapiens
  Payload ID: 18958
  Gene Name: ubiquitin-conjugating enzyme E2 variant 1
  Uniprot ID: Q13404
  ENSP ID: ENSP00000360720
MAATTGSGVKVPRNFRLLEELEEGQKGVGDGTVSWGLEDDEDMTLTRWTGMIIGPPRVDPRAISVLAKWQNSYSIKVVLQELRRLMMSKENMKLPQPPEGQCYSN

SEQ ID NO: 95075 - protein, 147 aa, Homo sapiens
  Payload ID: 18958
  Gene Name: ubiquitin-conjugating enzyme E2 variant 1
  Uniprot ID: Q13404
  ENSP ID: ENSP00000360739
MAATTGSGVKVPRNFRLLEELEEGQKGVGDGTVSWGLEDDEDMTLTRWTGMIIGPPRTIYENRIYSLKIECGPKYPEAPPFVRFVTKINMNGVNSSNGVVDPRAISVLAKWQNSYSIKVVLQELRRLMMSKENMKLPQPPEGQCYSN

SEQ ID NO: 95076 - protein, 170 aa, Homo sapiens; identical to SEQ ID NO: 95073
  Payload ID: 18958
  Gene Name: ubiquitin-conjugating enzyme E2 variant 1
  Uniprot ID: Q13404
  ENSP ID: ENSP00000360742

SEQ ID NO: 95077 - protein, 103 aa, Homo sapiens [sequence omitted]

SEQ ID NO: 95078 - protein, 103 aa, Homo sapiens
  Payload ID: 18958
  Gene Name: ubiquitin-conjugating enzyme E2 variant 1
  Uniprot ID: Q13404
  ENSP ID: ENSP00000407770
MKEDLNLENFTAKTIYENRIYSLKIECGPKYPEAPPFVRFVTKINMNGVNSSNGVVDPRAISVLAKWQNSYSIKVVLQELRRLMMSKENMKLPQPPEGQCYSN

SEQ ID NO: 95079 - protein, 89 aa, Homo sapiens
  Payload ID: 18958
  Gene Name: ubiquitin-conjugating enzyme E2 variant 1
  ENSP ID: ENSP00000421351
MPGEVQASYLKSQSKLSDEGRLEPRKFHCKGVKVPRNFRLLEELEEGQKGVGDGTVSWGLEDDEDMTLTRWTGMIIGPPRFQFIYLNLL

SEQ ID NO: 95080 - protein, 105 aa, Homo sapiens
  Payload ID: 18958
  Gene Name: ubiquitin-conjugating enzyme E2 variant 1
  ENSP ID: ENSP00000450635
MTLTRWTGMIIGPPRTIYENRIYSLKIECGPKYPEAPPFVRFVTKINMNGVNSSNGVVDPRAISVLAKWQNSYSIKVVLQELRRLMMSKENMKLPQPPEGQCYSN

SEQ ID NO: 95081 - protein, 105 aa, Homo sapiens; identical to SEQ ID NO: 95080
  Payload ID: 18958
  Gene Name: ubiquitin-conjugating enzyme E2 variant 1
  ENSP ID: ENSP00000484828

SEQ ID NO: 95082 - protein, 105 aa, Homo sapiens; identical to SEQ ID NO: 95080
  Payload ID: 18958
  Gene Name: ubiquitin-conjugating enzyme E2 variant 1
  ENSP ID: ENSP00000485599

SEQ ID NO: 95083 - protein, 145 aa, Homo sapiens
  Payload ID: 18959
  Gene Name: ubiquitin-conjugating enzyme E2 variant 2
  Uniprot ID: Q15819
  ENSP ID: ENSP00000428209
MAVSTGVKVPRNFRLLEELEEGQKGVGDGTVSWGLEDDEDMTLTRWTGMIIGPPRTNYENRIYSLKVECGPKYPEAPPSVRFVTKINMNGINNSSGMVDARSIPVLAKWQNSYSIKVVLQELRRLMMSKENMKLPQPPEGQTYNN

SEQ ID NO: 95084 - protein, 105 aa, Homo sapiens
  Payload ID: 18959
  Gene Name: ubiquitin-conjugating enzyme E2 variant 2
  ENSP ID: ENSP00000428818
MTLTRWTGMIIGPPRTNYENRIYSLKVECGPKYPEAPPSVRFVTKINMNGINNSSGMVDARSIPVLAKWQNSYSIKVVLQELRRLMMSKENMKLPQPPEGQTYNN

SEQ ID NO: 95085 - protein, 105 aa, Homo sapiens; identical to SEQ ID NO: 95084
  Payload ID: 18959
  Gene Name: ubiquitin-conjugating enzyme E2 variant 2
  ENSP ID: ENSP00000429419

SEQ ID NO: 95086 - protein, 105 aa, Homo sapiens; identical to SEQ ID NO: 95084
  Payload ID: 18959
  Gene Name: ubiquitin-conjugating enzyme E2 variant 2
  ENSP ID: ENSP00000429886

SEQ ID NO: 95087 - protein, 109 aa, Homo sapiens
  Payload ID: 18959
  Gene Name: ubiquitin-conjugating enzyme E2 variant 2
  ENSP ID: ENSP00000430019
  MOD_RES (1)..(1): Any amino acid
XACVRAAASGCRRRWRSPQTNYENRIYSLKVECGPKYPEAPPSVRFVTKINMNGINNSSGMVDARSIPVLAKWQNSYSIKVVLQELRRLMMSKENMKLPQPPEGQTYNN

SEQ ID NO: 95088 - protein, 154 aa, Homo sapiens
  Payload ID: 18959
  Gene Name: ubiquitin-conjugating enzyme E2 variant 2
  ENSP ID: ENSP00000430491
  MOD_RES (1)..(1): Any amino acid
XLQEKMAVSTGVKVPRNFRLLEELEEGQKGVGDGTVSWGLEDDEDMTLTRWTGMIIGPPRTNYENRIYSLKVECGPKYPEAPPSVRFVTKINMNGINNSSGMSLTLSPRLEYNCAILAHCNLCLPASSDSPASTSRVAGITGTCHHAQLIFVFL

SEQ ID NO: 95089 - protein, 52 aa, Homo sapiens
  Payload ID: 18959
  Gene Name: ubiquitin-conjugating enzyme E2 variant 2
  ENSP ID: ENSP00000430741
  MOD_RES (1)..(1): Any amino acid
XVKVPRNFRLLEELEEGQKGVGDGTVSWGLEDDEDMTLTRWTGMIIGPPRLE

SEQ ID NO: 95090 - protein, 318 aa, Homo sapiens
  Payload ID: 18960
  Gene Name: ubiquitin-conjugating enzyme E2, J1
  Uniprot ID: Q9Y385
  ENSP ID: ENSP00000451261
METRYNLKSPAVKRLMKEAAELKDPTDHYHAQPLEDNLFEWHFTVRGPPDSDFDGGVYHGRIVLPPEYPMKPPSIILLTANGRFEVGKKICLSISGHHPETWQPSWSIRTALLAIIGFMPTKGEGAIGSLDYTPEERRALAKKSQDFCCEGCGSAMKDVLLPLKSGSDSSQADQEAKELARQISFKAEVNSSGKTISESDLNHSFSLTDLQDDIPTTFQGATASTSYGLQNSSAASFHQPTQPVAKNTSMSPRQRRAQQQSQRRLSTSPDVIQGHQPRDNHTDHGGSAVLIVILTLALAALIFRRIYLANEYIFDFEL

SEQ ID NO: 95091 - protein, 259 aa, Homo sapiens
  Payload ID: 18961
  Gene Name: ubiquitin-conjugating enzyme E2, J2
  Uniprot ID: Q8N2K1
  ENSP ID: ENSP00000305826
MSSTSSKRAPTTATQRLKQDYLRIKKDPVPYICAEPLPSNILEWHYVVRGPEMTPYEGGYYHGKLIFPREFPFKPPSIYMITPNGRFKCNTRLCLSITDFHPDTWNPAWSVSTILTGLLSFMVEKGPTLGSIETSDFTKRQLAVQSLAFNLKDKVFCELFPEVVEEIKQKQKAQDELSSRPQTLPLPDVVPDGETHLVQNGIQLLNGHAPGAVPNLAGLQQANRHHGLLGGALANLFVIVGFAAFAYTVKYVLRSIAQE

SEQ ID NO: 95092 - protein, 207 aa, Homo sapiens
  Payload ID: 18961
  Gene Name: ubiquitin-conjugating enzyme E2, J2
  ENSP ID: ENSP00000344857
MTPYEGGYYHGKLIFPREFPFKPPSIYMITPNGRFKCNTRLCLSITDFHPDTWNPAWSVSTILTGLLSFMVEKGPTLGSIETSDFTKRQLAVQSLAFNLKDKVFCELFPEVVEEIKQKQKAQDELSSRPQTLPLPDVVPDGETHLVQNGIQLLNGHAPGAVPNLAGLQQANRHHGLLGGALANLFVIVGFAAFAYTVKYVLRSIAQE

SEQ ID NO: 95093 - protein, 259 aa, Homo sapiens; identical to SEQ ID NO: 95091
  Payload ID: 18961
  Gene Name: ubiquitin-conjugating enzyme E2, J2
  Uniprot ID: Q8N2K1
  ENSP ID: ENSP00000353653

SEQ ID NO: 95094 - protein, 207 aa, Homo sapiens; identical to SEQ ID NO: 95092
  Payload ID: 18961
  Gene Name: ubiquitin-conjugating enzyme E2, J2
  ENSP ID: ENSP00000383718

SEQ ID NO: 95095 - protein, 275 aa, Homo sapiens
  Payload ID: 18961
  Gene Name: ubiquitin-conjugating enzyme E2, J2
  Uniprot ID: Q8N2K1
  ENSP ID: ENSP00000383719
MSSTSSKRAPTTATQRLKQDYLRIKKDPVPYICAEPLPSNILEWFKRFSWLSLLSSWDYRHYVVRGPEMTPYEGGYYHGKLIFPREFPFKPPSIYMITPNGRFKCNTRLCLSITDFHPDTWNPAWSVSTILTGLLSFMVEKGPTLGSIETSDFTKRQLAVQSLAFNLKDKVFCELFPEVVEEIKQKQKAQDELSSRPQTLPLPDVVPDGETHLVQNGIQLLNGHAPGAVPNLAGLQQANRHHGLLGGALANLFVIVGFAAFAYTVKYVLRSIAQE

SEQ ID NO: 95096 - protein, 196 aa, Homo sapiens
  Payload ID: 18961
  Gene Name: ubiquitin-conjugating enzyme E2, J2
  ENSP ID: ENSP00000393301
MSSTSSKRAPTTATQRLKQDYLRIKKDPVPYICAEPLPSNILEWHYVVRGPEMTPYEGGYYHGKLIFPREFPFKPPSIYMITPNGRFKCNTRLCLSITDFHPDTWNPAWSVSTILTGLLSFMVEKGPTLGSIETSDFTKRQLAVQSLAFNLKDKVFCELFPEVVEEIKQKQKAQDELSSRPQTLPLPDVVPDGETH

SEQ ID NO: 95097 - protein, 101 aa, Homo sapiens
  Payload ID: 18961
  Gene Name: ubiquitin-conjugating enzyme E2, J2
  ENSP ID: ENSP00000401898
MSSTSSKRAPTTATQRLKQDYLRIKKDPVPYICAEPLPSNILEWFKRFSWLSLLSSWDYRHYVVRGPEMTPYEGGYYHGKLIFPREFPFKPPSIYMITPNG

SEQ ID NO: 95098 - protein, 43 aa, Homo sapiens
  Payload ID: 18961
  Gene Name: ubiquitin-conjugating enzyme E2, J2
  ENSP ID: ENSP00000407565
MSSTSSKRAPTTATQRLKQDYLRIKKDPVPYICAEPLPSNILE

SEQ ID NO: 95099 - protein, 44 aa, Homo sapiens
  Payload ID: 18961
  Gene Name: ubiquitin-conjugating enzyme E2, J2
  ENSP ID: ENSP00000422103
MSSTSSKRAPTTATQRLKQDYLRIKKDPVPYICAEPLPSNILEW

SEQ ID NO: 95100 - protein, 100 aa, Homo sapiens
  Payload ID: 18961
  Gene Name: ubiquitin-conjugating enzyme E2, J2
  ENSP ID: ENSP00000423480
MSSTSSKRAPTTATQRLKQDYLRIKKDPVPYICAEPLPSNILEWHYVVRGPEMTPYEGIPVLDHLQLGQPECGSTSVGWALHHRVIAHDQRWGCQQAVVR

SEQ ID NO: 95101 - protein, 105 aa, Homo sapiens
  Payload ID: 18961
  Gene Name: ubiquitin-conjugating enzyme E2, J2
  ENSP ID: ENSP00000423880
MSSTSSKRAPTTATQRLKQDYLRIKKDPVPYICAEPLPSNILEWHYVVRGPEMTPYEGIPVLDHLQLGQPECGSTSVGWALHHRVIAHDQRWGCQQAVVAIIMEN

SEQ ID NO: 95102 - protein, 71 aa, Homo sapiens
  Payload ID: 18961
  Gene Name: ubiquitin-conjugating enzyme E2, J2
  ENSP ID: ENSP00000424342
MSSTSSKRAPTTATQRLKQDYLRIKKDPVPYICAEPLPSNILEWHYVVRGPEMTPYEGGYYHGKLIFPREF

SEQ ID NO: 95103 - protein, 60 aa, Homo sapiens
  Payload ID: 18961
  Gene Name: ubiquitin-conjugating enzyme E2, J2
  ENSP ID: ENSP00000425419
MVEKGPTLGSIETSDFTKRQLAVQSLAFNLKDKVFCELFPEVVEEIKQKQKAQDELSSRP

SEQ ID NO: 95104 - protein, 44 aa, Homo sapiens; identical to SEQ ID NO: 95099
  Payload ID: 18961
  Gene Name: ubiquitin-conjugating enzyme E2, J2
  ENSP ID: ENSP00000425543

SEQ ID NO: 95105 - protein, 44 aa, Homo sapiens; identical to SEQ ID NO: 95099
  Payload ID: 18961
  Gene Name: ubiquitin-conjugating enzyme E2, J2
  ENSP ID: ENSP00000427024

SEQ ID NO: 95106 - protein, 43 aa, Homo sapiens; identical to SEQ ID NO: 95098
  Payload ID: 18961
  Gene Name: ubiquitin-conjugating enzyme E2, J2
  ENSP ID: ENSP00000427244

SEQ ID NO: 95107 - protein, 149 aa, Homo sapiens
  Payload ID: 18962
  Gene Name: ubiquitin-conjugating enzyme E2A
  ENSP ID: ENSP00000335027
MSTPARRRLMRDFKRLQEDPPAGVSGAPSENNIMVWNAVIFGPEGTPFEDGTFKLTIEFTEEYPNKPPTVRFVSKMFHPNDGSICLDILQNRWSPTYDVSSILTSIQSLLDEPNPNSPANSQAAQLYQENKREYEKRVSAIVEQSWRDC

SEQ ID NO: 95108 - protein, 152 aa, Homo sapiens
  Payload ID: 18962
  Gene Name: ubiquitin-conjugating enzyme E2A
  Uniprot ID: P49459
  ENSP ID: ENSP00000360613
MSTPARRRLMRDFKRLQEDPPAGVSGAPSENNIMVWNAVIFGPEGTPFEDGTFKLTIEFTEEYPNKPPTVRFVSKMFHPNVYADGSICLDILQNRWSPTYDVSSILTSIQSLLDEPNPNSPANSQAAQLYQENKREYEKRVSAIVEQSWRDC

SEQ ID NO: 95109 - protein, 123 aa, Homo sapiens
  Payload ID: 18962
  Gene Name: ubiquitin-conjugating enzyme E2A
  ENSP ID: ENSP00000486153
MSTPARRRLMRDFKRLQEDPPAGVSGAPSENNIMVWNAVIFGPEGTPFEDGTFKLTIEFTEEYPNKPPTVRFVSKMFHPNVYADGSICLDILQNRWSPTYDVSSILTSIQILWVKSLYGIVNF

SEQ ID NO: 95110 - protein, 64 aa, Homo sapiens
  Payload ID: 18962
  Gene Name: ubiquitin-conjugating enzyme E2A
  ENSP ID: ENSP00000486347
MSTPARRRLMRDFKRLQEDPPAGVSGAPSENNIMVWNAVIFGPEGTPFEDDGVAPCHPGWSAMV

SEQ ID NO: 95111 - protein, 77 aa, Homo sapiens
  Payload ID: 18962
  Gene Name: ubiquitin-conjugating enzyme E2A
  Uniprot ID: P49459
  ENSP ID: ENSP00000486550
MFHPNVYADGSICLDILQNRWSPTYDVSSILTSIQSLLDEPNPNSPANSQAAQLYQENKREYEKRVSAIVEQSWRDC

SEQ ID NO: 95112 - protein, 122 aa, Homo sapiens
  Payload ID: 18962
  Gene Name: ubiquitin-conjugating enzyme E2A
  Uniprot ID: P49459
  ENSP ID: ENSP00000486599
MSTPARRRLMRDFKRLQEDPPAGVSGAPSENNIMVWNAVIFGPEGTPFEDVYADGSICLDILQNRWSPTYDVSSILTSIQSLLDEPNPNSPANSQAAQLYQENKREYEKRVSAIVEQSWRDC

SEQ ID NO: 95113 - protein, 119 aa, Homo sapiens
  Payload ID: 18962
  Gene Name: ubiquitin-conjugating enzyme E2A
  ENSP ID: ENSP00000487203
MVWNAVIFGPEGTPFEDGTFKLTIEFTEEYPNKPPTVRFVSKMFHPNVYADGSICLDILQNRWSPTYDVSSILTSIQSLLDEPNPNSPANSQAAQLYQENKREYEKRVSAIVEQSWRDC

SEQ ID NO: 95114 - protein, 152 aa, Homo sapiens
  Payload ID: 18963
  Gene Name: ubiquitin-conjugating enzyme E2B
  Uniprot ID: P63146
  ENSP ID: ENSP00000265339
MSTPARRRLMRDFKRLQEDPPVGVSGAPSENNIMQWNAVIFGPEGTPFEDGTFKLVIEFSEEYPNKPPTVRFLSKMFHPNVYADGSICLDILQNRWSPTYDVSSILTSIQSLLDEPNPNSPANSQAAQLYQENKREYEKRVSAIVEQSWNDS

SEQ ID NO: 95115 - protein, 141 aa, Homo sapiens
  Payload ID: 18963
  Gene Name: ubiquitin-conjugating enzyme E2B
  ENSP ID: ENSP00000425137
  MOD_RES (1)..(1): Any amino acid
XPARRRLMRDFKRLQEDPPVGVSGAPSENNIMQWNAVIFGPEGTPFEDGTFKLVIEFSEEYPNKPPTVRFLSKMFHPNDILQNRWSPTYDVSSILTSIQSLLDEPNPNSPANSQAAQLYQENKREYEKRVSAIVEQSWNDS

SEQ ID NO: 95116 - protein, 44 aa, Homo sapiens
  Payload ID: 18963
  Gene Name: ubiquitin-conjugating enzyme E2B
  ENSP ID: ENSP00000425237
MSTPARRRLMRDFKRLQEDPPVGVSGAPSENNIMQWNAVIFGVC

SEQ ID NO: 95117 - protein, 138 aa, Homo sapiens
  Payload ID: 18963
  Gene Name: ubiquitin-conjugating enzyme E2B
  ENSP ID: ENSP00000426364
STPARRRLMRDFKRLQEDPPVGVSGAPSENNIMQWNAVIFGPEGTPFEDGTFKLVIEFSEEYPNKPPTVRFLSKMFHPNVYADGSICLDILQNRWSPTYDVSSILTSIQCLALLPRLECNGTILAHRNLCLPGSISAG

SEQ ID NO: 95118 - protein, 50 aa, Homo sapiens
  Payload ID: 18964
  Gene Name: ubiquitin-conjugating enzyme E2C
  ENSP ID: ENSP00000243893
MASQNRDPAATSVAAARKGAEPSGGAARGPVGKRLQQELMTLMNPTLIVP

SEQ ID NO: 95119 - protein, 150 aa, Homo sapiens
  Payload ID: 18964
  Gene Name: ubiquitin-conjugating enzyme E2C
  Uniprot ID: O00762
  ENSP ID: ENSP00000333975
MASQNRDPAATSVAAARKGAEPSGGAARGPVGKRLQQELMTLMVYEDLRYKLSLEFPSGYPYNAPTVKFLTPCYHPNVDTQGNICLDILKEKWSALYDVRTILLSIQSLLGEPNIDSPLNTHAAELWKNPTAFKKYLQETYSKQVTSQEP

SEQ ID NO: 95120 - protein, 161 aa, Homo sapiens
  Payload ID: 18964
  Gene Name: ubiquitin-conjugating enzyme E2C
  Uniprot ID: O00762
  ENSP ID: ENSP00000335674
MASQNRDPAATSVAAARKGAEPSGGAARGPVGKRLQQELMTLMMSGDKGISAFPESDNLFKWVGTIHGAAGTAVGSIRTSSTVCLLSGPRETQDSSKPLVWGLGWDMRLLLELTLQLFLQMPEPNIDSPLNTHAAELWKNPTAFKKYLQETYSKQVTSQEP

SEQ ID NO: 95121 - protein, 179 aa, Homo sapiens
  Payload ID: 18964
  Gene Name: ubiquitin-conjugating enzyme E2C
  Uniprot ID: O00762
  ENSP ID: ENSP00000348838
MASQNRDPAATSVAAARKGAEPSGGAARGPVGKRLQQELMTLMMSGDKGISAFPESDNLFKWVGTIHGAAGTVYEDLRYKLSLEFPSGYPYNAPTVKFLTPCYHPNVDTQGNICLDILKEKWSALYDVRTILLSIQSLLGEPNIDSPLNTHAAELWKNPTAFKKYLQETYSKQVTSQEP

SEQ ID NO: 95122 - protein, 140 aa, Homo sapiens
  Payload ID: 18964
  Gene Name: ubiquitin-conjugating enzyme E2C
  Uniprot ID: O00762
  ENSP ID: ENSP00000361649
MTLMMSGDKGISAFPESDNLFKWVGTIHGAAGTVYEDLRYKLSLEFPSGYPYNAPTVKFLTPCYHPNVDTQGNICLDILKEKWSALYDVRTILLSIQSLLGEPNIDSPLNTHAAELWKNPTAFKKYLQETYSKQVTSQEP

SEQ ID NO: 95123 - protein, 79 aa, Homo sapiens
  Payload ID: 18964
  Gene Name: ubiquitin-conjugating enzyme E2C
  ENSP ID: ENSP00000385878
MASQNRDPAATSVAAARKGAEPSGGAARGPVGKRLQQELMTLMMSGDKGISAFPESDNLFKWVGTIHGAAGTNPTLIVP

SEQ ID NO: 95124 - protein, 132 aa, Homo sapiens
  Payload ID: 18964
  Gene Name: ubiquitin-conjugating enzyme E2C
  ENSP ID: ENSP00000479486
MASQNRDPAATSVAAARKGAEPSGGAARGPVGKRLQQELMTLMAVGSIRTSSTVCLLSGPRETQDSSKPLVWGLGWDMRLLLELTLQLFLQMPEPNIDSPLNTHAAELWKNPTAFKKYLQETYSKQVTSQEP

SEQ ID NO: 95125 - protein, 147 aa, Homo sapiens
  Payload ID: 18965
  Gene Name: ubiquitin-conjugating enzyme E2D 1
  Uniprot ID: P51668
  ENSP ID: ENSP00000363019
MALKRIQKELSDLQRDPPAHCSAGPVGDDLFHWQATIMGPPDSAYQGGVFFLTVHFPTDYPFKPPKIAFTTKIYHPNINSNGSICLDILRSQWSPALTVSKVLLSICSLLCDPNPDDPLVPDIAQIYKSDKEKYNRHAREWTQKYAM

SEQ ID NO: 95126 - protein, 109 aa, Homo sapiens
  Payload ID: 18965
  Gene Name: ubiquitin-conjugating enzyme E2D 1
  ENSP ID: ENSP00000479814
MTPDSAYQGGVFFLTVHFPTDYPFKPPKIAFTTKIYHPNINSNGSICLDILRSQWSPALTVSKVLLSICSLLCDPNPDDPLVPDIAQIYKSDKEKYNRHAREWTQKYAM

SEQ ID NO: 95127 - protein, 147 aa, Homo sapiens
  Payload ID: 18966
  Gene Name: ubiquitin-conjugating enzyme E2D 2
  ENSP ID: ENSP00000253815
LSLLKIQKELNDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDREKYNRIAREWTQKYAM

SEQ ID NO: 95128 - protein, 147 aa, Homo sapiens
  Payload ID: 18966
  Gene Name: ubiquitin-conjugating enzyme E2D 2
  Uniprot ID: P62837
  ENSP ID: ENSP00000381717
MALKRIHKELNDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDREKYNRIAREWTQKYAM

SEQ ID NO: 95129 - protein, 147 aa, Homo sapiens; identical to SEQ ID NO: 95128
  Payload ID: 18966
  Gene Name: ubiquitin-conjugating enzyme E2D 2
  Uniprot ID: P62837
  ENSP ID: ENSP00000381718

SEQ ID NO: 95130 - protein, 118 aa, Homo sapiens
  Payload ID: 18966
  Gene Name: ubiquitin-conjugating enzyme E2D 2
  Uniprot ID: P62837
  ENSP ID: ENSP00000424941
MFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDREKYNRIAREWTQKYAM

SEQ ID NO: 95131 - protein, 98 aa, Homo sapiens
  Payload ID: 18966
  Gene Name: ubiquitin-conjugating enzyme E2D 2
  ENSP ID: ENSP00000426523
MFHWQATIMGPNDSPYQGGVFFLTIHFPTDYPFKPPKVAFTTRIYHPNINSNGSICLDILRSQWSPALTISKVLLSICSLLCDPNPDDPLVPEIARIY

SEQ ID NO: 95132 - protein, 118 aa, Homo sapiens; identical to SEQ ID NO: 95130
  Payload ID: 18966
  Gene Name: ubiquitin-conjugating enzyme E2D 2
  Uniprot ID: P62837
  ENSP ID: ENSP00000429613

SEQ ID NO: 95133 - protein, 147 aa, Homo sapiens
  Payload ID: 18967
  Gene Name: ubiquitin-conjugating enzyme E2D 3
  Uniprot ID: P61077
  ENSP ID: ENSP00000318494
MALKRINKELSDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDRDKYNRISREWTQKYAM

SEQ ID NO: 95134 - protein, 147 aa, Homo sapiens; identical to SEQ ID NO: 95133
  Payload ID: 18967
  Gene Name: ubiquitin-conjugating enzyme E2D 3
  Uniprot ID: P61077
  ENSP ID: ENSP00000337208

SEQ ID NO: 95135 - protein, 141 aa, Homo sapiens
  Payload ID: 18967
  Gene Name: ubiquitin-conjugating enzyme E2D 3
  ENSP ID: ENSP00000337262
MAELSDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDRDKYNRISREWTQKYAM

SEQ ID NO: 95136 - protein, 147 aa, Homo sapiens; identical to SEQ ID NO: 95133
  Payload ID: 18967
  Gene Name: ubiquitin-conjugating enzyme E2D 3
  Uniprot ID: P61077
  ENSP ID: ENSP00000344069

SEQ ID NO: 95137 - protein, 148 aa, Homo sapiens
  Payload ID: 18967
  Gene Name: ubiquitin-conjugating enzyme E2D 3
  Uniprot ID: P61077
  ENSP ID: ENSP00000345285
MALKRINKELSDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDRDKYNRLAREWTEKYAML

SEQ ID NO: 95138 - protein, 149 aa, Homo sapiens
  Payload ID: 18967
  Gene Name: ubiquitin-conjugating enzyme E2D 3
  Uniprot ID: P61077
  ENSP ID: ENSP00000349722
MLSNRKCLSKELSDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDRDKYNRISREWTQKYAM

SEQ ID NO: 95139 - protein, 147 aa, Homo sapiens; identical to SEQ ID NO: 95133
  Payload ID: 18967
  Gene Name: ubiquitin-conjugating enzyme E2D 3
  Uniprot ID: P61077
  ENSP ID: ENSP00000378280

SEQ ID NO: 95140 - protein, 147 aa, Homo sapiens; identical to SEQ ID NO: 95133
  Payload ID: 18967
  Gene Name: ubiquitin-conjugating enzyme E2D 3
  Uniprot ID: P61077
  ENSP ID: ENSP00000378282

SEQ ID NO: 95141 - protein, 147 aa, Homo sapiens; identical to SEQ ID NO: 95133
  Payload ID: 18967
  Gene Name: ubiquitin-conjugating enzyme E2D 3
  Uniprot ID: P61077
  ENSP ID: ENSP00000378283

SEQ ID NO: 95142 - protein, 147 aa, Homo sapiens; identical to SEQ ID NO: 95133
  Payload ID: 18967
  Gene Name: ubiquitin-conjugating enzyme E2D 3
  Uniprot ID: P61077
  ENSP ID: ENSP00000396901

SEQ ID NO: 95143 - protein, 49 aa, Homo sapiens
  Payload ID: 18967
  Gene Name: ubiquitin-conjugating enzyme E2D 3
  ENSP ID: ENSP00000421310
MALKRINKELSDLARDPPAQCSAGPVGDDMFHWQATIMGPNDSPYQGGV

SEQ ID NO: 95144 - protein, 35 aa, Homo sapiens
  Payload ID: 18967
  Gene Name: ubiquitin-conjugating enzyme E2D 3
  ENSP ID: ENSP00000421794
MALKRINKELSDLARDPPAQCSAGPVGDDKFFFFF

SEQ ID NO: 95145 - protein, 118 aa, Homo sapiens
  Payload ID: 18967
  Gene Name: ubiquitin-conjugating enzyme E2D 3
  ENSP ID: ENSP00000421904
MFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDRDKYNRISREWTQKYAM

SEQ ID NO: 95146 - protein, 35 aa, Homo sapiens; identical to SEQ ID NO: 95144
  Payload ID: 18967
  Gene Name: ubiquitin-conjugating enzyme E2D 3
  ENSP ID: ENSP00000422134

SEQ ID NO: 95147 - protein, 48 aa, Homo sapiens
  Payload ID: 18967
  Gene Name: ubiquitin-conjugating enzyme E2D 3
  ENSP ID: ENSP00000422939
MALKRINKELSDLARDPPAQCSAGPVGDDMFHWQATIMGPISNYMLDN

SEQ ID NO: 95148 - protein, 55 aa, Homo sapiens
  Payload ID: 18967
  Gene Name: ubiquitin-conjugating enzyme E2D 3
  ENSP ID: ENSP00000423324
MALKRINKELSDLARDPPAQCSAGPVGDDMFHWQATIMGPQNSFLSWVDKQLYAG

SEQ ID NO: 95149 - protein, 96 aa, Homo sapiens
  Payload ID: 18967
  Gene Name: ubiquitin-conjugating enzyme E2D 3
  ENSP ID: ENSP00000423487
MALKRINKELSDLARDPPAQCSAGPVGDDMFHWQATIMGPNDSPYQGGVFFLTIHFPTDYPFKPPKVAFTTRIYHPNINSNGSICLDILRSQWSPA

SEQ ID NO: 95150 - protein, 48 aa, Homo sapiens; identical to SEQ ID NO: 95147
  Payload ID: 18967
  Gene Name: ubiquitin-conjugating enzyme E2D 3
  ENSP ID: ENSP00000423692

SEQ ID NO: 95151 - protein, 48 aa, Homo sapiens; identical to SEQ ID NO: 95147
  Payload ID: 18967
  Gene Name: ubiquitin-conjugating enzyme E2D 3
  ENSP ID: ENSP00000423869

SEQ ID NO: 95152 - protein, 118 aa, Homo sapiens; identical to SEQ ID NO: 95145
  Payload ID: 18967
  Gene Name: ubiquitin-conjugating enzyme E2D 3
  ENSP ID: ENSP00000424359

SEQ ID NO: 95153 - protein, 72 aa, Homo sapiens
  Payload ID: 18967
  Gene Name: ubiquitin-conjugating enzyme E2D 3
  ENSP ID: ENSP00000424710
MFHWQATIMGPNDSPYQGGVFFLTIHFPTDYPFKPPKVAFTTRIYHPNINSNGSICLDILRSQWSPALTISK

SEQ ID NO: 95154 - protein, 78 aa, Homo sapiens
  Payload ID: 18967
  Gene Name: ubiquitin-conjugating enzyme E2D 3
  ENSP ID: ENSP00000425762
MALKRINKELSDLARDPPAQCSAGPVGDDMFHWQATIMGPNDSPYQGGVFFLTIHFPTDYPFKPPKVAFTTRIYHPNI

SEQ ID NO: 95155 - protein, 118 aa, Homo sapiens; identical to SEQ ID NO: 95145
  Payload ID: 18967
  Gene Name: ubiquitin-conjugating enzyme E2D 3
  ENSP ID: ENSP00000426586

SEQ ID NO: 95156 - protein, 118 aa, Homo sapiens; identical to SEQ ID NO: 95145
  Payload ID: 18967
  Gene Name: ubiquitin-conjugating enzyme E2D 3
  ENSP ID: ENSP00000426620

SEQ ID NO: 95157 - protein, 19 aa, Homo sapiens
  Payload ID: 18967
  Gene Name: ubiquitin-conjugating enzyme E2D 3
  ENSP ID: ENSP00000427270
MFHWQATIMGPISNYMLDN

SEQ ID NO: 95158 - protein, 148 aa, Homo sapiens
  Payload ID: 18967
  Gene Name: ubiquitin-conjugating enzyme E2D 3
  ENSP ID: ENSP00000481600
MLSLKKKKKELSDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDRDKYNRISREWTQKYAM

SEQ ID NO: 95159 - protein, 147 aa, Homo sapiens
  Payload ID: 18968
  Gene Name: ubiquitin-conjugating enzyme E2D 4 (putative)
  Uniprot ID: Q9Y2X8
  ENSP ID: ENSP00000222402
MALKRIQKELTDLQRDPPAQCSAGPVGDDLFHWQATIMGPNDSPYQGGVFFLTIHFPTDYPFKPPKVAFTTKIYHPNINSNGSICLDILRSQWSPALTVSKVLLSICSLLCDPNPDDPLVPEIAHTYKADREKYNRLAREWTQKYAM

SEQ ID NO: 95160 - protein, 42 aa, Homo sapiens
  Payload ID: 18968
  Gene Name: ubiquitin-conjugating enzyme E2D 4 (putative)
  ENSP ID: ENSP00000391678
MALKRIQKAVQEAWCQHLLLVRPQEAYNHGRKQRRSRRVTWN

SEQ ID NO: 95161 - protein, 122 aa, Homo sapiens
  Payload ID: 18968
  Gene Name: ubiquitin-conjugating enzyme E2D 4 (putative)
  ENSP ID: ENSP00000397406
MALKRIQKELTDLQRDPPAQCSAGPVGDDLFHWQATIMGPNDSPYQGGVFFLTIHFPTDYPFKPPKVAFTTKIYHPNINSNGSICLDILRSQWSPALTVSKGRDADGMLCVLFYTCFYPSTD

SEQ ID NO: 95162 - protein, 39 aa, Homo sapiens
  Payload ID: 18968
  Gene Name: ubiquitin-conjugating enzyme E2D 4 (putative)
  ENSP ID: ENSP00000401824
MALKRIQKELTDLQRDPPAQCSAGPVGDDCCFHNQNLSP

SEQ ID NO: 95163 - protein, 42 aa, Homo sapiens; identical to SEQ ID NO: 95160
  Payload ID: 18968
  Gene Name: ubiquitin-conjugating enzyme E2D 4 (putative)
  ENSP ID: ENSP00000407196

SEQ ID NO: 95164 - protein, 42 aa, Homo sapiens; identical to SEQ ID NO: 95160
  Payload ID: 18968
  Gene Name: ubiquitin-conjugating enzyme E2D 4 (putative)
  ENSP ID: ENSP00000410897

SEQ ID NO: 95165 - protein, 42 aa, Homo sapiens; identical to SEQ ID NO: 95160
  Payload ID: 18968
  Gene Name: ubiquitin-conjugating enzyme E2D 4 (putative)
  ENSP ID: ENSP00000411738

SEQ ID NO: 95166 - protein, 74 aa, Homo sapiens
  Payload ID: 18968
  Gene Name: ubiquitin-conjugating enzyme E2D 4 (putative)
  ENSP ID: ENSP00000414331
MALKRIQKELTDLQRDPPAQCSAGPVGDDLFHWQATIMGPNDSPYQGGVFFLTIHFPTDYPFKPPKVRSLSQLP

SEQ ID NO: 95167 - protein, 31 aa, Homo sapiens
  Payload ID: 18968
  Gene Name: ubiquitin-conjugating enzyme E2D 4 (putative)
  ENSP ID: ENSP00000442350
ELTDLQRDPPAQCSAGPVGDDCCFHNQNLSP

SEQ ID NO: 95168 - protein, 193 aa, Homo sapiens
  Payload ID: 18969
  Gene Name: ubiquitin-conjugating enzyme E2E 1
  Uniprot ID: P51965
  ENSP ID: ENSP00000303709
MSDDDSRASTSSSSSSSSNQQTEKETNTPKKKESKVSMSKNSKLLSTSAKRIQKELADITLDPPPNCSAGPKGDNIYEWRSTILGPPGSVYEGGVFFLDITFTPEYPFKPPKVTFRTRIYHCNINSQGVICLDILKDNWSPALTISKVLLSICSLLTDCNPADPLVGSIATQYMTNRAEHDRMARQWTKRYAT

SEQ ID NO: 95169 - protein, 176 aa, Homo sapiens
  Payload ID: 18969
  Gene Name: ubiquitin-conjugating enzyme E2E 1
  Uniprot ID: P51965
  ENSP ID: ENSP00000329113
MSDDDSRASTSSSSSSSSNQQTEKETNTPKKKESKVSMSKNSKLLSTSAKSAGPKGDNIYEWRSTILGPPGSVYEGGVFFLDITFTPEYPFKPPKVTFRTRIYHCNINSQGVICLDILKDNWSPALTISKVLLSICSLLTDCNPADPLVGSIATQYMTNRAEHDRMARQWTKRYAT

SEQ ID NO: 95170 - protein, 151 aa, Homo sapiens
  Payload ID: 18969
  Gene Name: ubiquitin-conjugating enzyme E2E 1
  ENSP ID: ENSP00000393088
RIQKELADITLDPPPNCSAGPKGDNIYEWRSTILGPPGSVYEGGVFFLDITFTPEYPFKPPKASVFFLGQVTFRTRIYHCNINSQGVICLDILKDNWSPALTISKVLLSICSLLTDCNPADPLVGSIATQYMTNRAEHDRMARQWTKRYAT

SEQ ID NO: 95171 - protein, 147 aa, Homo sapiens
  Payload ID: 18969
  Gene Name: ubiquitin-conjugating enzyme E2E 1
  ENSP ID: ENSP00000410652
MSDDDSRASTSSSSSSSSNQQTEKETNTPKKKESKVSMSKNSKLLSTSAKRIQKELADITLDPPPNCSAGPKGDNIYEWRSTILGPPGSVYEGGVFFLDITFTPEYPFKPPKVTFRTRIYHCNINSQGVICLDILKDNWSPALTISK

SEQ ID NO: 95172 - protein, 160 aa, Homo sapiens
  Payload ID: 18969
  Gene Name: ubiquitin-conjugating enzyme E2E 1
  Uniprot ID: P51965
  ENSP ID: ENSP00000411351
MKEVGRPREVRGRPGKSRIQKELADITLDPPPNCSAGPKGDNIYEWRSTILGPPGSVYEGGVFFLDITFTPEYPFKPPKVTFRTRIYHCNINSQGVICLDILKDNWSPALTISKVLLSICSLLTDCNPADPLVGSIATQYMTNRAEHDRMARQWTKRYAT

SEQ ID NO: 95173 - protein, 167 aa, Homo sapiens
  Payload ID: 18969
  Gene Name: ubiquitin-conjugating enzyme E2E 1
  ENSP ID: ENSP00000475890
MKEVGRPREVRGRPGKSRIQKELADITLDPPPNCSAGPKGDNIYEWRSTILGPPGSVYEGGVFFLDITFTPEYPFKPPKVTFRTRIYHCNINSQGVICLDILKDNWSPALTISKVLLSICSLLTDCNPGKVHNSLPCFILPYLKNTCFQKLSKDKTNFSAQVCEYKN

SEQ ID NO: 95174 - protein, 92 aa, Homo sapiens
  Payload ID: 18970
  Gene Name: ubiquitin-conjugating enzyme E2E 2
  ENSP ID: ENSP00000338340
MSTEAQRVDDSPSTSGGSSDGDQRESVQQEPEREQVQPKKKEGKISSKTAAKLSTSAKRIQKELAEITLDPPPNCRLPSEQESITVILTAKV

SEQ ID NO: 95175 - protein, 201 aa, Homo sapiens
  Payload ID: 18970
  Gene Name: ubiquitin-conjugating enzyme E2E 2
  Uniprot ID: Q96LR5
  ENSP ID: ENSP00000379931
MSTEAQRVDDSPSTSGGSSDGDQRESVQQEPEREQVQPKKKEGKISSKTAAKLSTSAKRIQKELAEITLDPPPNCSAGPKGDNIYEWRSTILGPPGSVYEGGVFFLDITFSPDYPFKPPKVTFRTRIYHCNINSQGVICLDILKDNWSPALTISKVLLSICSLLTDCNPADPLVGSIATQYMTNRAEHDRMARQWTKRYAT

SEQ ID NO: 95176 - protein, 164 aa, Homo sapiens
  Payload ID: 18970
  Gene Name: ubiquitin-conjugating enzyme E2E 2
  ENSP ID: ENSP00000392800
MSTEAQRVDDSPSTSGGSSDGDQRESVQQEPEREQVQPKKKEGKISSKTAAKLSTSAKRIQKELAEITLDPPPNCSTNITLKGNAHSILNWIFGFWMPTSAGPKGDNIYEWRSTILGPPGSVYEGGVFFLDITFSPDYPFKPPKVTFRTRIYHCNINSQGVICL

SEQ ID NO: 95177 - protein, 201 aa, Homo sapiens; identical to SEQ ID NO: 95175
  Payload ID: 18970
  Gene Name: ubiquitin-conjugating enzyme E2E 2
  Uniprot ID: Q96LR5
  ENSP ID: ENSP00000401053

SEQ ID NO: 95178 - protein, 89 aa, Homo sapiens
  Payload ID: 18970
  Gene Name: ubiquitin-conjugating enzyme E2E 2
  ENSP ID: ENSP00000407501
MSTEAQRVDDSPSTSGGSSDGDQRESVQQEPEREQVQPKKKEGKISSKTAAKLSTSAKRIQKELAEITLDPPPNCRLFLIRSACISSNL

SEQ ID NO: 95179 - protein, 94 aa, Homo sapiens
  Payload ID: 18970
  Gene Name: ubiquitin-conjugating enzyme E2E 2
  ENSP ID: ENSP00000484777
SAGPKGDNIYEWRSTILGPPGSVYEGGVFFLDITFSPDYPFKPPKVTFRTRIYHCNINSQGVICLDILKDNWSPALTISKVLLSICSLLTDCNP

SEQ ID NO: 95180 - protein, 89 aa, Homo sapiens; identical to SEQ ID NO: 95178
  Payload ID: 18970
  Gene Name: ubiquitin-conjugating enzyme E2E 2
  ENSP ID: ENSP00000486775

SEQ ID NO: 95181 - protein, 207 aa, Homo sapiens
  Payload ID: 18971
  Gene Name: ubiquitin-conjugating enzyme E2E 3
  Uniprot ID: Q969T4
  ENSP ID: ENSP00000376215
MSSDRQRSDDESPSTSSGSSDADQRDPAAPEPEEQEERKPSATQQKKNTKLSSKTTAKLSTSAKRIQKELAEITLDPPPNCSAGPKGDNIYEWRSTILGPPGSVYEGGVFFLDITFSSDYPFKPPKVTFRTRIYHCNINSQGVICLDILKDNWSPALTISKVLLSICSLLTDCNPADPLVGSIATQYLTNRAEHDRIARQWTKRYAT

SEQ ID NO: 95182 - protein, 207 aa, Homo sapiens; identical to SEQ ID NO: 95181
  Payload ID: 18971
  Gene Name: ubiquitin-conjugating enzyme E2E 3
  Uniprot ID: Q969T4
  ENSP ID: ENSP00000386788

SEQ ID NO: 95183 - protein, 111 aa, Homo sapiens
  Payload ID: 18971
  Gene Name: ubiquitin-conjugating enzyme E2E 3
  ENSP ID: ENSP00000473264
MSSDRQRSDDESPSTSSGSSDADQRDPAAPEPEEQEERKPSATQQKKNTKLSSKTTAKLSTSAKRIQKELAEITLDPPPNCRKISKSCIECKDIQIENEELVLSVSSSLSI

SEQ ID NO: 95184 - protein, 174 aa, Homo sapiens
  Payload ID: 18971
  Gene Name: ubiquitin-conjugating enzyme E2E 3
  ENSP ID: ENSP00000473345
MSSDRQRSDDESPSTSSGSSDADQRDPAAPEPEEQEERKPSATQQKKNTKLSSKTTAKLSTSAKRIQKELAEITLDPPPNCSAGPKGDNIYEWRSTILGPPGSVYEGGVFFLDITFSSDYPFKPPKVTFRTRIYHCNINSQGVICLDILKDNWSPALTISKVLLSICSLLTDCN

SEQ ID NO: 95185 - protein, 123 aa, Homo sapiens
  Payload ID: 18971
  Gene Name: ubiquitin-conjugating enzyme E2E 3
  ENSP ID: ENSP00000473521
MSSDRQRSDDESPSTSSGSSDADQRDPAAPEPEEQEERKPSATQQKKNTKLSSKTTAKLSTSAKRIQKELAEITLDPPPNCSAGPKGDNIYEWRSTILGPPGSVYEGGVFFLDITFSSDYPFK

SEQ ID NO: 95186 - protein, 175 aa, Homo sapiens
  Payload ID: 18971
  Gene Name: ubiquitin-conjugating enzyme E2E 3
  ENSP ID: ENSP00000473525
MSSDRQRSDDESPSTSSGSSDADQRDPAAPEPEEQEERKPSATQQKKNTKLSSKTTAKLSTSAKRIQKELAEITLDPPPNCSAGPKGDNIYEWRSTILGPPGSVYEGGVFFLDITFSSDYPFKPPKVTFRTRIYHCNINSQGVICLDILKDNWSPALTISKVLLSICSLLTDCNP

SEQ ID NO: 95187 - protein, 174 aa, Homo sapiens; identical to SEQ ID NO: 95184
  Payload ID: 18971
  Gene Name: ubiquitin-conjugating enzyme E2E 3
  ENSP ID: ENSP00000473591

SEQ ID NO: 95188 - protein, 207 aa, Homo sapiens; identical to SEQ ID NO: 95181
  Payload ID: 18971
  Gene Name: ubiquitin-conjugating enzyme E2E 3
  Uniprot ID: Q969T4
  ENSP ID: ENSP00000473623

SEQ ID NO: 95189 - protein, 207 aa, Homo sapiens; identical to SEQ ID NO: 95181
  Payload ID: 18971
  Gene Name: ubiquitin-conjugating enzyme E2E 3
  Uniprot ID: Q969T4
  ENSP ID: ENSP00000473639

SEQ ID NO: 95190 - protein, 130 aa, Homo sapiens
  Payload ID: 18971
  Gene Name: ubiquitin-conjugating enzyme E2E 3
  ENSP ID: ENSP00000473642
MSSDRQRSDDESPSTSSGSSDADQRDPAAPEPEEQEERKPSATQQKKNTKLSSKTTAKLSTSAKRIQKELAEITLDPPPNCRGCPCPLLVTTCANSESLERKISKSCIECKDIQIENEELVLSVSSSLSI

SEQ ID NO: 95191 - protein, 185 aa, Homo sapiens
  Payload ID: 18972
  Gene Name: ubiquitin-conjugating enzyme E2F (putative)
  Uniprot ID: Q969M7
  ENSP ID: ENSP00000272930
MLTLASKLKRDDGLKGSRTAATASDSTRRVSVRDKLLVKEVAELEANLPCTCKVHFPDPNKLHCFQLTVTPDEGYYQGGKFQFETEVPDAYNMVPPKVKCLTKIWHPNITETGEICLSLLREHSIDGTGWAPTRTLKDVVWGLNSLFTDLLNFDDPLNIEAAEHHLRDKEDFRNKVDDYIKRYAR

SEQ ID NO: 95192 - protein, 161 aa, Homo sapiens
  Payload ID: 18972
  Gene Name: ubiquitin-conjugating enzyme E2F (putative)
  Uniprot ID: Q969M7
  ENSP ID: ENSP00000386680
MVLGAGPASPVSGSPEVAELEANLPCTCKVHFPDPNKLHCFQLTVTPDEGYYQGGKFQFETEVPDAYNMVPPKVKCLTKIWHPNITETGEICLSLLREHSIDGTGWAPTRTLKDVVWGLNSLFTDLLNFDDPLNIEAAEHHLRDKEDFRNKVDDYIKRYAR

SEQ ID NO: 95193 - protein, 163 aa, Homo sapiens
  Payload ID: 18972
  Gene Name: ubiquitin-conjugating enzyme E2F (putative)
  ENSP ID: ENSP00000387060
MLTLASKLKRDDGLKGSRTAATASDSTRRVSVRDKLLVKEVAELEANLPYEGYYQGGKFQFETEVPDAYNMVPPKVKCLTKIWHPNITETGEICLSLLREHSIDGTGWAPTRTLKDVVWGLNSLFTDLLNFDDPLNIEAAEHHLRDKEDFRNKVDDYIKRYAR

SEQ ID NO: 95194 - protein, 164 aa, Homo sapiens
  Payload ID: 18972
  Gene Name: ubiquitin-conjugating enzyme E2F (putative)
  Uniprot ID: Q969M7
  ENSP ID: ENSP00000387299
MLTLASKLKRDDGLKGSRTAATASDSTRRVSVRDKLLVKEVAELEANLPCTCKVHFPDPNKLHCFQLTVTPDEGYYQGGKFQFETEVPDAYNMVPPKVKCLTKIWHPNITETGEICLSLLREHSIDGTGWAPTRTLKDVVWGLNSLFTEDFRNKVDDYIKRYAR

SEQ ID NO: 95195 - protein, 101 aa, Homo sapiens
  Payload ID: 18972
  Gene Name: ubiquitin-conjugating enzyme E2F (putative)
  ENSP ID: ENSP00000389685
MLTLASKLKRDDGLKGSRTAATASDSTRRVSVRDKLLVKEVAELEANLPCTCKVHFPDPNKLHCFQLTVTPDEGYYQGGKFQFETEVPDAYNMVFIERTFN

SEQ ID NO: 95196 - protein, 139 aa, Homo sapiens
  Payload ID: 18972
  Gene Name: ubiquitin-conjugating enzyme E2F (putative)
  ENSP ID: ENSP00000390813
MLTLASKLKRDDGLKGSRTAATASDSTRRVSVRDKLLVKDEGYYQGGKFQFETEVPDAYNMVPPKVKCLTKIWHPNITETGEICLSLLREHSIDGTGWAPTRTLKDVVWGLNSLFTDLLNFDDPLNIEAAEHHLRDKED

SEQ ID NO: 95197 - protein, 120 aa, Homo sapiens
  Payload ID: 18972
  Gene Name: ubiquitin-conjugating enzyme E2F (putative)
  Uniprot ID: Q969M7
  ENSP ID: ENSP00000393515
MLTLASKLKRDDGLKGSRTAATASDSTRRVSVRDKLLVKEVAELEANLPCTCKVHFPDPNKLHCFQLTVTPDEGYYQGGKFQFETEVPDAYNMVPPKVKCLTKIWHPNITETGEICLRIF

SEQ ID NO: 95198 - protein, 142 aa, Homo sapiens
  Payload ID: 18972
  Gene Name: ubiquitin-conjugating enzyme E2F (putative)
  ENSP ID: ENSP00000396003
MLTLASKLKRDDGLKGSRTAATASDSTRRVSVRDKLLVKEVAELEANLPCTCKVHFPDPNKLHCFQLTVTPGFFCFVLCFLIDEGYYQGGKFQFETEVPDAYNMVPPKVKCLTKIWHPNITETGEICLSLLREHSIDGTGWA

SEQ ID NO: 95199 - protein, 78 aa, Homo sapiens
  Payload ID: 18972
  Gene Name: ubiquitin-conjugating enzyme E2F (putative)
  ENSP ID: ENSP00000396296
MVLGAGPASPVSGSPEVAELEANLPCTCKVHFPDPNKLHCFQLTVTPASQSEMPDQDLAPQHHRDRGNMSEFIERTFN

SEQ ID NO: 95200 - protein, 123 aa, Homo sapiens
  Payload ID: 18972
  Gene Name: ubiquitin-conjugating enzyme E2F (putative)
  ENSP ID: ENSP00000396630
MLTLASKLKRDDGLKGSRTAATASDSTRRVSVRDKLLVKEVAELEANLPCTCKVHFPDPNKLHCFQLTVTPDEGYYQGGKFQFETEVPDAYNMVPPKVKCLTKIWHPNITETGEICLRMSFGD

SEQ ID NO: 95201 - protein, 153 aa, Homo sapiens
  Payload ID: 18972
  Gene Name: ubiquitin-conjugating enzyme E2F (putative)
  Uniprot ID: Q969M7
  ENSP ID: ENSP00000399183
MLTLASKLKRDDGLKGSRTAATASDSTRRVSVRDKLLVKDEGYYQGGKFQFETEVPDAYNMVPPKVKCLTKIWHPNITETGEICLSLLREHSIDGTGWAPTRTLKDVVWGLNSLFTDLLNFDDPLNIEAAEHHLRDKEDFRNKVDDYIKRYAR

SEQ ID NO: 95202 - protein, 171 aa, Homo sapiens
  Payload ID: 18972
  Gene Name: ubiquitin-conjugating enzyme E2F (putative)
  ENSP ID: ENSP00000406113
MLTLASKLKRDDGLKGSRTAATASDSTRRVSVRDKLLVKEVAELEANLPCTCKVHFPDPNKLHCFQLTVTPDEGYYQGGKFQFETEVPDAYNMVPPKVKCLTKIWHPNITETGEICLSLLREHSIDGTGWAPTRTLKDVVWGLNSLFTDLLNFDDPLNIEAAEHHLRDKED

SEQ ID NO: 95203 - protein, 47 aa, Homo sapiens
  Payload ID: 18972
  Gene Name: ubiquitin-conjugating enzyme E2F (putative)
  ENSP ID: ENSP00000408676
MLTLASKLKRDDGLKGSRTAATASDSTRRVSVRDKLLVKGQSLRRIL

SEQ ID NO: 95204 - protein, 47 aa, Homo sapiens; identical to SEQ ID NO: 95203
  Payload ID: 18972
  Gene Name: ubiquitin-conjugating enzyme E2F (putative)
  ENSP ID: ENSP00000408823

SEQ ID NO: 95205 - protein, 102 aa, Homo sapiens
  Payload ID: 18972
  Gene Name: ubiquitin-conjugating enzyme E2F (putative)
  Uniprot ID: Q969M7
  ENSP ID: ENSP00000409749
MLTLASKLKRDDGLKGSRTAATASDSTRRVSVRDKLLVKEVAELEANLPCTCKVHFPDPNKLHCFQLTVTPASQSEMPDQDLAPQHHRDRGNMSEFIERTFN

SEQ ID NO: 95206 - protein, 63 aa, Homo sapiens
  Payload ID: 18972
  Gene Name: ubiquitin-conjugating enzyme E2F (putative)
  ENSP ID: ENSP00000410345
MLTLASKLKRDDGLKGSRTAATASDSTRRVSVRDKLLVKEVAELEANLPYRVSLCCPSWSTVA

SEQ ID NO: 95207 - protein, 86 aa, Homo sapiens
  Payload ID: 18972
  Gene Name: ubiquitin-conjugating enzyme E2F (putative)
  ENSP ID: ENSP00000410867
MLTLASKLKRDDGLKGSRTAATASDSTRRVSVRDKLLVKEVAELEANLPCTCKVHFPDPNKLHCFQLTVTPEFGWCDASLLTVPTE

SEQ ID NO: 95208 - protein, 48 aa, Homo sapiens
  Payload ID: 18972
  Gene Name: ubiquitin-conjugating enzyme E2F (putative)
  ENSP ID: ENSP00000412965
MLTLASKLKRDDGLKGSRTAATASDSTRRVSVRDKLLVKDGVSLCHVE

SEQ ID NO: 95209 - protein, 153 aa, Homo sapiens
  Payload ID: 18972
  Gene Name: ubiquitin-conjugating enzyme E2F (putative)
  ENSP ID: ENSP00000414619
MLTLASKLKRDDGLKGSRTAATASDSTRRVSVRDKLLVKGTCKVHFPDPNKLHCFQLTVTPDEGYYQGGKFQFETEVPDAYNMVPPKVKCLTKIWHPNITETGEICLSLLREHSIDGTGWAPTRTLKDVVWGLNSLFTDLLNFDDPLNIEAAE

SEQ ID NO: 95210 - protein, 185 aa, Homo sapiens; identical to SEQ ID NO: 95191
  Payload ID: 18972
  Gene Name: ubiquitin-conjugating enzyme E2F (putative)
  Uniprot ID: Q969M7
  ENSP ID: ENSP00000478474

SEQ ID NO: 95211 - protein, 170 aa, Homo sapiens
  Payload ID: 18973
  Gene Name: ubiquitin-conjugating enzyme E2G 1
  Uniprot ID: P62253
  ENSP ID: ENSP00000380178
MTELQSALLLRRQLAELNKNPVEGFSAGLIDDNDLYRWEVLIIGPPDTLYEGGVFKAHLTFPKDYPLRPPKMKFITEIWHPNVDKNGDVCISILHEPGEDKYGYEKPEERWLPIHTVETIMISVISMLADPNGDSPANVDAAKEWREDRNGEFKRKVARCVRKSQETAFE

SEQ ID NO: 95212 - protein, 49 aa, Homo sapiens
  Payload ID: 18973
  Gene Name: ubiquitin-conjugating enzyme E2G 1
  ENSP ID: ENSP00000458253
MTELQSALLLRRQLAELNKNPVEGFSAGLIDDNDLYRWEVLIIGPPDTL

SEQ ID NO: 95213 - protein, 6 aa, Homo sapiens
  Payload ID: 18973
  Gene Name: ubiquitin-conjugating enzyme E2G 1
  ENSP ID: ENSP00000459485
MKFITE

SEQ ID NO: 95214 - protein, 99 aa, Homo sapiens
  Payload ID: 18973
  Gene Name: ubiquitin-conjugating enzyme E2G 1
  ENSP ID: ENSP00000459691
MKFITEIWHPNVDKNGDVCISILHEPGEDKYGYEKPEERWLPIHTVETIMISVISMLADPNGDSPANVDAAKEWREDRNGEFKRKVARCVRKSQETAFE

SEQ ID NO: 95215 - protein, 50 aa, Homo sapiens
  Payload ID: 18973
  Gene Name: ubiquitin-conjugating enzyme E2G 1
  ENSP ID: ENSP00000459847
MTELQSALLLRRQLAELNKNPVEGFSAGLIDDNDLYRWEVLIIGPPDTLY

SEQ ID NO: 95216 - protein, 78 aa, Homo sapiens
  Payload ID: 18973
  Gene Name: ubiquitin-conjugating enzyme E2G 1
  ENSP ID: ENSP00000467502
MKFITEIWHPNVDKNGDVCISILHEPGEDKYGYEKPEERWLPIHTVETIMISVISMLADPNGDSPANVDAAKEWREDR

SEQ ID NO: 95217 - protein, 137 aa, Homo sapiens
  Payload ID: 18974
  Gene Name: ubiquitin-conjugating enzyme E2G 2
  Uniprot ID: P60604
  ENSP ID: ENSP00000331384
MNEENFFEWEALIMGPEDTCFEFGVFPAILSFPLDYPLSPPKMRFTCEMFHPNIYPDGRVCISILHAPGDDPMGYESSAERWSPVQSVEKILLSVVSMLAEPNDESGANVDASKMWRDDREQFYKIAKQIVQKSLGL

SEQ ID NO: 95218 - protein, 165 aa, Homo sapiens
  Payload ID: 18974
  Gene Name: ubiquitin-conjugating enzyme E2G 2
  Uniprot ID: P60604
  ENSP ID: ENSP00000338348
MAGTALKRLMAEYKQLTLNPPEGIVAGPMNEENFFEWEALIMGPEDTCFEFGVFPAILSFPLDYPLSPPKMRFTCEMFHPNIYPDGRVCISILHAPGDDPMGYESSAERWSPVQSVEKILLSVVSMLAEPNDESGANVDASKMWRDDREQFYKIAKQIVQKSLGL

SEQ ID NO: 95219 - protein, 48 aa, Homo sapiens
  Payload ID: 18974
  Gene Name: ubiquitin-conjugating enzyme E2G 2
  ENSP ID: ENSP00000418423
MAGTALKRLMAEYKQLTLNPPEGIVAGPMNEENFFEWEALIISALLGP

SEQ ID NO: 95220 - protein, 99 aa, Homo sapiens
  Payload ID: 18974
  Gene Name: ubiquitin-conjugating enzyme E2G 2
  ENSP ID: ENSP00000420671
MAGTALKRLMAEYKQLTLNPPEGIVAGPMNEENFFEWEALIMGPEDTCFEFGVFPAILSFPLDYPLSPPKMRFTCEMFHPNSGQPDVQGKYASSFFHSP

SEQ ID NO: 95221 - protein, 183 aa, Homo sapiens
  Payload ID: 18975
  Gene Name: ubiquitin-conjugating enzyme E2H
  Uniprot ID: P62256
  ENSP ID: ENSP00000347836
MSSPSPGKRRMDTDVVKLIESKHEVTILGGLNEFVVKFYGPQGTPYEGGVWKVRVDLPDKYPFKSPSIGFMNKIFHPNIDEASGTVCLDVINQTWTALYDLTNIFESFLPQLLAYPNPIDPLNGDAAAMYLHRPEEYKQKIKEYIQKYATEEALKEQEEGTGDSSSESSMSDFSEDEAQDMEL

SEQ ID NO: 95222 - protein, 149 aa, Homo sapiens
  Payload ID: 18975
  Gene Name: ubiquitin-conjugating enzyme E2H
  ENSP ID: ENSP00000417681
MDHKEVSTCVAPYEGGVWKVRVDLPDKYPFKSPSIGFMNKIFHPNIDEASGTVCLDVINQTWTALYDLTNIFESFLPQLLAYPNPIDPLNGDAAAMYLHRPEEYKQKIKEYIQKYATEEALKEQEEGTGDSSSESSMSDFSEDEAQDME

SEQ ID NO: 95223 - protein, 62 aa, Homo sapiens
  Payload ID: 18975
  Gene Name: ubiquitin-conjugating enzyme E2H
  ENSP ID: ENSP00000417709
RRMDTDVVKLIESKHEVTILGGLNEFVVKFYGPQGTPYEGGVWKVRVDLPDKYPFKSPSIEL

SEQ ID NO: 95224 - protein, 152 aa, Homo sapiens
  Payload ID: 18975
  Gene Name: ubiquitin-conjugating enzyme E2H
  Uniprot ID: P62256
  ENSP ID: ENSP00000419097
MSSPSPGKRRMDTDVVKLIESKHEVTILGGLNEFVVKFYGPQGTPYEGGVWKVRVDLPDKYPFKSPSIDLTNIFESFLPQLLAYPNPIDPLNGDAAAMYLHRPEEYKQKIKEYIQKYATEEALKEQEEGTGDSSSESSMSDFSEDEAQDMEL

SEQ ID NO: 95225 - protein, 123 aa, Homo sapiens
  Payload ID: 18975
  Gene Name: ubiquitin-conjugating enzyme E2H
  ENSP ID: ENSP00000419689
MSSPSPGKRRMDTDVVKLIESKHEVTILGGLNEFVVKFYGPQGTPYEGGVWKVRVDLPDKYPFKSPSIGFMNKIFHPNIDEASGTVCLDVINQTWTALYDPLNGDAAAMYLHRPEEYKQKIKG

SEQ ID NO: 95226 - protein, 103 aa, Homo sapiens
  Payload ID: 18975
  Gene Name: ubiquitin-conjugating enzyme E2H
  ENSP ID: ENSP00000419750
MQAKGRRHRSSALIGRPVTTRKRRRGGATKQLMDIESKHEVTILGGLNEFVVKFYGPQGTPYEGGVWKVRVDLPDKYPFKSPSIGFMNKIFHPNIDEASGTVC

SEQ ID NO: 95227 - protein, 158 aa, Homo sapiens [sequence omitted]

SEQ ID NO: 95228 - protein, 158 aa, Homo sapiens [sequence omitted]

SEQ ID NO: 95229 - protein, 158 aa, Homo sapiens [sequence omitted]

SEQ ID NO: 95230 - protein, 158 aa, Homo sapiens [sequence omitted]

SEQ ID NO: 95231 - protein, 184 aa, Homo sapiens
  Payload ID: 18976
  Gene Name: ubiquitin-conjugating enzyme E2I
  ENSP ID: ENSP00000384361
MSGIALSRLAQERKAWRKDHPFGFVAVPTKNPDGTMNLMNWECAIPGKKGTPWEGGLFKLRMLFKDDYPSSPPKCKFEPPLFHPNVYPSGTVCLSILEEDKDWRPAITIKQILLGIQELLNEPNIQDPAQAEAYTIYWLVAALAPLVAAPPRPSQGRLAGREWRTQAHPTDSQGPRLCGEGRGA

SEQ ID NO: 95232 - protein, 158 aa, Homo sapiens [sequence omitted]

SEQ ID NO: 95233 - protein, 158 aa, Homo sapiens [sequence omitted]

SEQ ID NO: 95234 - protein, 70 aa, Homo sapiens
  Payload ID: 18976
  Gene Name: ubiquitin-conjugating enzyme E2I
  ENSP ID: ENSP00000455252
  MOD_RES (1)..(1): Any amino acid
XLSRLAQERKAWRKDHPFGFVAVPTKNPDGTMNLMNWECAIPGKKGTPWEGGLFKLRMLFKDDYPSSPPK

SEQ ID NO: 95235 - protein, 137 aa, Homo sapiens
  Payload ID: 18976
  Gene Name: ubiquitin-conjugating enzyme E2I
  ENSP ID: ENSP00000455893
MSGIALSRLAQERKAWRKDHPFGFVAVPTKNPDGTMNLMNWECAIPGKKGTPWEGGLFKLRMLFKDDYPSSPPKCKFEPPLFHPNVYPSGTVCLSILEEDKDWRPAITIKQILLGIQELLNEPNIQDPAQAEAYTIY

SEQ ID NO: 95236 - protein, 29 aa, Homo sapiens
  Payload ID: 18976
  Gene Name: ubiquitin-conjugating enzyme E2I
  ENSP ID: ENSP00000456188
MSGIALSRLAQERKAWRKDHPFGFVAVPT

SEQ ID NO: 95237 - protein, 158 aa, Homo sapiens [sequence omitted]

SEQ ID NO: 95238 - protein, 200 aa, Homo sapiens
  Payload ID: 18977
  Gene Name: ubiquitin-conjugating enzyme E2K
  Uniprot ID: P61086
  ENSP ID: ENSP00000261427
MANIAVQRIKREFKEVLKSEETSKNQIKVDLVDENFTELRGEIAGPPDTPYEGGRYQLEIKIPETYPFNPPKVRFITKIWHPNISSVTGAICLDILKDQWAAAMTLRTVLLSLQALLAAAEPDDPQDAVVANQYKQNPEMFKQTARLWAHVYAGAPVSSPEYTKKIENLCAMGFDRNAVIVALSSKSWDVETATELLLSN

SEQ ID NO: 95239 - protein, 157 aa, Homo sapiens
  Payload ID: 18977
  Gene Name: ubiquitin-conjugating enzyme E2K
  Uniprot ID: P61086
  ENSP ID: ENSP00000390483
MANIAVQRIKREFKEVLKSEETSKNQIKVDLVDENFTELRGEIAGPPDTPYEGGRYQLEIKIPETYPFNPPKVRFITKIWHPNISSVTGAICLDILKDQWAAAMTLRTVLLSLQALLAAAEPDDPQDAVVANQNAVIVALSSKSWDVETATELLLSN

SEQ ID NO: 95240 - protein, 149 aa, Homo sapiens
  Payload ID: 18977
  Gene Name: ubiquitin-conjugating enzyme E2K
  Uniprot ID: P61086
  ENSP ID: ENSP00000421203
MANIAVQRIKREFKEVLKSEEVRFITKIWHPNISSVTGAICLDILKDQWAAAMTLRTVLLSLQALLAAAEPDDPQDAVVANQYKQNPEMFKQTARLWAHVYAGAPVSSPEYTKKIENLCAMGFDRNAVIVALSSKSWDVETATELLLSN

SEQ ID NO: 95241 - protein, 44 aa, Homo sapiens
  Payload ID: 18977
  Gene Name: ubiquitin-conjugating enzyme E2K
  ENSP ID: ENSP00000421422
MANIAVQRIKREFKEVLKSEEGSCNDSPHGIIVIASTIGSCRAR

SEQ ID NO: 95242 - protein, 123 aa, Homo sapiens
  Payload ID: 18977
  Gene Name: ubiquitin-conjugating enzyme E2K
  ENSP ID: ENSP00000425301
MANIAVQRIKREFKEVLKSEETSKNQIKVDLVDENFTELRGEIAGPPDTPYEGGRYQLEIKIPETYPFNPPKYKQNPEMFKQTARLWAHVYAGAPVSSPEYTKKIENLCAMGFDRNAVIVALS

SEQ ID NO: 95243 - protein, 154 aa, Homo sapiens [sequence omitted]

SEQ ID NO: 95244 - protein, 212 aa, Homo sapiens
  Payload ID: 18978
  Gene Name: ubiquitin-conjugating enzyme E2L 3
  Uniprot ID: P68036
  ENSP ID: ENSP00000400906
MQVAAGTRGDTRLQEVALLPQLFDLLVLGQRRARLLRQVPSALAGKDLAQLQAGATLAGYRRAHGPEELEEIRKCGMKNFRNIQVDEANLLTWQGLIVPDNPPYDKGAFRIEINFPAEYPFKPPKITFKTKIYHPNIDEKGQVCLPVISAENWKPATKTDQVIQSLIALVNDPQPEHPLRADLAEEYSKDRKKFCKNAEEFTKKYGEKRPVD

SEQ ID NO: 95245 - protein, 122 aa, Homo sapiens
  Payload ID: 18978
  Gene Name: ubiquitin-conjugating enzyme E2L 3
  Uniprot ID: P68036
  ENSP ID: ENSP00000445931
MAASRRLMKDNPPYDKGAFRIEINFPAEYPFKPPKITFKTKIYHPNIDEKGQVCLPVISAENWKPATKTDQVIQSLIALVNDPQPEHPLRADLAEEYSKDRKKFCKNAEEFTKKYGEKRPVD

SEQ ID NO: 95246 - protein, 153 aa, Homo sapiens
  Payload ID: 18979
  Gene Name: ubiquitin-conjugating enzyme E2L 6
  Uniprot ID: O14933
  ENSP ID: ENSP00000287156
MMASMRVVKELEDLQKKPPPYLRNLSSDDANVLVWHALLLPDQPPYHLKAFNLRISFPPEYPFKPPMIKFTTKIYHPNVDENGQICLPIISSENWKPCTKTCQVLEALNVLVNRPNIREPLRMDLADLLTQNPELFRKNAEEFTLRFGVDRPS

SEQ ID NO: 95247 - protein, 87 aa, Homo sapiens
  Payload ID: 18979
  Gene Name: ubiquitin-conjugating enzyme E2L 6
  Uniprot ID: O14933
  ENSP ID: ENSP00000341980
MIKFTTKIYHPNVDENGQICLPIISSENWKPCTKTCQVLEALNVLVNRPNIREPLRMDLADLLTQNPELFRKNAEEFTLRFGVDRPS

SEQ ID NO: 95248 - protein, 127 aa, Homo sapiens
  Payload ID: 18979
  Gene Name: ubiquitin-conjugating enzyme E2L 6
  ENSP ID: ENSP00000434348
MRRWTWKASWSRWLAFELEDLQKKPPPYLRNLSSDDANVLVWHALLLPDQPPYHLKAFNLRISFPPEYPFKPPMIKFTTKIYHPNVDENGQICLPIISSENWKPCTKTCQVLEALNVLVNRPNIREP

SEQ ID NO: 95249 - protein, 65 aa, Homo sapiens
  Payload ID: 18979
  Gene Name: ubiquitin-conjugating enzyme E2L 6
  ENSP ID: ENSP00000435265
MIKFTTKIYHPNVDENGQICLPIISSENWKPCTKTCQVLEALNVLVNRPNIREPLRMDLADLLTQ

SEQ ID NO: 95250 - protein, 183 aa, Homo sapiens
  Payload ID: 18980
  Gene Name: ubiquitin-conjugating enzyme E2M
  Uniprot ID: P61081
  ENSP ID: ENSP00000253023
MIKLFSLKQQKKEEESAGGTKGSSKKASAAQLRIQKDINELNLPKTCDISFSDPDDLLNFKLVICPDEGFYKSGKFVFSFKVGQGYPHDPPKVKCETMVYHPNIDLEGNVCLNILREDWKPVLTINSIIYGLQYLFLEPNPEDPLNKEAAEVLQNNRRLFEQNVQRSMRGGYIGSTYFERCLK

SEQ ID NO: 95251 - protein, 69 aa, Homo sapiens
  Payload ID: 18980
  Gene Name: ubiquitin-conjugating enzyme E2M
  ENSP ID: ENSP00000468940
MVYHPNIDLEGNVCLNILREDWKPVLTINSIIYGLQYLFLEPNPEDPLNKEAAEVLQNNRRLFEQNVQR

SEQ ID NO: 95252 - protein, 114 aa, Homo sapiens
  Payload ID: 18980
  Gene Name: ubiquitin-conjugating enzyme E2M
  ENSP ID: ENSP00000469855
FKLVICPDEGFYKSGKFVFSFKVGQGYPHDPPKVKCETMVYHPNIDLEGNVCLNILREDWKPVLTINSIIYGLQYLFLVSRNRWLGLGRLAFCPSGLLTPPTCTGHRSPTPRTH

SEQ ID NO: 95253 - protein, 152 aa, Homo sapiens
  Payload ID: 18981
  Gene Name: ubiquitin-conjugating enzyme E2N
  Uniprot ID: P61088
  ENSP ID: ENSP00000316176
MAGLPRRIIKETQRLLAEPVPGIKAEPDESNARYFHVVIAGPQDSPFEGGTFKLELFLPEEYPMAAPKVRFMTKIYHPNVDKLGRICLDILKDKWSPALQIRTVLLSIQALLSAPNPDDPLANDVAEQWKTNEAQAIETARAWTRLYAMNNI

SEQ ID NO: 95254 - protein, 87 aa, Homo sapiens
  Payload ID: 18981
  Gene Name: ubiquitin-conjugating enzyme E2N
  ENSP ID: ENSP00000447009
MAGLPRRIIKETQRLLAEPVPGIKAEPDESNARYFHVVIAGPQDSPFEGGTFKLELFLPEEYPMAAPKISGPQHCRSAQFCYRSRPC

SEQ ID NO: 95255 - protein, 105 aa, Homo sapiens
  Payload ID: 18981
  Gene Name: ubiquitin-conjugating enzyme E2N
  ENSP ID: ENSP00000448352
MAGLPRRIIKETQRLLAEPVPGIKAEPDESNARYFHVVIAGPQDSPFEGGTFKLELFLPEEYPMAAPKVRFMTKIYHPNVDKLGRICLDILKARAWTRLYAMNNI

SEQ ID NO: 95256 - protein, 152 aa, Homo sapiens
  Payload ID: 18981
  Gene Name: ubiquitin-conjugating enzyme E2N
  ENSP ID: ENSP00000449352
MAGLPRRIIKETQRLLAEPVPGIKAEPDESNARYFHVVIAGPQDSPFEGGTFKLELFLPEEYPMAAPKVRFMTKIYHPNVDKLGRICLDILKGKCYLYQHMLLLSFLLFLLSIPCLECKHYTKIREVCGREVKQFWACFFHALSYWACCLHR

SEQ ID NO: 95257 - protein, 89 aa, Homo sapiens
  Payload ID: 18981
  Gene Name: ubiquitin-conjugating enzyme E2N
  ENSP ID: ENSP00000450260
MAAPKVRFMTKIYHPNVDKLGRICLDILKDKWSPALQIRTVLLSIQALLSAPNPDDPLANDVAEQWKTNEAQAIETARAWTRLYAMNNI

SEQ ID NO: 95258 - protein, 152 aa, Homo sapiens
  Payload ID: 18982
  Gene Name: ubiquitin-conjugating enzyme E2N-like (gene/pseudogene)
  ENSP ID: ENSP00000488314
MAELPHRIIKETQRLLAEPVPGIKAEPDESNARYFHVVIAGESKDSPFEGGTFKRELLLAEEYPMAAPKVRFMTKIYHPNVDKLERISDILKDKWSPALQIRTVLLSIQALLNAPNPDDPLANDVVEQWKTNEAQAIETARAWTRLYAMNSI

SEQ ID NO: 95259 - protein, 1292 aa, Homo sapiens
  Payload ID: 18983
  Gene Name: ubiquitin-conjugating enzyme E2O
  Uniprot ID: Q9C0C9
  ENSP ID: ENSP00000323687
MADPAAPTPAAPAPAQAPAPAPEAVPAPAAAPVPAPAPASDSASGPSSDSGPEAGSQRLLFSHDLVSGRYRGSVHFGLVRLIHGEDSDSEGEEEGRGSSGCSEAGGAGHEEGRASPLRRGYVRVQWYPEGVKQHVKETKLKLEDRSVVPRDVVRHMRSTDSQCGTVIDVNIDCAVKLIGTNCIIYPVNSKDLQHIWPFMYGDYIAYDCWLGKVYDLKNQIILKLSNGARCSMNTEDGAKLYDVCPHVSDSGLFFDDSYGFYPGQVLIGPAKIFSSVQWLSGVKPVLSTKSKFRVVVEEVQVVELKVTWITKSFCPGGTDSVSPPPSVITQENLGRVKRLGCFDHAQRQLGERCLYVFPAKVEPAKIAWECPEKNCAQGEGSMAKKVKRLLKKQVVRIMSCSPDTQCSRDHSMEDPDKKGESKTKSEAESASPEETPDGSASPVEMQDEGAEEPHEAGEQLPPFLLKEGRDDRLHSAEQDADDEAADDTDDTSSVTSSASSTTSSQSGSGTSRKKSIPLSIKNLKRKHKRKKNKITRDFKPGDRVAVEVVTTMTSADVMWQDGSVECNIRSNDLFPVHHLDNNEFCPGDFVVDKRVQSCPDPAVYGVVQSGDHIGRTCMVKWFKLRPSGDDVELIGEEEDVSVYDIADHPDFRFRTTDIVIRIGNTEDGAPHKEDEPSVGQVARVDVSSKVEVVWADNSKTIILPQHLYNIESEIEESDYDSVEGSTSGASSDEWEDDSDSWETDNGLVEDEHPKIEEPPIPPLEQPVAPEDKGVVISEEAATAAVQGAVAMAAPMAGLMEKAGKDGPPKSFRELKEAIKILESLKNMTVEQLLTGSPTSPTVEPEKPTREKKFLDDIKKLQENLKKTLDNVAIVEEEKMEAVPDVERKEDKPEGQSPVKAEWPSETPVLCQQCGGKPGVTFTSAKGEVFSVLEFAPSNHSFKKIEFQPPEAKKFFSTVRKEMALLATSLPEGIMVKTFEDRMDLFSALIKGPTRTPYEDGLYLFDIQLPNIYPAVPPHFCYLSQCSGRLNPNLYDNGKVCVSLLGTWIGKGTERWTSKSSLLQVLISIQGLILVNEPYYNEAGFDSDRGLQEGYENSRCYNEMALIRVVQSMTQLVRRPPEVFEQEIRQHFSTGGWRLVNRIESWLETHALLEKAQALPNGVPKASSSPEPPAVAELSDSGQQEPEDGGPAPGEASQGSDSEGGAQGLASASRDHTDQTSETAPDASVPPSVKPKKRRKSYRSFLPEKSGYPDIGFPLFPLSKGFIKSIRGVLTQFRAALLEAGMPECTEDK

SEQ ID NO: 95260 - protein, 189 aa, Homo sapiens
  Payload ID: 18983
  Gene Name: ubiquitin-conjugating enzyme E2O
  ENSP ID: ENSP00000467623
  MOD_RES (1)..(1): Any amino acid
XKNQIILKLSNGARCSMNTEDGAKLYDVCPHVSDSGLFFDDSYGFYPGQVLIGPAKIFSSVQWLSGVKPVLSTKSKFRVVVEEVQVVELKVTWITKSFCPGGTDSVSPPPSVITQENLGRVKRLGCFDHAQRQLGERCLYVFPAKVKRLLKKQVVRIMSCSPDTQCSRDHSMEDPDKKGESKTKSEAES

SEQ ID NO: 95261 - protein, 807 aa, Homo sapiens
  Payload ID: 18983
  Gene Name: ubiquitin-conjugating enzyme E2O
  ENSP ID: ENSP00000468498
  MOD_RES (1)..(1): Any amino acid
XTDDTSSVTSSASSTTSSQSGSGTSRKKSIPLSIKNLKRKHKRKKNKITRDFKPGDRVAVEVVTTMTSADVMWQDGSVECNIRSNDLFPVHHLDNNEFCPGDFVVDKRVQSCPDPAVYGVVQSGDHIGRTCMVKWFKLRPSGDDVELIGEEEDVSVYDIADHPDFRFRTTDIVIRIGNTEDGAPHKEDEQPSVGQVARVDVSSKVEVVWADNSKTIILPQHLYNIESEIEESDYDSVEGSTSGASSDEWEDDSDSWETDNGLVEDEHPKIEEPPIPPLEQPVAPEDKGVVISEEAATAAVQGAVAMAAPMAGLMEKAGKDGPPKSFRELKEAIKILESLKNMTVEQLLTGSPTSPTVEPEKPTREKKFLDDIKKLQENLKKTLDNVAIVEEEKMEAVPDVERKEDKPEGQSPVKAEWPSETPVLCQQCGGKPGVTFTSAKGEVFSVLEFAPSNHSFKKIEFQPPEAKKFFSTVRKEMALLATSLPEGIMVKTFEDRMDLFSALIKGPTRTPYEDGLYLFDIQLPNIYPAVPPHFCYLSQCSGRLNPNLYDNGKVCVSLLGTWIGKGTERWTSKSSLLQVLISIQGLILVNEPYYNEAGFDSDRGLQEGYENSRCYNEMALIRVVQSMTQLVRRPPEVFEQEIRQHFSTGGWRLVNRIESWLETHALLEKAQALPNGVPKASSSPEPPAVAELSDSGQQEPEDGGPAPGEASQGSDSEGGAQGLASASRDHTDQTSETAPDASVPPSVKPKKRRKSYRSFLPEKSGYPDIGFPLFPLSKGFIKSIRGVLTQFRAALLEAGMPECTEDK

SEQ ID NO: 95262 - protein, 422 aa, Homo sapiens
  Payload ID: 18984
  Gene Name: ubiquitin-conjugating enzyme E2Q family member 1
  Uniprot ID: Q7Z7E8
  ENSP ID: ENSP00000292211
MQQPQPQGQQQPGPGQQLGGQGAAPGAGGGPGGGPGPGPCLRRELKLLESIFHRGHERFRIASACLDELSCEFLLAGAGGAGAGAAPGPHLPPRGSVPGDPVRIHCNITESYPAVPPIWSVESDDPNLAAVLERLVDIKKGNTLLLQHLKRIISDLCKLYNLPQHPDVEMLDQPLPAEQCTQEDVSSEDEDEEMPEDTEDLDHYEMKEEEPAEGKKSEDDGIGKENLAILEKIKKNQRQDYLNGAVSGSVQATDRLMKELRDIYRSQSFKGGNYAVELVNDSLYDWNVKLLKVDQDSALHNDLQILKEKEGADFILLNFSFKDNFPFDPPFVRVVSPVLSGGYVLGGGAICMELLTKQGWSSAYSIESVIMQISATLVKGKARVQFGANKSQYSLTRAQQSYKSLVQIHEKNGWYTPPKEDG

SEQ ID NO: 95263 - protein, 375 aa, Homo sapiens
  Payload ID: 18985
  Gene Name: ubiquitin-conjugating enzyme E2Q family member 2
  Uniprot ID: Q8WVN8
  ENSP ID: ENSP00000267938
MSVSGLKAELKFLASIFDKNHERFRIVSWKLDELHCQFLVPQQGSPHSLPPPLTLHCNITESYPSSSPIWFVDSEDPNLTSVLERLEDTKNNNLLRQQLKWLICELCSLYNLPKHLDVEMLDQPLPTGQNGTTEEVTSEEEEEEEEMAEDIEDLDHYEMKEEEPISGKKSEDEGIEKENLAILEKIRKTQRQDHLNGAVSGSVQASDRLMKELRDIYRSQSYKTGIYSVELINDSLYDWHVKLQKVDPDSPLHSDLQILKEKEGIEYILLNFSFKDNFPFDPPFVRVVLPVLSGGYVLGGGALCMELLTKQGWSSAYSIESVIMQINATLVKGKARVQFGANKNQYNLARAQQSYNSIVQIHEKNGWYTPPKEDG

SEQ ID NO: 95264 - protein, 200 aa, Homo sapiens
  Payload ID: 18985
  Gene Name: ubiquitin-conjugating enzyme E2Q family member 2
  ENSP ID: ENSP00000400960
  MOD_RES (1)..(1): Any amino acid
XLDVEMLDQPLPTGQNGTTEEVTSEEEEEEEEMAEDIEDLDHYEMKEEEPISGKKSEDEGIEKENLAILEKIRKTQRQDHLNGAVSGSVQASDRLMKELRDIYRSQSYKTGIYSVELINDSLYDWHVKLQKVDPDSPLHSDLQILKEKEGIEYILLNFSFKDNFPFDPPFVRVVLPVLSGGLVHPSKGRWLNVLTVVCLD

SEQ ID NO: 95265 - protein, 91 aa, Homo sapiens
  Payload ID: 18985
  Gene Name: ubiquitin-conjugating enzyme E2Q family member 2
  ENSP ID: ENSP00000454742
NGTTEEVTSEEEEEEEEMAEDIEDLDHYEMKEEEPISGKKSEDEGIEKENLAILEKIRKTQRQDHLNDNFPFDPPFVRVVLPVLSGGINII

SEQ ID NO: 95266 - protein, 359 aa, Homo sapiens
  Payload ID: 18985
  Gene Name: ubiquitin-conjugating enzyme E2Q family member 2
  Uniprot ID: Q8WVN8
  ENSP ID: ENSP00000456229
MRMDSLTEEKLECRLWCCLSDPSPPGLAARCCVLERSIVPSLRQESYPSSSPIWFVDSEDPNLTSVLERLEDTKNNNLLRQQLKWLICELCSLYNLPKHLDVEMLDQPLPTGQNGTTEEVTSEEEEEEEEMAEDIEDLDHYEMKEEEPISGKKSEDEGIEKENLAILEKIRKTQRQDHLNGAVSGSVQASDRLMKELRDIYRSQSYKTGIYSVELINDSLYDWHVKLQKVDPDSPLHSDLQILKEKEGIEYILLNFSFKDNFPFDPPFVRVVLPVLSGGYVLGGGALCMELLTKQGWSSAYSIESVIMQINATLVKGKARVQFGANKNQYNLARAQQSYNSIVQIHEKNGWYTPPKEDG

SEQ ID NO: 95267 - protein, 340 aa, Homo sapiens
  Payload ID: 18985
  Gene Name: ubiquitin-conjugating enzyme E2Q family member 2
  Uniprot ID: Q8WVN8
  ENSP ID: ENSP00000456324
MSVSGLKAELKFLASIFDKNHERFRIVSWKLDELHCQFLVPQQGSPHSLPPPLTLHCNITESYPSSSPIWFVDSEDPNLTSVLERLEDTKNNNLNGTTEEVTSEEEEEEEEMAEDIEDLDHYEMKEEEPISGKKSEDEGIEKENLAILEKIRKTQRQDHLNGAVSGSVQASDRLMKELRDIYRSQSYKTGIYSVELINDSLYDWHVKLQKVDPDSPLHSDLQILKEKEGIEYILLNFSFKDNFPFDPPFVRVVLPVLSGGYVLGGGALCMELLTKQGWSSAYSIESVIMQINATLVKGKARVQFGANKNQYNLARAQQSYNSIVQIHEKNGWYTPPKEDG

SEQ ID NO: 95268 - protein, 118 aa, Homo sapiens
  Payload ID: 18985
  Gene Name: ubiquitin-conjugating enzyme E2Q family member 2
  ENSP ID: ENSP00000458006
MSVSGLKAELKFLASIFDKNHERFRIVSWKLDELHCQFLVPQQGSPHSLPPPLTLHCNITESYPSSSPIWFVDSEDPNLTSVLERLEDTKNNNLDNFPFDPPFVRVVLPVLSGGINII

SEQ ID NO: 95269 - protein, 131 aa, Homo sapiens
  Payload ID: 18986
  Gene Name: ubiquitin-conjugating enzyme E2Q family member 2-like
  Uniprot ID: H0YL09
  ENSP ID: ENSP00000453012
MGPAVLGQGQEGQPEARACSGLLQPPKRPIVFKEKLTMKTDSLMEEKLECSLWCCLSDPSIPGRCCVLERRIVPWMQQESYSSSSPIWSVDSDEPNLTSVLERLEDTKENSSVRKETKLFSLFLMNIIFRN

SEQ ID NO: 95270 - protein, 161 aa, Homo sapiens
  Payload ID: 18987
  Gene Name: ubiquitin-conjugating enzyme E2Q family-like 1
  Uniprot ID: A1L167
  ENSP ID: ENSP00000382713
MKELQDIARLSDRFISVELVDESLFDWNVKLHQVDKDSVLWQDMKETNTEFILLNLTFPDNFPFSPPFMRVLSPRLENGYVLDGGAICMELLTPRGWSSAYTVEAVMRQFAASLVKGQGRICRKAGKSKKSFSRKEAEATFKSLVKTHEKYGWVTPPVSDG

SEQ ID NO: 95271 - protein, 238 aa, Homo sapiens
  Payload ID: 18988
  Gene Name: ubiquitin-conjugating enzyme E2R 2
  Uniprot ID: Q712K3
  ENSP ID: ENSP00000263228
MAQQQMTSSQKALMLELKSLQEEPVEGFRITLVDESDLYNWEVAIFGPPNTLYEGGYFKAHIKFPIDYPYSPPTFRFLTKMWHPNIYENGDVCISILHPPVDDPQSGELPSERWNPTQNVRTILLSVISLLNEPNTFSPANVDASVMFRKWRDSKGKDKEYAEIIRKQVSATKAEAEKDGVKVPTTLAEYCIKTKVPSNDNSSDLLYDDLYDDDIDDEDEEEEDADCYDDDDSGNEES

SEQ ID NO: 95272 - protein, 222 aa, Homo sapiens
  Payload ID: 18989
  Gene Name: ubiquitin-conjugating enzyme E2S
  Uniprot ID: Q16763
  ENSP ID: ENSP00000264552
MNSNVENLPPHIIRLVYKEVTTLTADPPDGIKVFPNEEDLTDLQVTIEGPEGTPYAGGLFRMKLLLGKDFPASPPKGYFLTKIFHPNVGANGEICVNVLKRDWTAELGIRHVLLTIKCLLIHPNPESALNEEAGRLLLENYEEYAARARLLTEIHGGAGGPSGRAEAGRALASGTEASSTDPGAPGGPGGAEGPMAKKHAGERDKKLAAKKKTDKKRALRRL

SEQ ID NO: 95273 - protein, 79 aa, Homo sapiens
  Payload ID: 18989
  Gene Name: ubiquitin-conjugating enzyme E2S
  ENSP ID: ENSP00000466388
MNSNVENLPPHIIRLVYKEVTTLTADPPDGIKVFPNEEDLTDLQVTIEGPGLLPDQDLPPERGRQWRDLRQRAQEGLDG

SEQ ID NO: 95274 - protein, 204 aa, Homo sapiens
  Payload ID: 18989
  Gene Name: ubiquitin-conjugating enzyme E2S
  ENSP ID: ENSP00000467409
MNSNVENLPPHIIRLVYKEVTTLTADPPDGIKVFPNEEDLTDLQVTIEGPEGTPYAGGLFRMKLLLGKDFPASPPKGYFLTKIFHPNVGANGEICVNVLKRDWTAELGIRHVLLLSWKDKQCQTQDTQVLLRSAQEHLTMQRVTIKCLLIHPNPESALNEEAGRLLLENYEEYAARARLLTEIHGGAGGPSGRAEAGRALASGT

SEQ ID NO: 95275 - protein, 197 aa, Homo sapiens
  Payload ID: 18990
  Gene Name: ubiquitin-conjugating enzyme E2T
  Uniprot ID: Q9NPD8
  ENSP ID: ENSP00000356243
MQRASRLKRELHMLATEPPPGITCWQDKDQMDDLRAQILGGANTPYEKGVFKLEVIIPERYPFEPPQIRFLTPIYHPNIDSAGRICLDVLKLPPKGAWRPSLNIATVLTSIQLLMSEPNPDDPLMADISSEFKYNKPAFLKNARQWTEKHARQKQKADEEEMLDNLPEAGDSRVHNSTQKRKASQLVGIEKKFHPDV

SEQ ID NO: 95276 - protein, 226 aa, Homo sapiens
  Payload ID: 18991
  Gene Name: ubiquitin-conjugating enzyme E2U (putative)
  Uniprot ID: Q5VVX9
  ENSP ID: ENSP00000360116
MHGRAYLLLHRDFCDLKENNYKGITAKPVSEDMMEWEVEIEGLQNSVWQGLVFQLTIHFTSEYNYAPPVVKFITIPFHPNVDPHTGQPCIDFLDNPEKWNTNYTLSSILLALQVMLSNPVLENPVNLEAARILVKDESLYRTILRLFNRPLQMKDDSQELPKDPRKCIRPIKTTSFSDYYQTWSRIATSKATEYYRTPLLKVPNFIGQYYKWKKMDLQHQKEWNLK

SEQ ID NO: 95277 - protein, 256 aa, Homo sapiens
  Payload ID: 18991
  Gene Name: ubiquitin-conjugating enzyme E2U (putative)
  ENSP ID: ENSP00000360117
MHGRAYLLLHRDFCDLKENNYKGITAKPVSEDMMEWEVEIEGLQNSVWQGLVFQLTIHFTSEYNYAPPVVKFITIPFHPNVDPHTGQPCIDFLDNPEKWNTNYTLSSILLALQVMLSNPVLENPVNLEAARILVKDESLYRTILRLFNRPLQMKDDSQELPKDPRKCIRPIKTTSFSDYYQTWSRIATSKATEYYRTPLLKVPNFIGQYYKWKKMDLQHQKEWNLKYSVIKCWLARKRMPHEVTHSMEEIKLCPTL

SEQ ID NO: 95278 - protein, 134 aa, Homo sapiens
  Payload ID: 18991
  Gene Name: ubiquitin-conjugating enzyme E2U (putative)
  ENSP ID: ENSP00000476556
  MOD_RES (1)..(1): Any amino acid
XMTARSYLKTHVNVSVLKVPNFIGQYYKWKKMDLQHQKEWNLKYSVIKCWLARKRMPHEVTHSMEEIKLCPTLNEIFLESPTAINSITDIYETEEEGWKSDTSLYENDTDEPREEEVEDLISWTNTLNTNTSED

SEQ ID NO: 95279 - protein, 204 aa, Homo sapiens
  Payload ID: 18991
  Gene Name: ubiquitin-conjugating enzyme E2U (putative)
  ENSP ID: ENSP00000477356
VMLSNPVLENPVNLEAARILVKDESLYRTILRLFNRPLQMKDDSQELPKDPRKCIRPIKTTSFSDYYQTWSRIATSKATEYYRTPLLKVPNFIGQYYKWKKMDLQHQKEWNLKYSVIKCWLARKRMPHEVTHSMEEIKLCPTLNEIFLESPTAINSITDIYETEEEGWKSDTSLYENDTDEPREEEVEDLISWTNTLNTNTSED

SEQ ID NO: 95280 - protein, 321 aa, Homo sapiens
  Payload ID: 18991
  Gene Name: ubiquitin-conjugating enzyme E2U (putative)
  Uniprot ID: Q5VVX9
  ENSP ID: ENSP00000481174
MHGRAYLLLHRDFCDLKENNYKGITAKPVSEDMMEWEVEIEGLQNSVWQGLVFQLTIHFTSEYNYAPPVVKFITIPFHPNVDPHTGQPCIDFLDNPEKWNTNYTLSSILLALQVMLSNPVLENPVNLEAARILVKDESLYRTILRLFNRPLQMKDDSQELPKDPRKCIRPIKTTSFSDYYQTWSRIATSKATEYYRTPLLKVPNFIGQYYKWKKMDLQHQKEWNLKYSVIKCWLARKRMPHEVTHSMEEIKLCPTLIPTTDEIFLESPTAINSITDIYETEEEGWKSDTSLYENDTDEPREEEVEDLISWTNTLNTNTSED

SEQ ID NO: 95281 - protein, 191 aa, Homo sapiens
  Payload ID: 18992
  Gene Name: ubiquitin-conjugating enzyme E2W (putative)
  ENSP ID: ENSP00000397453
MLSPRGVTRARQLLPLRLWPRRSWGDGSIMASMQTTGRRVEVWFPKRLQKELLALQNDPPPGMTLNEKSVQNSITQWIVDMEGAPGTLYEGEKFQLLFKFSSRYPFDSPQVMFTGENIPVHPHVYSNGHICLSILTEDWSPALSVQSVCLSIISMLSSCKEKRRPPDNSFYVRTCNKNPKKTKWWYHDDTC

SEQ ID NO: 95282 - protein, 60 aa, Homo sapiens
  Payload ID: 18992
  Gene Name: ubiquitin-conjugating enzyme E2W (putative)
  ENSP ID: ENSP00000414771
MASMQKRLQKELLALQNDPPPGMTLNEKSVQNSITQSCLLVKIFLFILMFIAMVISVYPF

SEQ ID NO: 95283 - protein, 180 aa, Homo sapiens
  Payload ID: 18992
  Gene Name: ubiquitin-conjugating enzyme E2W (putative)
  Uniprot ID: Q96B02
  ENSP ID: ENSP00000428813
MLSPRGVTRARQLLPLRLWPRRSWGDGSIMASMQKRLQKELLALQNDPPPGMTLNEKSVQNSITQWIVDMEGAPGTLYEGEKFQLLFKFSSRYPFDSPQVMFTGENIPVHPHVYSNGHICLSILTEDWSPALSVQSVCLSIISMLSSCKEKRRPPDNSFYVRTCNKNPKKTKWWYHDDTC

SEQ ID NO: 95284 - protein, 155 aa, Homo sapiens
  Payload ID: 18992
  Gene Name: ubiquitin-conjugating enzyme E2W (putative)
  ENSP ID: ENSP00000428835
  MOD_RES (1)..(1): Any amino acid
XKRLQKELLALQNDPPPGMTLNEKSVQNSITQWIVDMEGAPGTLYEGEKFQLLFKFSSRYPFDSPQVMFTGENIPVHPHVYSNGHICLSILTEDWSPALSVQSVCLSIISMLSSCKEKRRPPDNSFYVRTCNKNPKKTKWWYHELKSAFILSITD

SEQ ID NO: 95285 - protein, 60 aa, Homo sapiens; identical to SEQ ID NO: 95282
  Payload ID: 18992
  Gene Name: ubiquitin-conjugating enzyme E2W (putative)
  ENSP ID: ENSP00000429136

SEQ ID NO: 95286 - protein, 60 aa, Homo sapiens; identical to SEQ ID NO: 95282
  Payload ID: 18992
  Gene Name: ubiquitin-conjugating enzyme E2W (putative)
  ENSP ID: ENSP00000430254

SEQ ID NO: 95287 - protein, 151 aa, Homo sapiens
  Payload ID: 18992
  Gene Name: ubiquitin-conjugating enzyme E2W (putative)
  Uniprot ID: Q96B02
  ENSP ID: ENSP00000473561
MASMQKRLQKELLALQNDPPPGMTLNEKSVQNSITQWIVDMEGAPGTLYEGEKFQLLFKFSSRYPFDSPQVMFTGENIPVHPHVYSNGHICLSILTEDWSPALSVQSVCLSIISMLSSCKEKRRPPDNSFYVRTCNKNPKKTKWWYHDDTC

SEQ ID NO: 95288 - protein, 354 aa, Homo sapiens
  Payload ID: 18993
  Gene Name: ubiquitin-conjugating enzyme E2Z
  Uniprot ID: Q9H832
  ENSP ID: ENSP00000354201
MAESPTEEAATAGAGAAGPGASSVAGVVGVSGSGGGFGPPFLPDVWAAAAAAGGAGGPGSGLAPLPGLPPSAAAHGAALLSHWDPTLSSDWDGERTAPQCLLRIKRDIMSIYKEPPPGMFVVPDTVDMTKIHALITGPFDTPYEGGFFLFVFRCPPDYPIHPPRVKLMTTGNNTVRFNPNFYRNGKVCLSILGTWTGPAWSPAQSISSVLISIQSLMTENPYHNEPGFEQERHPGDSKNYNECIRHETIRVAVCDMMEGKCPCPEPLRGVMEKSFLEYYDFYEVACKDRLHLQGQTMQDPFGEKRGHFDYQSLLMRLGLIRQKVLERLHNENAEMDSDSSSSGTETDLHGSLRV

SEQ ID NO: 95289 - protein, 180 aa, Homo sapiens
  Payload ID: 18993
  Gene Name: ubiquitin-conjugating enzyme E2Z
  ENSP ID: ENSP00000424543
MAESPTEEAATAGAGAAGPGASSVAGVVGVSGSGGGFGPPFLPDVWAAAAAAGGAGGPGSGLAPLPGLPPSAAAHGAALLSHWDPTLSSDWDGERTAPQCLLRIKRTWTGPAWSPAQSISSVLISIQSLMTENPYHNEPGFEQERHPGDSKNYNECIRHETIRVAVCDMMEGKCPCPEPL

SEQ ID NO: 95290 - protein, 129 aa, Homo sapiens
  Payload ID: 18993
  Gene Name: ubiquitin-conjugating enzyme E2Z
  ENSP ID: ENSP00000425398
  MOD_RES (1)..(1): Any amino acid
XAAAHGAALLSHWDPTLSSDWDGERTAPQCLLRIKRDIMSIYKEPPPGMFVVPDTVDMTKIHALITGPFDTPYEGGFFLFVFRCPPDYPIHPPRVKLMTTGNNTYMDWTCLEPSPEHLLSAHLYPVPDD

SEQ ID NO: 95291 - protein, 70 aa, Homo sapiens
  Payload ID: 18993
  Gene Name: ubiquitin-conjugating enzyme E2Z
  ENSP ID: ENSP00000459473
RHETIRVAVCDMMEGKCPCPEPLRGVMEKSFLEYYDFYEVACKDRLHLQGQTMQVIQPLLLIAEALQLAM

SEQ ID NO: 95292 - protein, 47 aa, Homo sapiens
  Payload ID: 18993
  Gene Name: ubiquitin-conjugating enzyme E2Z
  ENSP ID: ENSP00000460759
MSIYKEPPPGMFVVPDTVDMTKYMDWTCLEPSPEHLLSAHLYPVPDD

SEQ ID NO: 95293 - protein, 100 aa, Homo sapiens
  Payload ID: 18993
  Gene Name: ubiquitin-conjugating enzyme E2Z
  ENSP ID: ENSP00000461147
MSIYKEPPPGMFVVPDTVDMTKIHALITGPFDTPYEGGFFLFVFRCPPDYPIHPPRVKLMTTGNNTVRFNPNFYRNGKVCLSILGTWTGPAWSPAQSISS

SEQ ID NO: 95294 - protein, 85 aa, Homo sapiens
  Payload ID: 18994
  Gene Name: ubiquitin-fold modifier 1
  Uniprot ID: P61960
  ENSP ID: ENSP00000239878
MSKVSFKITLTSDPRLPYKVLSVPESTPFTAVLKFAAEEFKVPAATSAIITNDGIGINPAQTAGNVFLKHGSELRIIPRDRVGSC

SEQ ID NO: 95295 - protein, 103 aa, Homo sapiens
  Payload ID: 18994
  Gene Name: ubiquitin-fold modifier 1
  Uniprot ID: P61960
  ENSP ID: ENSP00000368970
MIRAFPTTTPRSLHLFTSSTFLARALPGAFPTGACEERLSVPESTPFTAVLKFAAEEFKVPAATSAIITNDGIGINPAQTAGNVFLKHGSELRIIPRDRVGSC

SEQ ID NO: 95296 - protein, 81 aa, Homo sapiens
  Payload ID: 18994
  Gene Name: ubiquitin-fold modifier 1
  ENSP ID: ENSP00000402378
  MOD_RES (1)..(1): Any amino acid
XRSKVSFKITLTSDPRLPYKVLSVPESTPFTAVLKFAAEEFKVPAATSAIITNDGIGINPAQTAGEYLKTHRGVGGVIYVN

SEQ ID NO: 95297 - protein, 167 aa, Homo sapiens
  Payload ID: 18995
  Gene Name: ubiquitin-fold modifier conjugating enzyme 1
  Uniprot ID: Q9Y3C8
  ENSP ID: ENSP00000356982
MADEATRRVVSEIPVLKTNAGPRDRELWVQRLKEEYQSLIRYVENNKNADNDWFRLESNKEGTRWFGKCWYIHDLLKYEFDIEFDIPITYPTTAPEIAVPELDGKTAKMYRGGKICLTDHFKPLWARNVPKFGLAHLMALGLGPWLAVEIPDLIQKGVIQHKEKCNQ

SEQ ID NO: 95298 - protein, 117 aa, Homo sapiens
  Payload ID: 18996
  Gene Name: ubiquitin-like 3
  Uniprot ID: O95164
  ENSP ID: ENSP00000370055
MSSNVPADMINLRLILVSGKTKEFLFSPNDSASDIAKHVYDNWPMDWEEEQVSSPNILRLIYQGRFLHGNVTLGALKLPFGKTTVMHLVARETLPEPNSQGQRNREKTGESNCCVIL

SEQ ID NO: 95299 - protein, 180 aa, Homo sapiens
  Payload ID: 18997
  Gene Name: ubiquitin-like 4A
  ENSP ID: ENSP00000358667
MQLTVKALQGRECSLQVPEDELVSTLKQLVSEKLNVPVRQQRLLFKGKALADGKRLSDYSIGPNSKLNLVVKPLEKVLLEEGEAQRLADSPPPQVWQLISKVLARHFSAADASRVLEQLQRDYERSLSRLTLDDIERWAHHHHSWHVPGSGQVLGTPHSLTWVCFHTLRRGEPAQQRHRR

SEQ ID NO: 95300 - protein, 157 aa, Homo sapiens
  Payload ID: 18997
  Gene Name: ubiquitin-like 4A
  Uniprot ID: P11441
  ENSP ID: ENSP00000358674
MQLTVKALQGRECSLQVPEDELVSTLKQLVSEKLNVPVRQQRLLFKGKALADGKRLSDYSIGPNSKLNLVVKPLEKVLLEEGEAQRLADSPPPQVWQLISKVLARHFSAADASRVLEQLQRDYERSLSRLTLDDIERLASRFLHPEVTETMEKGFSK

SEQ ID NO: 95301 - protein, 33 aa, Homo sapiens
  Payload ID: 18997
  Gene Name: ubiquitin-like 4A
  ENSP ID: ENSP00000396237
MQLTVKALQGRECSLQMGNDSRIIASGPTPSST

SEQ ID NO: 95302 - protein, 103 aa, Homo sapiens
  Payload ID: 18997
  Gene Name: ubiquitin-like 4A
  ENSP ID: ENSP00000397223
MQLTVKALQGRECSLQVPEDELVSTLKQLVSEKLNVPVRQQRLLFKGKALAAGCRSAPLPPPEAASRPGPPPRRWRRRNPSICLWQMGNDSRIIASGPTPSST

SEQ ID NO: 95303 - protein, 33 aa, Homo sapiens; identical to SEQ ID NO: 95301
  Payload ID: 18997
  Gene Name: ubiquitin-like 4A
  ENSP ID: ENSP00000486867

SEQ ID NO: 95304 - protein, 174 aa, Homo sapiens
  Payload ID: 18998
  Gene Name: ubiquitin-like 4B
  Uniprot ID: Q8N7F7
  ENSP ID: ENSP00000334044
MFLTVKLLLGQRCSLKVSGQESVATLKRLVSRRLKVPEEQQHLLFRGQLLEDDKHLSDYCIGPNASINVIMQPLEKMALKEAHQPQTQPLWHQLGLVLAKHFEPQDAKAVLQLLRQEHEERLQKISLEHLEQLAQYLLAEEPHVEPAGERELEAKARPQSSCDMEEKEEAAADQ

SEQ ID NO: 95305 - protein, 73 aa, Homo sapiens
  Payload ID: 18999
  Gene Name: ubiquitin-like 5
  Uniprot ID: Q9BZL1
  ENSP ID: ENSP00000351492
MIEVVCNDRLGKKVRVKCNTDDTIGDLKKLIAAQTGTRWNKIVLKKWYTIFKDHVSLGDYEIHDGMNLELYYQ

SEQ ID NO: 95306 - protein, 73 aa, Homo sapiens; identical to SEQ ID NO: 95305
  Payload ID: 18999
  Gene Name: ubiquitin-like 5
  Uniprot ID: Q9BZL1
  ENSP ID: ENSP00000466910

SEQ ID NO: 95307 - protein, 36 aa, Homo sapiens
  Payload ID: 18999
  Gene Name: ubiquitin-like 5
  ENSP ID: ENSP00000467663
MIEVVCNDRLGKKVRVKCTRFLRTTCLWGTMKSTMG

SEQ ID NO: 95308 - protein, 73 aa, Homo sapiens; identical to SEQ ID NO: 95305
  Payload ID: 18999
  Gene Name: ubiquitin-like 5
  Uniprot ID: Q9BZL1
  ENSP ID: ENSP00000468656

SEQ ID NO: 95309 - protein, 380 aa, Homo sapiens
  Payload ID: 19000
  Gene Name: ubiquitin-like 7
  Uniprot ID: Q96S82
  ENSP ID: ENSP00000354883
MSLSDWHLAVKLADQPLTPKSILRLPETELGEYSLGGYSISFLKQLIAGKLQESVPDPELIDLIYCGRKLKDDQTLDFYGIQPGSTVHVLRKSWPEPDQKPEPVDKVAAMREFRVLHTALHSSSSYREAVFKMLSNKESLDQIIVATPGLSSDPIALGVLQDKDLFSVFADPNMLDTLVPAHPALVNAIVLVLHSVAGSAPMPGTDSSSRSMPSSSYRDMPGGFLFEGLSDDEDDFHPNTRSTPSSSTPSSRPASLGYSGAAGPRPITQSELATALALASTPESSSHTPTPGTQGHSSGTSPMSSGVQSGTPITNDLFSQALQHALQASGQPSLQSQWQPQLQQLRDMGIQDDELSLRALQATGGDIQAALELIFAGGAP

SEQ ID NO: 95310 - protein, 380 aa, Homo sapiens; identical to SEQ ID NO: 95309
  Payload ID: 19000
  Gene Name: ubiquitin-like 7
  Uniprot ID: Q96S82
  ENSP ID: ENSP00000378518

SEQ ID NO: 95311 - protein, 380 aa, Homo sapiens; identical to SEQ ID NO: 95309
  Payload ID: 19000
  Gene Name: ubiquitin-like 7
  Uniprot ID: Q96S82
  ENSP ID: ENSP00000454828

SEQ ID NO: 95312 - protein, 114 aa, Homo sapiens
  Payload ID: 19000
  Gene Name: ubiquitin-like 7
  ENSP ID: ENSP00000456662
PASLGYSGAAGPRPITQSELATALALASTPESSSHTPTPGTQSGTPITNDLFSQALQHALQASGQPSLQSQWQPQLQQLRDMGIQDDELSLRALQATGGDIQAALELIFAGGAP

SEQ ID NO: 95313 - protein, 182 aa, Homo sapiens
  Payload ID: 19000
  Gene Name: ubiquitin-like 7
  ENSP ID: ENSP00000456807
  MOD_RES (1)..(1): Any amino acid
XPVDKVAAMREFRVLHTALHSSSSYREAVFKMLSNKESLDQIIVATPGLSSDPIALGVLQDKDLFSVFADPNMLDTLVPAHPALVNAIVLVLHSVAGSAPMPGTDSSSRSMPSSSYRDMPGGFLFEGLSDDEDDFHPSQWQPQLQQLRDMGIQDDELSLRALQATGGDIQAALELIFAGGAP

SEQ ID NO: 95314 - protein, 380 aa, Homo sapiens; identical to SEQ ID NO: 95309
  Payload ID: 19000
  Gene Name: ubiquitin-like 7
  Uniprot ID: Q96S82
  ENSP ID: ENSP00000457703

SEQ ID NO: 95315 - protein, 380 aa, Homo sapiens; identical to SEQ ID NO: 95309
  Payload ID: 19000
  Gene Name: ubiquitin-like 7
  Uniprot ID: Q96S82
  ENSP ID: ENSP00000457708

SEQ ID NO: 95316 - protein, 224 aa, Homo sapiens
  Payload ID: 19000
  Gene Name: ubiquitin-like 7
  ENSP ID: ENSP00000457828
MSLSDWHLAVKLADQPLTPKSILRLPETELGEYSLGGYSISFLKQLIAGKLQESVPDPELIDLIYCGRKLKDDQTLDFYGIQPGSTVHVLRKSWPEPDQKPGVLQDKDLFSVFADPNMLDTLVPAHPALVNAIVLVLHSVAGSAPMPGTDSSSRSMPSSSYRDMPGGFLFEGLSDDEDDFHPNTRSTPSSSTPSSRPASLGYSGAAGPRPITQSELATALALAS

SEQ ID NO: 95317 - protein, 162 aa, Homo sapiens [sequence omitted]

SEQ ID NO: 95318 - protein, 318 aa, Homo sapiens
  Payload ID: 19001
  Gene Name: ubiquitin-like domain containing CTD phosphatase 1
  Uniprot ID: Q8WVY7
  ENSP ID: ENSP00000296786
MALPIIVKWGGQEYSVTTLSEDDTVLDLKQFLKTLTGVLPERQKLLGLKVKGKPAENDVKLGALKLKPNTKIMMMGTREESLEDVLGPPPDNDDVVNDFDIEDEVVEVENREENLLKISRRVKEYKVEILNPPREGKKLLVLDVDYTLFDHRSCAETGVELMRPYLHEFLTSAYEDYDIVIWSATNMKWIEAKMKELGVSTNANYKITFMLDSAAMITVHTPRRGLIDVKPLGVIWGKFSEFYSKKNTIMFDDIGRNFLMNPQNGLKIRPFMKAHLNRDKDKELLKLTQYLKEIAKLDDFLDLNHKYWERYLSKKQGQ

SEQ ID NO: 95319 - protein, 1058 aa, Homo sapiens
  Payload ID: 19002
  Gene Name: ubiquitin-like modifier activating enzyme 1
  Uniprot ID: P22314
  ENSP ID: ENSP00000338413
MSSSPLSKKRRVSGPDPKPGSNCSPAQSVLSEVPSVPTNGMAKNGSEADIDEGLYSRQLYVLGHEAMKRLQTSSVLVSGLRGLGVEIAKNIILGGVKAVTLHDQGTAQWADLSSQFYLREEDIGKNRAEVSQPRLAELNSYVPVTAYTGPLVEDFLSGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSQGVSMLYSFFMPAAKLKERLDQPMTEIVSRVSKRKLGRHVRALVLELCCNDESGEDVEVPYVRYTIR

SEQ ID NO: 95320 - protein, 506 aa, Homo sapiens
  Payload ID: 19002
  Gene Name: ubiquitin-like modifier activating enzyme 1
  ENSP ID: ENSP00000366481
MGFHHVGQAGLEPLTSGDPSALASQSAGITGVSYCAWPGFSIEVGEWGRLEGFPTSRVAVRLVLALFTDGPSNNACGNPFCQLWPHVICLLCLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSQGVSMLYSFFMPAAKLKERLDQPMTEIVSRVSKRKLGRHVRALVLELCCNDESGEDVEVPYVRYTIR

SEQ ID NO: 95321 - protein, 1058 aa, Homo sapiens; identical to SEQ ID NO: 95319
  Payload ID: 19002
  Gene Name: ubiquitin-like modifier activating enzyme 1
  Uniprot ID: P22314
  ENSP ID: ENSP00000366568

SEQ ID NO: 95322 - protein, 284 aa, Homo sapiens
  Payload ID: 19002
  Gene Name: ubiquitin-like modifier activating enzyme 1
  ENSP ID: ENSP00000389583
MLCVIYHLDNPVGKMSSSPLSKKRRVSGPDPKPGSNCSPAQSVLSEVPSVPTNGMAKNGSEADIDEGLYSRQLYVLGHEAMKRLQTSSVLVSGLRGLGVEIAKNIILGGVKAVTLHDQGTAQWADLSSQFYLREEDIGKNRAEVSQPRLAELNSYVPVTAYTGPLVEDFLSGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVL

SEQ ID NO: 95323 - protein, 173 aa, Homo sapiens
  Payload ID: 19002
  Gene Name: ubiquitin-like modifier activating enzyme 1
  ENSP ID: ENSP00000397816
MLCVIYHLDNPVGKMSSSPLSKKRRVSGPDPKPGSNCSPAQSVLSEVPSVPTNGMAKNGSEADIDEGLYSRQLYVLGHEAMKRLQTSSVLVSGLRGLGVEIAKNIILGGVKAVTLHDQGTAQWADLSSQFYLREEDIGKNRAEVSQPRLAELNSYVPVTAYTGPLVEDFLSGF

SEQ ID NO: 95324 - protein, 234 aa, Homo sapiens
  Payload ID: 19002
  Gene Name: ubiquitin-like modifier activating enzyme 1
  ENSP ID: ENSP00000401101
MSKPHFPPALPAPAAIPGIKGEENGCLLLPTYSVPGSMLCVIYHLDNPVGKMSSSPLSKKRRVSGPDPKPGSNCSPAQSVLSEVPSVPTNGMAKNGSEADIDEGLYSRQLYVLGHEAMKRLQTSSVLVSGLRGLGVEIAKNIILGGVKAVTLHDQGTAQWADLSSQFYLREEDIGKNRAEVSQPRLAELNSYVPVTAYTGPLVEDFLSGFQVVVLTNTPLEDQLRVGEFCHNRG

SEQ ID NO: 95325 - protein, 195 aa, Homo sapiens
  Payload ID: 19002
  Gene Name: ubiquitin-like modifier activating enzyme 1
  ENSP ID: ENSP00000404796
MSKPHFPPALPAPAAIPGIKGEENGCLLLPTYSVPGSMLCVIYHLDNPVGKMSSSPLSKKRRVSGPDPKPGSNCSPAQSVLSEVPSVPTNGMAKNGSEADIDEGLYSRQLYVLGHEAMKRLQTSSVLVSGLRGLGVEIAKNIILGGVKAVTLHDQGTAQWADLSSQFYLREEDIGKNRAEVSQPRLAELNSYVPV

SEQ ID NO: 95326 - protein, 270 aa, Homo sapiens
  Payload ID: 19002
  Gene Name: ubiquitin-like modifier activating enzyme 1
  ENSP ID: ENSP00000415033
MSSSPLSKKRRVSGPDPKPGSNCSPAQSVLSEVPSVPTNGMAKNGSEADIDEGLYSRQLYVLGHEAMKRLQTSSVLVSGLRGLGVEIAKNIILGGVKAVTLHDQGTAQWADLSSQFYLREEDIGKNRAEVSQPRLAELNSYVPVTAYTGPLVEDFLSGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVL

SEQ ID NO: 95327 - protein, 640 aa, Homo sapiens
  Payload ID: 19003
  Gene Name: ubiquitin-like modifier activating enzyme 2
  Uniprot ID: Q9UBT2
  ENSP ID: ENSP00000246548
MALSRGLPRELAEAVAGGRVLVVGAGGIGCELLKNLVLTGFSHIDLIDLDTIDVSNLNRQFLFQKKHVGRSKAQVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIFLNKQPNPRKKLLVPCALDPPNPNCYVCASKPEVTVRLNVHKVTVLTLQDKIVKEKFAMVAPDVQIEDGKGTILISSEEGETEANNHKKLSEFGIRNGSRLQADDFLQDYTLLINILHSEDLGKDVEFEVVGDAPEKVGPKQAEDAAKSITNGSDDGAQPSTSTAQEQDDVLIVDSDEEDSSNNADVSEEERSRKRKLDEKENLSAKRSRIEQKEELDDVIALD

SEQ ID NO: 95328 - protein, 544 aa, Homo sapiens
  Payload ID: 19003
  Gene Name: ubiquitin-like modifier activating enzyme 2
  Uniprot ID: Q9UBT2
  ENSP ID: ENSP00000437484
MNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIFLNKQPNPRKKLLVPCALDPPNPNCYVCASKPEVTVRLNVHKVTVLTLQDKIVKEKFAMVAPDVQIEDGKGTILISSEEGETEANNHKKLSEFGIRNGSRLQADDFLQDYTLLINILHSEDLGKDVEFEVVGDAPEKVGPKQAEDAAKSITNGSDDGAQPSTSTAQEQDDVLIVDSDEEDSSNNADVSEEERSRKRKLDEKENLSAKRSRIEQKEELDDVIALD

SEQ ID NO: 95329 - protein, 262 aa, Homo sapiens
  Payload ID: 19003
  Gene Name: ubiquitin-like modifier activating enzyme 2
  ENSP ID: ENSP00000467433
MALSRGLPRELAEAVAGGRVLVVGAGGIGCELLKNLVLTGFSHIDLVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQ

SEQ ID NO: 95330 - protein, 74 aa, Homo sapiens
  Payload ID: 19003
  Gene Name: ubiquitin-like modifier activating enzyme 2
  ENSP ID: ENSP00000468538
MALSRGLPRELAEAVAGGRVLVVGAGGIGCELLKNLVLTGFSHIDLLPETMLIECAWQLMFLLLKVEQLGILDK

SEQ ID NO: 95331 - protein, 215 aa, Homo sapiens
  Payload ID: 19003
  Gene Name: ubiquitin-like modifier activating enzyme 2
  ENSP ID: ENSP00000468756
  MOD_RES (1)..(1): Any amino acid
XYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIVKEKFAMVAPDVQIEDGKGTILISSEEGETEANNHKKLSEFGIRNGSRLQADDFLQDYTLLI

SEQ ID NO: 95332 - protein, 54 aa, Homo sapiens
  Payload ID: 19003
  Gene Name: ubiquitin-like modifier activating enzyme 2
  ENSP ID: ENSP00000475565
MALSRGLPRELAEAVAGGRVLVVGAGGIGCELLKNLVLTGFSHIDLPPGSHYFA

SEQ ID NO: 95333 - protein, 166 aa, Homo sapiens
  Payload ID: 19003
  Gene Name: ubiquitin-like modifier activating enzyme 2
  ENSP ID: ENSP00000475656
MVAPDVQIEDGKGTILISSEEGETEANNHKKLSEFGIRNGSRLQADDFLQDYTLLINILHSEDLGKDVEFEVVGDAPEKVGPKQAEDAAKSITNGSDDGAQPSTSTAQEQDDVLIVDSDEEDSSNNADVSEEERSRKRKLDEKENLSAKRSRIEQKEELDDVIALD

SEQ ID NO: 95334 - protein, 449 aa, Homo sapiens
  Payload ID: 19004
  Gene Name: ubiquitin-like modifier activating enzyme 3
  Uniprot ID: Q8TBC4
  ENSP ID: ENSP00000340041
MADGEEPMAVDGGCGDTGDWEGRWNHVKKFLERSGPFTHPDFEPSTESLQFLLDTCKVLVIGAGGLGCELLKNLALSGFRQIHVIDMDTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVCATEVFKIATSAYIPLNNYLVFNDVDGLYTYTFEAERKENCPACSQLPQNIQFSPSAKLQEVLDYLTNSASLQMKSPAITATLEGKNRTLYLQSVTSIEERTRPNLSKTLKELGLVDGQELAVADVTTPQTVLFKLHFTS

SEQ ID NO: 95335 - protein, 463 aa, Homo sapiens
  Payload ID: 19004
  Gene Name: ubiquitin-like modifier activating enzyme 3
  Uniprot ID: Q8TBC4
  ENSP ID: ENSP00000354340
MADGEEPEKKRRRIEELLAEKMAVDGGCGDTGDWEGRWNHVKKFLERSGPFTHPDFEPSTESLQFLLDTCKVLVIGAGGLGCELLKNLALSGFRQIHVIDMDTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVCATEVFKIATSAYIPLNNYLVFNDVDGLYTYTFEAERKENCPACSQLPQNIQFSPSAKLQEVLDYLTNSASLQMKSPAITATLEGKNRTLYLQSVTSIEERTRPNLSKTLKELGLVDGQELAVADVTTPQTVLFKLHFTS

SEQ ID NO: 95336 - protein, 422 aa, Homo sapiens
  Payload ID: 19004
  Gene Name: ubiquitin-like modifier activating enzyme 3
  ENSP ID: ENSP00000400294
MADGEEPMAVDGGCGDTGDWEGRWNHVKKFLERSGPFTHPDFEPSTEALSGFRQIHVIDMDTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVCATEVFKIATSAYIPLNNYLVFNDVDGLYTYTFEAERKENCPACSQLPQNIQFSPSAKLQEVLDYLTNSASLQMKSPAITATLEGKNRTLYLQSVTSIEERTRPNLSKTLKELGLVDGQELAVADVTTPQTVLFKLHFTS

SEQ ID NO: 95337 - protein, 64 aa, Homo sapiens
  Payload ID: 19004
  Gene Name: ubiquitin-like modifier activating enzyme 3
  ENSP ID: ENSP00000417547
MADGEEPMAVDGGCGDTGDWEGRWNHVKKFLERSGPFTHPDFEPSTENFILLYVDWTLSSPEDG

SEQ ID NO: 95338 - protein, 129 aa, Homo sapiens
  Payload ID: 19004
  Gene Name: ubiquitin-like modifier activating enzyme 3
  ENSP ID: ENSP00000419077
MADGEEPMAVDGGCGDTGDWEGRWNHVKKFLERSGPFTHPDFEPSTESLQFLLDTCKVLVIGAGGLGCELLKNLALSGFRQIHVIDMDTIDVSNLNRQFLFRISYYCMWTGLYHRQKMDKWHADISSKL

SEQ ID NO: 95339 - protein, 41 aa, Homo sapiens
  Payload ID: 19004
  Gene Name: ubiquitin-like modifier activating enzyme 3
  ENSP ID: ENSP00000486366
LIVSILRLECNGVILAHGNLCLPGSSDSPASASQVAGMTGA

SEQ ID NO: 95340 - protein, 129 aa, Homo sapiens; identical to SEQ ID NO: 95338
  Payload ID: 19004
  Gene Name: ubiquitin-like modifier activating enzyme 3
  ENSP ID: ENSP00000486985

SEQ ID NO: 95341 - protein, 348 aa, Homo sapiens
  Payload ID: 19005
  Gene Name: ubiquitin-like modifier activating enzyme 5
  Uniprot ID: Q9GZZ9
  ENSP ID: ENSP00000264991
MALKRMGIVSDYEKIRTFAVAIVGVGGVGSVTAEMLTRCGIGKLLLFDYDKVELANMNRLFFQPHQAGLSKVQAAEHTLRNINPDVLFEVHNYNITTVENFQHFMDRISNGGLEEGKPVDLVLSCVDNFEARMTINTACNELGQTWMESGVSENAVSGHIQLIIPGESACFACAPPLVVAANIDEKTLKREGVCAASLPTTMGVVAGILVQNVLKFLLNFGTVSFYLGYNAMQDFFPTMSMKPNPQCDDRNCRKQQEEYKKKVAALPKQEVIQEEEEIIHEDNEWGIELVSEVSEEELKNFSGPVPDLPEGITVAYTIPKKQEDSVTELTVEDSGESLEDLMAKMKNM

SEQ ID NO: 95342 - protein, 404 aa, Homo sapiens
  Payload ID: 19005
  Gene Name: ubiquitin-like modifier activating enzyme 5
  Uniprot ID: Q9GZZ9
  ENSP ID: ENSP00000348565
MAESVERLQQRVQELERELAQERSLQVPRSGDGGGGRVRIEKMSSEVVDSNPYSRLMALKRMGIVSDYEKIRTFAVAIVGVGGVGSVTAEMLTRCGIGKLLLFDYDKVELANMNRLFFQPHQAGLSKVQAAEHTLRNINPDVLFEVHNYNITTVENFQHFMDRISNGGLEEGKPVDLVLSCVDNFEARMTINTACNELGQTWMESGVSENAVSGHIQLIIPGESACFACAPPLVVAANIDEKTLKREGVCAASLPTTMGVVAGILVQNVLKFLLNFGTVSFYLGYNAMQDFFPTMSMKPNPQCDDRNCRKQQEEYKKKVAALPKQEVIQEEEEIIHEDNEWGIELVSEVSEEELKNFSGPVPDLPEGITVAYTIPKKQEDSVTELTVEDSGESLEDLMAKMKNM

SEQ ID NO: 95343 - protein, 377 aa, Homo sapiens
  Payload ID: 19005
  Gene Name: ubiquitin-like modifier activating enzyme 5
  ENSP ID: ENSP00000417879
MAESVERLQQRVQELERELAQERSLQVPRSGDGGGGRVRIEKMSSEVVDSNPYSRLMALKRMGIVSDYEKIRTFAVAIVGVGGVGSVTAEMLTRCGIGKLLLFDYDKVELANMNRLFFQPHQAGLSKVQAAEHTLRNINPDVLFEVHNYNITTVENFQHFMDRISNGGLEEGKPVDLVLSCVDNFEARMTINTACNELGQTWMESGVSENAVSGHIQLIIPGESACFACAPPLVVAANIDEKTLKREGVCAASLPTTMGVVAGILVQNVLKFLLNFGTVSFYLGYNAMQDFFPTMSMKPNPQCDDRNCRKQQEEYKKKVAALPKQEVIQEEEEIIHEDNEWGIELVSEVSEEELKNFSGPVPDLPEGITVAYTIPKK

SEQ ID NO: 95344 - protein, 108 aa, Homo sapiens
  Payload ID: 19005
  Gene Name: ubiquitin-like modifier activating enzyme 5
  ENSP ID: ENSP00000417905
MALKRMGIVSDYEKIRTFAVAIVGVGGVGSVTAEMLTRCGIGKLLLFDYDKVELANMNRLFFQPHQAGLSKVQAAEHTLRNINPDVLFEVHNYNITTVENFQHFMDRI

SEQ ID NO: 95345 - protein, 79 aa, Homo sapiens
  Payload ID: 19005
  Gene Name: ubiquitin-like modifier activating enzyme 5
  ENSP ID: ENSP00000418569
MALKRMGIVSDYEKIRTFAVAIVGVGGVGSVTAEMLTRCGIGKLLLFDYDKVELANMNRLFFQPHQAGLSKVQAAEHTL

SEQ ID NO: 95346 - protein, 348 aa, Homo sapiens; identical to SEQ ID NO: 95341
  Payload ID: 19005
  Gene Name: ubiquitin-like modifier activating enzyme 5
  Uniprot ID: Q9GZZ9
  ENSP ID: ENSP00000418807

SEQ ID NO: 95347 - protein, 110 aa, Homo sapiens
  Payload ID: 19005
  Gene Name: ubiquitin-like modifier activating enzyme 5
  ENSP ID: ENSP00000420055
MRSNIKPAKLLLFDYDKVELANMNRLFFQPHQAGLSKVQAAEHTLRNINPDVLFEVHNYNITTVENFQHFMDRISNGGLEEGKPVDLVLSCVDNFEARMTINTACNELGQ

SEQ ID NO: 95348 - protein, 347 aa, Homo sapiens
  Payload ID: 19005
  Gene Name: ubiquitin-like modifier activating enzyme 5
  ENSP ID: ENSP00000424984
MAESVERLQQRVQELERELAQERSLQVPRSGDGGGGRVRIEKMSSEVVDSNPYSRLMALKRMGIVSDYEKIRTFAVAIVGVGGVGSVTAEMLTRCGIGKLLLFDYDKVELANMNRLFFQPHQAGLSKVQAAEHTLRNINPDVLFEVHNYNITTVENFQHFMDRISNGGLEEGKPVDLVLSCVDNFEARMTINTACNELGQTWMESGVSENAVSGHIQLIIPGESACFACAPPLVVAANIDEKTLKREGVCAASLPTTMGVVAGILVQNVLKFLLNFGTVSFYLGYNAMQDFFPTMSMKPNPQCDDRNCRKQQEEYKKKVAALPKQEVIQEEEEIIHEDNEWARRFCH

SEQ ID NO: 95349 - protein, 64 aa, Homo sapiens
  Payload ID: 19005
  Gene Name: ubiquitin-like modifier activating enzyme 5
  ENSP ID: ENSP00000427233
MAESVERLQQRVQELERELAQERSLQVPRSGDGGGGRVRIEKMSSEVVDSNPYSCYSLIMTRWN

SEQ ID NO: 95350 - protein, 1052 aa, Homo sapiens
  Payload ID: 19006
  Gene Name: ubiquitin-like modifier activating enzyme 6
  Uniprot ID: A0AVT1
  ENSP ID: ENSP00000313454
MEGSEPVAAHQGEEASCSSWGTGSTNKNLPIMSTASVEIDDALYSRQRYVLGDTAMQKMAKSHVFLSGMGGLGLEIAKNLVLAGIKAVTIHDTEKCQAWDLGTNFFLSEDDVVNKRNRAEAVLKHIAELNPYVHVTSSSVPFNETTDLSFLDKYQCVVLTEMKLPLQKKINDFCRSQCPPIKFISADVHGIWSRLFCDFGDEFEVLDTTGEEPKEIFISNITQANPGIVTCLENHPHKLETGQFLTFREINGMTGLNGSIQQITVISPFSFSIGDTTELEPYLHGGIAVQVKTPKTVFFESLERQLKHPKCLIVDFSNPEAPLEIHTAMLALDQFQEKYSRKPNVGCQQDSEELLKLATSISETLEEKPDVNADIVHWLSWTAQGFLSPLAAAVGGVASQEVLKAVTGKFSPLCQWLYLEAADIVESLGKPECEEFLPRGDRYDALRACIGDTLCQKLQNLNIFLVGCGAIGCEMLKNFALLGVGTSKEKGMITVTDPDLIEKSNLNRQFLFRPHHIQKPKSYTAADATLKINSQIKIDAHLNKVCPTTETIYNDEFYTKQDVIITALDNVEARRYVDSRCLANLRPLLDSGTMGTKGHTEVIVPHLTESYNSHRDPPEEEIPFCTLKSFPAAIEHTIQWARDKFESSFSHKPSLFNKFWQTYSSAEEVLQKIQSGHSLEGCFQVIKLLSRRPRNWSQCVELARLKFEKYFNHKALQLLHCFPLDIRLKDGSLFWQSPKRPPSPIKFDLNEPLHLSFLQNAAKLYATVYCIPFAEEDLSADALLNILSEVKIQEFKPSNKVVQTDETARKPDHVPISSEDERNAIFQLEKAILSNEATKSDLQMAVLSFEKDDDHNGHIDFITAASNLRAKMYSIEPADRFKTKRIAGKIIPAIATTTATVSGLVALEMIKVTGGYPFEAYKNCFLNLAIPIVVFTETTEVRKTKIRNGISFTIWDRWTVHGKEDFTLLDFINAVKEKYGIEPTMVVQGVKMLYVPVMPGHAKRLKLTMHKLVKPTTEKKYVDLTVSFAPDIDGDEDLPGPPVRYYFSHDTD

SEQ ID NO: 95351 - protein, 389 aa, Homo sapiens
  Payload ID: 19006
  Gene Name: ubiquitin-like modifier activating enzyme 6
  Uniprot ID: A0AVT1
  ENSP ID: ENSP00000399234
MEGSEPVAAHQGEEASCSSWGTGSTNKNLPIMSTASVEIDDALYSRQRYVLGDTAMQKMAKSHVFLSGMGGLGLEIAKNLVLAGIKAVTIHDTEKCQAWDLGTNFFLSEDDVVNKRNRAEAVLKHIAELNPYVHVTSSSVPFNETTDLSFLDKYQCVVLTEMKLPLQKKINDFCRSQCPPIKFISADVHGIWSRLFCDFGDEFEVLDTTGEEPKEIFISNITQANPGIVTCLENHPHKLETGQFLTFREINGMTGLNGSIQQITVISPFSFSIGDTTELEPYLHGGIAVQVKTPKTVFFESLERQLKHPKCLIVDFSNPEAPLEIHTAMLALDQFQEKYSRKPNVGCQQDSEELLKLATSISETLEEKVTIEIYGCPNICLLIHKCSVY

SEQ ID NO: 95352 - protein, 271 aa, Homo sapiens
  Payload ID: 19006
  Gene Name: ubiquitin-like modifier activating enzyme 6
  ENSP ID: ENSP00000421984
  MOD_RES (1)..(1): Any amino acid
XCGAIGCEMLKNFALLGVGTSKEKGMITVTDPDLIEKSNLNRQFLFRPHHIQKPKSYTAADATLKINSQIKIDAHLNKVCPTTETIYNDEFYTKQDVIITALDNVEARRYVDSRCLANLRPLLDSGTMGTKGHTEVIVPHLTESYNSHRDPPEEEIPFCTLKSFPAAIEHTIQWARDKFESSFSHKPSLFNKFWQTYSSAEEVLQALQLLHCFPLDIRLKDGSLFWQSPKRPPSPIKFDLNEPLHLSFLQNAAKLYATVYCIPFAEEVRYS

SEQ ID NO: 95353 - protein, 88 aa, Homo sapiens
  Payload ID: 19006
  Gene Name: ubiquitin-like modifier activating enzyme 6
  ENSP ID: ENSP00000425091
KDDDHNGHIDFITAASNLRAKMYSIEPADRFKTKRIAGKIIPAIATTTATVSGLKWNIIYNLGSMDRTWKRRFHPLGFHKCSQREVWN

SEQ ID NO: 95354 - protein, 1012 aa, Homo sapiens
  Payload ID: 19007
  Gene Name: ubiquitin-like modifier activating enzyme 7
  Uniprot ID: P41226
  ENSP ID: ENSP00000333266
MDALDASKLLDEELYSRQLYVLGSPAMQRIQGARVLVSGLQGLGAEVAKNLVLMGVGSLTLHDPHPTCWSDLAAQFLLSEQDLERSRAEASQELLAQLNRAVQVVVHTGDITEDLLLDFQVVVLTAAKLEEQLKVGTLCHKHGVCFLAADTRGLVGQLFCDFGEDFTVQDPTEAEPLTAAIQHISQGSPGILTLRKGANTHYFRDGDLVTFSGIEGMVELNDCDPRSIHVREDGSLEIGDTTTFSRYLRGGAITEVKRPKTVRHKSLDTALLQPHVVAQSSQEVHHAHCLHQAFCALHKFQHLHGRPPQPWDPVDAETVVGLARDLEPLKRTEEEPLEEPLDEALVRTVALSSAGVLSPMVAMLGAVAAQEVLKAISRKFMPLDQWLYFDALDCLPEDGELLPSPEDCALRGSRYDGQIAVFGAGFQEKLRRQHYLLVGAGAIGCELLKVFALVGLGAGNSGGLTVVDMDHIERSNLSRQFLFRSQDVGRPKAEVAAAAARGLNPDLQVIPLTYPLDPTTEHIYGDNFFSRVDGVAAALDSFQARRYVAARCTHYLKPLLEAGTSGTWGSATVFMPHVTEAYRAPASAAASEDAPYPVCTVRYFPSTAEHTLQWARHEFEELFRLSAETINHHQQAHTSLADMDEPQTLTLLKPVLGVLRVRPQNWQDCVAWALGHWKLCFHYGIKQLLRHFPPNKVLEDGTPFWSGPKQCPQPLEFDTNQDTHLLYVLAAANLYAQMHGLPGSQDWTALRELLKLLPQPDPQQMAPIFASNLELASASAEFGPEQQKELNKALEVWSVGPPLKPLMFEKDDDSNFHVDFVVAAASLRCQNYGIPPVNRAQSKRIVGQIIPAIATTTAAVAGLLGLELYKVVSGPRPRSAFRHSYLHLAENYLIRYMPFAPAIQTFHHLKWTSWDRLKVPAGQPERTLESLLAHLQEQHGLRVRILLHGSALLYAAGWSPEKQAQHLPLRVTELVQQLTGQAPAPGQRVLVLELSCEGDDEDTAFPPLHYEL

SEQ ID NO: 95355 - protein, 857 aa, Homo sapiens
  Payload ID: 19008
  Gene Name: ubiquitin-like with PHD and ring finger domains 1
  ENSP ID: ENSP00000478171
MPSFRGKKIRAAGSAAGSVCRAGAPGRTQVRAGSGPRTRFHRHPQPGHARRQTSCSRRPESADTMWIQVRTMDGRQTHTVDSLSRLTKVEELRRKIQELFHVEPGLQRLFYRGKQMEDGHTLFDYEVRLNDTIQLLVRQSLVLPHSTKERDSELSDTDSGCCLGQSESDKSSTHGEAAAETDSRPADEDMWDETELGLYKVNEYVDARDTNMGAWFEAQVVRVTRKAPSRDEPCSSTSRPALEEDVIYHVKYDDYPENGVVQMNSRDVRARARTIIKWQDLEVGQVVMLNYNPDNPKERGFWYDAEISRKRETRTARELYANVVLGDDSLNDCRIIFVDEVFKIERPGEGSPMVDNPMRRKSGPSCKHCKDDVNRLCRVCACHLCGGRQDPDKQLMCDECDMAFHIYCLDPPLSSVPSEDEWYCPECRNDASEVVLAGERLRESKKKAKMASATSSSQRDWGKGMACVGRTKECTIVPSNHYGPIPGIPVGTMWRFRVQVSESGVHRPHVAGIHGRSNDGAYSLVLAGGYEDDVDHGNFFTYTGSGGRDLSGNKRTAEQSCDQKLTNTNRALALNCFAPINDQEGAEAKDWRSGKPVRVVRNVKGGKNSKYAPAEGNRYDGIYKVVKYWPEKGKSGFLVWRYLLRRDDDEPGPWTKEGKDRIKKLGLTMQYPEGYLEALANREREKENSKREEEEQQEGGFASPRTGKGKWKRKSAGGGPSRAGSPRRTSKKTKVEPYSLTAQQSSLIREDKSNAKLWNEVLASLKDRPASGSPFQLFLSKVEETFQCICCQELVFRPITTVCQHNVCKDCLDRSFRAQVFSCPACRYDLGRSYAMQVNQPLQTVLNQLFPGYGNGR

SEQ ID NO: 95356 - protein, 793 aa, Homo sapiens
  Payload ID: 19008
  Gene Name: ubiquitin-like with PHD and ring finger domains 1
  Uniprot ID: Q96T88
  ENSP ID: ENSP00000478348
MWIQVRTMDGRQTHTVDSLSRLTKVEELRRKIQELFHVEPGLQRLFYRGKQMEDGHTLFDYEVRLNDTIQLLVRQSLVLPHSTKERDSELSDTDSGCCLGQSESDKSSTHGEAAAETDSRPADEDMWDETELGLYKVNEYVDARDTNMGAWFEAQVVRVTRKAPSRDEPCSSTSRPALEEDVIYHVKYDDYPENGVVQMNSRDVRARARTIIKWQDLEVGQVVMLNYNPDNPKERGFWYDAEISRKRETRTARELYANVVLGDDSLNDCRIIFVDEVFKIERPGEGSPMVDNPMRRKSGPSCKHCKDDVNRLCRVCACHLCGGRQDPDKQLMCDECDMAFHIYCLDPPLSSVPSEDEWYCPECRNDASEVVLAGERLRESKKKAKMASATSSSQRDWGKGMACVGRTKECTIVPSNHYGPIPGIPVGTMWRFRVQVSESGVHRPHVAGIHGRSNDGAYSLVLAGGYEDDVDHGNFFTYTGSGGRDLSGNKRTAEQSCDQKLTNTNRALALNCFAPINDQEGAEAKDWRSGKPVRVVRNVKGGKNSKYAPAEGNRYDGIYKVVKYWPEKGKSGFLVWRYLLRRDDDEPGPWTKEGKDRIKKLGLTMQYPEGYLEALANREREKENSKREEEEQQEGGFASPRTGKGKWKRKSAGGGPSRAGSPRRTSKKTKVEPYSLTAQQSSLIREDKSNAKLWNEVLASLKDRPASGSPFQLFLSKVEETFQCICCQELVFRPITTVCQHNVCKDCLDRSFRAQVFSCPACRYDLGRSYAMQVNQPLQTVLNQLFPGYGNGR

SEQ ID NO: 95357 - protein, 793 aa, Homo sapiens; identical to SEQ ID NO: 95356
  Payload ID: 19008
  Gene Name: ubiquitin-like with PHD and ring finger domains 1
  Uniprot ID: Q96T88
  ENSP ID: ENSP00000478601

SEQ ID NO: 95358 - protein, 806 aa, Homo sapiens
  Payload ID: 19008
  Gene Name: ubiquitin-like with PHD and ring finger domains 1
  ENSP ID: ENSP00000479617
MGVFAVPPLSADTMWIQVRTMDGRQTHTVDSLSRLTKVEELRRKIQELFHVEPGLQRLFYRGKQMEDGHTLFDYEVRLNDTIQLLVRQSLVLPHSTKERDSELSDTDSGCCLGQSESDKSSTHGEAAAETDSRPADEDMWDETELGLYKVNEYVDARDTNMGAWFEAQVVRVTRKAPSRDEPCSSTSRPALEEDVIYHVKYDDYPENGVVQMNSRDVRARARTIIKWQDLEVGQVVMLNYNPDNPKERGFWYDAEISRKRETRTARELYANVVLGDDSLNDCRIIFVDEVFKIERPGEGSPMVDNPMRRKSGPSCKHCKDDVNRLCRVCACHLCGGRQDPDKQLMCDECDMAFHIYCLDPPLSSVPSEDEWYCPECRNDASEVVLAGERLRESKKKAKMASATSSSQRDWGKGMACVGRTKECTIVPSNHYGPIPGIPVGTMWRFRVQVSESGVHRPHVAGIHGRSNDGAYSLVLAGGYEDDVDHGNFFTYTGSGGRDLSGNKRTAEQSCDQKLTNTNRALALNCFAPINDQEGAEAKDWRSGKPVRVVRNVKGGKNSKYAPAEGNRYDGIYKVVKYWPEKGKSGFLVWRYLLRRDDDEPGPWTKEGKDRIKKLGLTMQYPEGYLEALANREREKENSKREEEEQQEGGFASPRTGKGKWKRKSAGGGPSRAGSPRRTSKKTKVEPYSLTAQQSSLIREDKSNAKLWNEVLASLKDRPASGSPFQLFLSKVEETFQCICCQELVFRPITTVCQHNVCKDCLDRSFRAQVFSCPACRYDLGRSYAMQVNQPLQTVLNQLFPGYGNGR

SEQ ID NO: 95359 - protein, 496 aa, Homo sapiens
  Payload ID: 19008
  Gene Name: ubiquitin-like with PHD and ring finger domains 1
  ENSP ID: ENSP00000480214
IRAAGSAAGSVCRAGAPGRTQVRAGSGPRTRFHRHPQPGHARRQTSCSRRPESSVPSEDEWYCPECRNDASEVVLAGERLRESKKKAKMASATSSSQRDWGKGMACVGRTKECTIVPSNHYGPIPGIPVGTMWRFRVQVSESGVHRPHVAGIHGRSNDGAYSLVLAGGYEDDVDHGNFFTYTGSGGRDLSGNKRTAEQSCDQKLTNTNRALALNCFAPINDQEGAEAKDWRSGKPVRVVRNVKGGKNSKYAPAEGNRYDGIYKVVKYWPEKGKSGFLVWRYLLRRDDDEPGPWTKEGKDRIKKLGLTMQYPEGYLEALANREREKENSKREEEEQQEGGFASPRTGKGKWKRKSAGGGPSRAGSPRRTSKKTKVEPYSLTAQQSSLIREDKSNAKLWNEVLASLKDRPASGSPFQLFLSKVEETFQCICCQELVFRPITTVCQHNVCKDCLDRSFRAQVFSCPACRYDLGRSYAMQVNQPLQTVLNQLFPGYGNGR

SEQ ID NO: 95360 - protein, 793 aa, Homo sapiens; identical to SEQ ID NO: 95356
  Payload ID: 19008
  Gene Name: ubiquitin-like with PHD and ring finger domains 1
  Uniprot ID: Q96T88
  ENSP ID: ENSP00000484739

SEQ ID NO: 95361 - protein, 793 aa, Homo sapiens; identical to SEQ ID NO: 95356
  Payload ID: 19008
  Gene Name: ubiquitin-like with PHD and ring finger domains 1
  Uniprot ID: Q96T88
  ENSP ID: ENSP00000485604

SEQ ID NO: 95362 - protein, 802 aa, Homo sapiens
  Payload ID: 19009
  Gene Name: ubiquitin-like with PHD and ring finger domains 2, E3 ubiquitin protein ligase
  Uniprot ID: Q96PU4
  ENSP ID: ENSP00000276893
MWIQVRTIDGSKTCTIEDVSRKATIEELRERVWALFDVRPECQRLFYRGKQLENGYTLFDYDVGLNDIIQLLVRPDPDHLPGTSTQIEAKPCSNSPPKVKKAPRVGPSNQPSTSARARLIDPGFGIYKVNELVDARDVGLGAWFEAHIHSVTRASDGQSRGKTPLKNGSSCKRTNGNIKHKSKENTNKLDSVPSTSNSDCVAADEDVIYHIQYDEYPESGTLEMNVKDLRPRARTILKWNELNVGDVVMVNYNVESPGQRGFWFDAEITTLKTISRTKKELRVKIFLGGSEGTLNDCKIISVDEIFKIERPGAHPLSFADGKFLRRNDPECDLCGGDPEKKCHSCSCRVCGGKHEPNMQLLCDECNVAYHIYCLNPPLDKVPEEEYWYCPSCKTDSSEVVKAGERLKMSKKKAKMPSASTESRRDWGRGMACVGRTRECTIVPSNHYGPIPGIPVGSTWRFRVQVSEAGVHRPHVGGIHGRSNDGAYSLVLAGGFADEVDRGDEFTYTGSGGKNLAGNKRIGAPSADQTLTNMNRALALNCDAPLDDKIGAESRNWRAGKPVRVIRSFKGRKISKYAPEEGNRYDGIYKVVKYWPEISSSHGFLVWRYLLRRDDVEPAPWTSEGIERSRRLCLRLQYPAGYPSDKEGKKPKGQSKKQPSGTTKRPISDDDCPSASKVYKASDSAEAIEAFQLTPQQQHLIREDCQNQKLWDEVLSHLVEGPNFLKKLEQSFMCVCCQELVYQPVTTECFHNVCKDCLQRSFKAQVFSCPACRHDLGQNYIMIPNEILQTLLDLFFPGYSKGR

SEQ ID NO: 95363 - protein, 136 aa, Homo sapiens
  Payload ID: 19009
  Gene Name: ubiquitin-like with PHD and ring finger domains 2, E3 ubiquitin protein ligase
  ENSP ID: ENSP00000370778
MWIQVRTIDGSKTCTIEDVSRKATIEELRERVWALFDVRPECQRLFYRGKQLENGYTLFDYDVGLNDIIQLLVRPDPDHLPGTSTQIEAKPCSNSPPKVKKAPRVGPSNQPSTSARARLIDPGFGIYKGLALSPRL

SEQ ID NO: 95364 - protein, 112 aa, Homo sapiens
  Payload ID: 19009
  Gene Name: ubiquitin-like with PHD and ring finger domains 2, E3 ubiquitin protein ligase
  ENSP ID: ENSP00000399217
MNVKDLRPRARTILKWNELNVGDVVMVNYNVESPGQRGFWFDAEITTLKTISRTKKELRVKIFLGGSEGTLNDCKIISVDEIFKIERPGAHPLSFADGKFLRRNDPECDLCG

SEQ ID NO: 95365 - protein, 503 aa, Homo sapiens
  Payload ID: 19009
  Gene Name: ubiquitin-like with PHD and ring finger domains 2, E3 ubiquitin protein ligase
  Uniprot ID: Q96PU4
  ENSP ID: ENSP00000434182
MWIQVRTIDGSKTCTIEDVSRKATIEELRERVWALFDVRPECQRLFYRGKQLENGYTLFDYDVGLNDIIQLLVRPDPDHLPGTSTQIEAKPCSNSPPKVKKAPRVGPSNQPSTSARARLIDPGFGIYKVNELVDARDVGLGAWFEAHIHSVTRASDGQSRGKTPLKNGSSCKRTNGNIKHKSKENTNKLDSVPSTSNSDCVAADEDVIYHIQYDEYPESGTLEMNVKDLRPRARTILKWNELNVGDVVMVNYNVESPGQRGFWFDAEITTLKTISRTKKELRVKIFLGGSEGTLNDCKIISVDEIFKIERPGAHPLSFADGKFLRRNDPECDLCGGDPEKKCHSCSCRVCGGKHEPNMQLLCDECNVAYHIYCLNPPLDKVPEEEYWYCPSCKTDSSEVVKAGERLKMSKKKAKMPSASTESRRDWGRGMACVGRTRECTIVPSNHYGPIPGIPVGSTWRFRVQVSEAGVHRPHVGGIHGRSNDGAYSLVLAGGFADEVLTEL

SEQ ID NO: 95366 - protein, 1347 aa, Homo sapiens
  Payload ID: 19010
  Gene Name: ubiquitously transcribed tetratricopeptide repeat containing, Y-linked
  Uniprot ID: O14607
  ENSP ID: ENSP00000328939
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 95367 - protein, 1079 aa, Homo sapiens
  Payload ID: 19010
  Gene Name: ubiquitously transcribed tetratricopeptide repeat containing, Y-linked
  Uniprot ID: O14607
  ENSP ID: ENSP00000330446
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLRAGMQWCDLSSLQPPPPGFKRFSHLSLPNSWNYRHLPSCPTNFCIFVETGFHHVGQACLELLTSGGLLASASQSAGITGVSHHAR

SEQ ID NO: 95368 - protein, 1240 aa, Homo sapiens
  Payload ID: 19010
  Gene Name: ubiquitously transcribed tetratricopeptide repeat containing, Y-linked
  Uniprot ID: O14607
  ENSP ID: ENSP00000355420
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIK

SEQ ID NO: 95369 - protein, 207 aa, Homo sapiens
  Payload ID: 19010
  Gene Name: ubiquitously transcribed tetratricopeptide repeat containing, Y-linked
  ENSP ID: ENSP00000372349
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAESKYF

SEQ ID NO: 95370 - protein, 1392 aa, Homo sapiens
  Payload ID: 19010
  Gene Name: ubiquitously transcribed tetratricopeptide repeat containing, Y-linked
  Uniprot ID: O14607
  ENSP ID: ENSP00000372352
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 95371 - protein, 1335 aa, Homo sapiens
  Payload ID: 19010
  Gene Name: ubiquitously transcribed tetratricopeptide repeat containing, Y-linked
  ENSP ID: ENSP00000439922
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEALSLSSSS

SEQ ID NO: 95372 - protein, 1389 aa, Homo sapiens
  Payload ID: 19010
  Gene Name: ubiquitously transcribed tetratricopeptide repeat containing, Y-linked
  ENSP ID: ENSP00000441943
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGSVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQQSLSLHMITSSQVEGLSSPAKKKRTSSPTKNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 95373 - protein, 1444 aa, Homo sapiens
  Payload ID: 19010
  Gene Name: ubiquitously transcribed tetratricopeptide repeat containing, Y-linked
  ENSP ID: ENSP00000442047
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQAYRAHDPNTEHVLNHSQTPILQQSLSLHMITSSQVEGLSSPAKKKRTSSPTKNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 95374 - protein, 1363 aa, Homo sapiens
  Payload ID: 19010
  Gene Name: ubiquitously transcribed tetratricopeptide repeat containing, Y-linked
  ENSP ID: ENSP00000445274
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQAYLGHLTGFIQDNCNKGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 95375 - protein, 1399 aa, Homo sapiens
  Payload ID: 19010
  Gene Name: ubiquitously transcribed tetratricopeptide repeat containing, Y-linked
  ENSP ID: ENSP00000483735
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAYRAHDPNTEHVLNHSQTPILQQSLSLHMITSSQVEGLSSPAKKKRTSSPTKNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 95376 - protein, 1264 aa, Homo sapiens
  Payload ID: 19010
  Gene Name: ubiquitously transcribed tetratricopeptide repeat containing, Y-linked
  ENSP ID: ENSP00000484698
MKSCAVSLTTAAVAFGDEAKKMAEGKASRESEEESVSLTVEEREALGGMDSRLFGFVRLHEDGARTKTLLGKNAAFLYGLGLVYFYYNAFHWAIKAFQDVLYVDPSFCRAKEIHLRLGLMFKVNTDYKSSLKRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 95377 - protein, 1367 aa, Homo sapiens
  Payload ID: 19010
  Gene Name: ubiquitously transcribed tetratricopeptide repeat containing, Y-linked
  ENSP ID: ENSP00000485013
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSEKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 95378 - protein, 1211 aa, Homo sapiens
  Payload ID: 19010
  Gene Name: ubiquitously transcribed tetratricopeptide repeat containing, Y-linked
  Uniprot ID: O14607
  ENSP ID: ENSP00000485539
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQNGSDNWNGGQSLSHHPVQQVYSLCLTPQKLQHLEQLRANRDNLNPAQKHQLEQLESQFVLMQQMRHKEVAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEALSLSSSS

SEQ ID NO: 95379 - protein, 157 aa, Homo sapiens
  Payload ID: 19011
  Gene Name: ubiquitously-expressed, prefoldin-like chaperone
  Uniprot ID: Q9UBK9
  ENSP ID: ENSP00000327797
MATPPKRRAVEATGEKVLRYETFISDVLQRDLRKVLDHRDKVYEQLAKYLQLRNVIERLQEAKHSELYMQVDLGCNFFVDTVVPDTSRIYVALGYGFFLELTLAEALKFIDRKSSLLTELSNSLTKDSMNIKAHIHMLLEGLRELQGLQNFPEKPHH

SEQ ID NO: 95380 - protein, 169 aa, Homo sapiens
  Payload ID: 19011
  Gene Name: ubiquitously-expressed, prefoldin-like chaperone
  ENSP ID: ENSP00000337393
MVFPLPTPQEPIMATPPKRRAVEATGEKVLRYETFISDVLQRDLRKVLDHRDKVYEQLAKYLQLRNVIERLQEAKHSELYMQVDLGCNFFVDTVVPDTSRIYVALGYGFFLELTLAEALKFIDRKSSLLTELSNSLTKDSMNIKAHIHMLLEGLRELQGLQNFPEKPHH

SEQ ID NO: 95381 - protein, 99 aa, Homo sapiens
  Payload ID: 19011
  Gene Name: ubiquitously-expressed, prefoldin-like chaperone
  ENSP ID: ENSP00000473785
MVFPLPTPQEPIMATPPKRRAVEATGEKVLRYETFISDVLQRDLRKVLDHRDKVYEQLAKYLQLRNVIERLQPRYFTHLCGPGIWFFPGVDTGRSSQVH

SEQ ID NO: 95382 - protein, 541 aa, Homo sapiens
  Payload ID: 19012
  Gene Name: U-box domain containing 5
  Uniprot ID: O94941
  ENSP ID: ENSP00000217173
MVINLCLPQFRPRIHCNKISADGYEVENLISEDLTKRSHGFRTEYFIKPPVYVTVSFPFNVEICRINIDLTAGGGQNVTGLEMYTSASSSRVSWNTPQCRTLGPAEPSVPDKEAFTLVGKVLLKNQSQVVFSHRGFKARPPFGAMEATLPSPAVVAQELWNKGALSLSHVAHLRICITHVTGGGIPCIKRLEVWGQPAKTCSQEVIDSILLVTSENLPQDVALQAPALPMESDCDPGDQPESQQAPSSLQKLAEIIQDVPEEFLDPITLEIMPCPMLLPSGKVIDQSTLEKCNRSEATWGRVPSDPFTGVAFTPHSQPLPHPSLKARIDHFLLQHSIPGCHLLGRAQTALAVIPSSIVLPSQKRKIEQAEHVPDSNFGVNASCFSATSPLVLPTTSEHTAKKMKATNEPSLTHMDCSTGPLSHEQKLSQSLEIALASTLGSMPSFTARLTRGQLQHLGTRGSNTSWRPGTGSEQPGSILGPECASCKRVFSPYFKKEPVYQLPCGHLLCRPCLGEKQRSLPMTCTACQRPVASQDVLRVHF

SEQ ID NO: 95383 - protein, 487 aa, Homo sapiens
  Payload ID: 19012
  Gene Name: U-box domain containing 5
  Uniprot ID: O94941
  ENSP ID: ENSP00000311726
MVINLCLPQFRPRIHCNKISADGYEVENLISEDLTKRSHGFRTEYFIKPPVYVTVSFPFNVEICRINIDLTAGGGQNVTGLEMYTSASSSRVSWNTPQCRTLGPAEPSVPDKEAFTLVGKVLLKNQSQVVFSHRGFKARPPFGAMEATLPSPAVVAQELWNKGALSLSHVAHLRICITHVTGGGIPCIKRLEVWGQPAKTCSQEVIDSILLVTSENLPQDVALQAPALPMESDCDPGDQPESQQAPSSLQKLAEIIQDVPEEFLDPITLEIMPCPMLLPSGKVIDQSTLEKCNRSEATWGRVPSDPFTGVAFTPHSQPLPHPSLKARIDHFLLQHSIPGCHLLGRAQTALAVIPSSIVLPSQKRKIEQAEHVPDSNFGVNASCFSATSPLVLPTTSEHTAKKMKATNEPSLTHMDCSTEQPGSILGPECASCKRVFSPYFKKEPVYQLPCGHLLCRPCLGEKQRSLPMTCTACQRPVASQDVLRVHF

SEQ ID NO: 95384 - protein, 88 aa, Homo sapiens
  Payload ID: 19012
  Gene Name: U-box domain containing 5
  ENSP ID: ENSP00000404364
MVINLCLPQFRPRIHCNKISADGYEVENLISEDLTKRSHGFRTEYFIKPPVYVTVSFPFNVEICRINIDLTAGGGQNVTGLEMYTSAS

SEQ ID NO: 95385 - protein, 312 aa, Homo sapiens
  Payload ID: 19013
  Gene Name: UBX domain protein 1
  Uniprot ID: Q04323
  ENSP ID: ENSP00000294119
MAELTALESLIEMGFPRGRAEKALALTGNQGIEAAMDWLMEHEDDPDVDEPLETPLGHILGREPTSSEQGGLEGSGSAAGEGKPALSEEERQEQTKRMLELVAQKQREREEREEREALERERQRRRQGQELSAARQRLQEDEMRRAAEERRREKAEELAARQRVREKIERDKAERAKKYGGSVGSQPPPVAPEPGPVPSSPSQEPPTKREYDQCRIQVRLPDGTSLTQTFRAREQLAAVRLYVELHRGEELGGGQDPVQLLSGFPRRAFSEADMERPLQELGMAARLETRTRNWGSREACLGKGGMQREGAL

SEQ ID NO: 95386 - protein, 297 aa, Homo sapiens
  Payload ID: 19013
  Gene Name: UBX domain protein 1
  Uniprot ID: Q04323
  ENSP ID: ENSP00000303991
MAELTALESLIEMGFPRGRAEKALALTGNQGIEAAMDWLMEHEDDPDVDEPLETPLGHILGREPTSSEQGGLEGSGSAAGEGKPALSEEERQEQTKRMLELVAQKQREREEREEREALERERQRRRQGQELSAARQRLQEDEMRRAAEERRREKAEELAARQRVREKIERDKAERAKKYGGSVGSQPPPVAPEPGPVPSSPSQEPPTKREYDQCRIQVRLPDGTSLTQTFRAREQLAAVRLYVELHRGEELGGGQDPVQLLSGFPRRAFSEADMERPLQELGLVPSAVLIVAKKCPS

SEQ ID NO: 95387 - protein, 100 aa, Homo sapiens
  Payload ID: 19013
  Gene Name: UBX domain protein 1
  ENSP ID: ENSP00000432189
MRRAAEERRREKAEELAARQRVREKIERDKAERAKKYGGSVGSQPPPVAPEPGPVPSSPSQEPPTKREYDQCRIQDSCLLLFSLWPRNVPAEGLCPIVPL

SEQ ID NO: 95388 - protein, 290 aa, Homo sapiens
  Payload ID: 19013
  Gene Name: UBX domain protein 1
  ENSP ID: ENSP00000435625
MAELTALESLIEMGFPRGRAEKALALTGNQGIEAAMDWLMEHEDDPDVDEPLETPLGHILGREPTSSEQGGLEGSGSAAGEGKPALSEEERQEQTKRMLELVAQKQREREEREEREALERERQRRRQGQELSAARQRLQEDEMRRAAEERRREKAEELAARQRVREKIERDKAERAKKYGGSVGSQPPPVAPEPGPVPSSPSQEPPTKREYDQCRIQVRLPDGTSLTQTFRAREQLAAVRLYVELHRGEELGGGQDPVQLLSGFPRRAFSEADMERPLQELGLVPSAVLI

SEQ ID NO: 95389 - protein, 293 aa, Homo sapiens
  Payload ID: 19013
  Gene Name: UBX domain protein 1
  ENSP ID: ENSP00000435964
MAELTALESLIEMGFPRGRAEKALALTGNQGIEAAMDWLMEHEDDPDVDEPLETPLGHILGREPTSSEQGGLEGSGSAAGEGKPALSEEERQEQTKRMLELVAQKQREREEREEREALERERQRRRQGQELSAARQRLQEDEMRRAAEERRREKAEEQRVREKIERDKAERAKKYGGSVGSQPPPVAPEPGPVPSSPSQEPPTKREYDQCRIQVRLPDGTSLTQTFRAREQLAAVRLYVELHRGEELGGGQDPVQLLSGFPRRAFSEADMERPLQELGLVPSAVLIVAKKCPS

SEQ ID NO: 95390 - protein, 238 aa, Homo sapiens
  Payload ID: 19013
  Gene Name: UBX domain protein 1
  ENSP ID: ENSP00000478250
MAELTALESLIEMGFPRGRAEKALALTGNQGIEAAMDWMLELVAQKQREREEREEREALERERQRRRQGQELSAARQRLQEDEMRRAAEERRREKAEELAARQRVREKIERDKAERAKKYGGSVGSQPPPVAPEPGPVPSSPSQEPPTKREYDQCRIQVRLPDGTSLTQTFRAREQLAAVRLYVELHRGEELGGGQDPVQLLSGFPRRAFSEADMERPLQELGLVPSAVLIVAKKCPS

SEQ ID NO: 95391 - protein, 280 aa, Homo sapiens
  Payload ID: 19014
  Gene Name: UBX domain protein 10
  Uniprot ID: Q96LJ8
  ENSP ID: ENSP00000364240
MATEAPVNIAPPECSTVVSTAVDSLIWQPNSLNMHMIRPKSAKGRTRPSLQKSQGVEVCAHHIPSPPPAIPYELPSSQKPGACAPKSPNQGASDEIPELQQQVPTGASSSLNKYPVLPSINRKNLEEEAVETVAKKASSLQLSSIRALYQDETGTMKTSEEDSRARACAVERKFIVRTKKQGSSRAGNLEEPSDQEPRLLLAVRSPTGQRFVRHFRPTDDLQTIVAVAEQKNKTSYRHCSIETMEVPRRRFSDLTKSLQECRIPHKSVLGISLEDGEGWP

SEQ ID NO: 95392 - protein, 400 aa, Homo sapiens
  Payload ID: 19015
  Gene Name: UBX domain protein 11
  Uniprot ID: Q5T124
  ENSP ID: ENSP00000324721
MSSPLASLSKTRKVPLPSEPMNPGRRGIRIYGDEDEVDMLSDGCGSEEKISVPSCYGGIGAPVSRQGDSLAPPEVDFDRLLASLQDLSELVVEGDTQVTPVPGGARLRTLEPIPLKLYRNGIMMFDGPFQPFYDPSTQRCLRDILDGFFPSELQRLYPNGVPFKVSDLRNQVYLEDGLDPFPGEGRVVGRQLMHKALDRVEEHPGSRMTAEKFLNRLPKFVIRQGEVIDIRGPIRDTLQNCCPLPARIQEIVVETPTLAAERERSQESPNTPAPPLSMLRIKSENGEQAFLLMMQPDNTIGDVRALLAQARVMDASAFEIFSTFPPTLYQDDTLTLQAAGLVPKAALLLRARRAPKSSLKFSPGPCPGPGPGPSPGPGPGPSPGPGPGPSPCPGPSPSPQ

SEQ ID NO: 95393 - protein, 487 aa, Homo sapiens
  Payload ID: 19015
  Gene Name: UBX domain protein 11
  Uniprot ID: Q5T124
  ENSP ID: ENSP00000349601
MSSPLASLSKTRKVPLPSEPMNPGRRGIRIYGDVPASHDSELMAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGDSLAPPEVDFDRLLASLQDLSELVVEGDTQVTPVPGGARLRTLEPIPLKLYRNGIMMFDGPFQPFYDPSTQRCLRDILDGFFPSELQRLYPNGVPFKVSDLRNQVYLEDGLDPFPGEGRVVGRQLMHKALDRVEEHPGSRMTAEKFLNRLPKFVIRQGEVIDIRGPIRDTLQNCCPLPARIQEIVVETPTLAAERERSQESPNTPAPPLSMLRIKSENGEQAFLLMMQPDNTIGDVRALLAQARVMDASAFEIFSTFPPTLYQDDTLTLQAAGLVPKAALLLRARRAPKSSLKFSPGPCPGPGPGPSPGPGPGPSPGPGPGPSPCPGPSPSPQ

SEQ ID NO: 95394 - protein, 247 aa, Homo sapiens
  Payload ID: 19015
  Gene Name: UBX domain protein 11
  ENSP ID: ENSP00000363332
MLSDGCGSEEKISVPSCYGGIGAPVSRQVPASHDSELMAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGDSLAPPEVDFDRLLASLQDLSELVVEGDTQVTPVPGGARLRTLEPIPLKLYRNGIMMFDGPFQPFYDPSTQRCLRDILDGFFPSELQRLYPNGVPFKV

SEQ ID NO: 95395 - protein, 487 aa, Homo sapiens; identical to SEQ ID NO: 95393
  Payload ID: 19015
  Gene Name: UBX domain protein 11
  Uniprot ID: Q5T124
  ENSP ID: ENSP00000363334

SEQ ID NO: 95396 - protein, 520 aa, Homo sapiens
  Payload ID: 19015
  Gene Name: UBX domain protein 11
  Uniprot ID: Q5T124
  ENSP ID: ENSP00000363338
MSSPLASLSKTRKVPLPSEPMNPGRRGIRIYGDEDEVDMLSDGCGSEEKISVPSCYGGIGAPVSRQVPASHDSELMAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGDSLAPPEVDFDRLLASLQDLSELVVEGDTQVTPVPGGARLRTLEPIPLKLYRNGIMMFDGPFQPFYDPSTQRCLRDILDGFFPSELQRLYPNGVPFKVSDLRNQVYLEDGLDPFPGEGRVVGRQLMHKALDRVEEHPGSRMTAEKFLNRLPKFVIRQGEVIDIRGPIRDTLQNCCPLPARIQEIVVETPTLAAERERSQESPNTPAPPLSMLRIKSENGEQAFLLMMQPDNTIGDVRALLAQARVMDASAFEIFSTFPPTLYQDDTLTLQAAGLVPKAALLLRARRAPKSSLKFSPGPCPGPGPGPSPGPGPGPSPGPGPGPSPCPGPSPSPQ

SEQ ID NO: 95397 - protein, 520 aa, Homo sapiens; identical to SEQ ID NO: 95396
  Payload ID: 19015
  Gene Name: UBX domain protein 11
  Uniprot ID: Q5T124
  ENSP ID: ENSP00000363339

SEQ ID NO: 95398 - protein, 277 aa, Homo sapiens
  Payload ID: 19015
  Gene Name: UBX domain protein 11
  ENSP ID: ENSP00000363340
MFDGPFQPFYDPSTQRCLRDILDGFFPSELQRLYPNGVPFKVSDLRNQVYLEDGLDPFPGEGRVVGRQLMHKALDRVEEHPGSRMTAEKFLNRLPKFVIRQGEVIDIRGPIRDTLQNCCPLPARIQEIVVETPTLAAERERSQESPNTPAPPLSMLRIKSENGEQAFLLMMQPDNTIGDVRALLAQARVMDASAFEIFSTFPPTLYQDDTLTLQAAGLVPKAALLLRARRAPKSSLKFSPGPCPGPGPGPSPGPGPGPSPGPGPGPSPCPGPSPSPQ

SEQ ID NO: 95399 - protein, 148 aa, Homo sapiens
  Payload ID: 19015
  Gene Name: UBX domain protein 11
  ENSP ID: ENSP00000394036
MLSDGCGSEEKISVPSCYGGIGAPVSRQVPASHDSELMAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKP

SEQ ID NO: 95400 - protein, 134 aa, Homo sapiens
  Payload ID: 19015
  Gene Name: UBX domain protein 11
  ENSP ID: ENSP00000395165
MSSPLASLSKTRKVPLPSEPMNPGRRGIRIYGDEDEVDMLSDGCGSEEKISVPSCYGGIGAPVSRQVPASHDSELMAFMTRKLWDLEQQVKAQTDEILSKDQKIAALEDLVQTLRPHPAEATLQRQEELETMCV

SEQ ID NO: 95401 - protein, 185 aa, Homo sapiens
  Payload ID: 19015
  Gene Name: UBX domain protein 11
  ENSP ID: ENSP00000404956
MSSPLASLSKTRKVPLPSEPMNPGRRGIRIYGDVPASHDSELMAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGDSLAPPEVDFDRLLASLQDLSELVVEGDTQV

SEQ ID NO: 95402 - protein, 207 aa, Homo sapiens
  Payload ID: 19015
  Gene Name: UBX domain protein 11
  ENSP ID: ENSP00000410357
MSSPLASLSKTRKVPLPSEPMNPGRRGIRIYGDVPASHDSELMAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGDSLAPPEVDFDRLLASLQDLSELVVEGDTQVTPVPGGARLRTLEPIPLKLYRN

SEQ ID NO: 95403 - protein, 115 aa, Homo sapiens
  Payload ID: 19015
  Gene Name: UBX domain protein 11
  ENSP ID: ENSP00000413448
MAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGRAG

SEQ ID NO: 95404 - protein, 259 aa, Homo sapiens
  Payload ID: 19016
  Gene Name: UBX domain protein 2A
  Uniprot ID: P68543
  ENSP ID: ENSP00000312107
MKDVDNLKSIKEEWVCETGSDNQPLGNNQQSNCEYFVDSLFEEAQKVSSKCVSPAEQKKQVDVNIKLWKNGFTVNDDFRSYSDGASQQFLNSIKKGELPSELQGIFDKEEVDVKVEDKKNEICLSTKPVFQPFSGQGHRLGSATPKIVSKAKNIEVENKNNLSAVPLNNLEPITNIQIWLANGKRIVQKFNITHRVSHIKDFIEKYQGSQRSPPFSLATALPVLRLLDETLTLEEADLQNAVIIQRLQKTASFRELSEH

SEQ ID NO: 95405 - protein, 259 aa, Homo sapiens; identical to SEQ ID NO: 95404
  Payload ID: 19016
  Gene Name: UBX domain protein 2A
  Uniprot ID: P68543
  ENSP ID: ENSP00000385525

SEQ ID NO: 95406 - protein, 206 aa, Homo sapiens
  Payload ID: 19016
  Gene Name: UBX domain protein 2A
  Uniprot ID: P68543
  ENSP ID: ENSP00000440533
MKDVDNLKSIKEEWVCETGSDNQPLGNNQQSNCEYFVDSLFEEAQKVSSKCVSPAEQKKQVDVNIKLWKNGFTVNDDFRSYSDGASQQFLNSIKKGELPSELQGIFDKEEVDVKVEDKKNEICLSTKPVFQPFSGQGHRLGRVSHIKDFIEKYQGSQRSPPFSLATALPVLRLLDETLTLEEADLQNAVIIQRLQKTASFRELSEH

SEQ ID NO: 95407 - protein, 331 aa, Homo sapiens
  Payload ID: 19017
  Gene Name: UBX domain protein 2B
  Uniprot ID: Q14CS0
  ENSP ID: ENSP00000382507
MAEGGGPEPGEQERRSSGPRPPSARDLQLALAELYEDEVKCKSSKSNRPKATVFKSPRTPPQRFYSSEHEYSGLNIVRPSTGKIVNELFKEAREHGAVPLNEATRASGDDKSKSFTGGGYRLGSSFCKRSEYIYGENQLQDVQILLKLWSNGFSLDDGELRPYNEPTNAQFLESVKRGEIPLELQRLVHGGQVNLDMEDHQDQEYIKPRLRFKAFSGEGQKLGSLTPEIVSTPSSPEEEDKSILNAVVLIDDSVPTTKIQIRLADGSRLIQRFNSTHRILDVRNFIVQSRPEFAALDFILVTSFPNKELTDESLTLLEADILNTVLLQQLK

SEQ ID NO: 95408 - protein, 104 aa, Homo sapiens
  Payload ID: 19017
  Gene Name: UBX domain protein 2B
  ENSP ID: ENSP00000427759
MAEGGGPEPGEQERRSSGPRPPSARDLQLALAELYEDEVKCKSSKSNRPKATVFKSPRTPPQRHLQVEDTDWVVLFVSGLNISMEKISCKMFRFCLNCGAMVSV

SEQ ID NO: 95409 - protein, 142 aa, Homo sapiens
  Payload ID: 19017
  Gene Name: UBX domain protein 2B
  ENSP ID: ENSP00000428241
  MOD_RES (1)..(1): Any amino acid
XSPRTPPQRFYSSEHEYSGLNIVRPSTGKIVNELFKEAREHGAVPLNEATRASGDDKSKSFTGGGYRLGSSFCKRSEYIYGENQLQDVQILLKLWSNGFSLDDGELRPYNEPTNAQFLESVKRGVTLIACMPEIQQLMLEIF

SEQ ID NO: 95410 - protein, 196 aa, Homo sapiens
  Payload ID: 19017
  Gene Name: UBX domain protein 2B
  ENSP ID: ENSP00000428314
MAEGGGPEPGEQERRSSGPRPPSARDLQLALAELYEDEVKCKSSKSNRPKATVFKSPRTPPQRFYSSEHEYSGLNIVRPSTGKIVNELFKEAREHGAVPLNEATRASGDDKSKSFTGGGYRLGSSFCKRSEYIYGENQLQDVQILLKLWSNGFSLDDGELRPYNEPTNAQFLESVKRGVTLIACMPEIQQLMLEIF

SEQ ID NO: 95411 - protein, 508 aa, Homo sapiens
  Payload ID: 19018
  Gene Name: UBX domain protein 4
  Uniprot ID: Q92575
  ENSP ID: ENSP00000272638
MLWFQGAIPAAIATAKRSGAVFVVFVAGDDEQSTQMAASWEDDKVTEASSNSFVAIKIDTKSEACLQFSQIYPVVCVPSSFFIGDSGIPLEVIAGSVSADELVTRIHKVRQMHLLKSETSVANGSQSESSVSTPSASFEPNNTCENSQSRNAELCEIPPTSDTKSDTATGGESAGHATSSQEPSGCSDQRPAEDLNIRVERLTKKLEERREEKRKEEEQREIKKEIERRKTGKEMLDYKRKQEEELTKRMLEERNREKAEDRAARERIKQQIALDRAERAARFAKTKEEVEAAKAAALLAKQAEMEVKRESYARERSTVARIQFRLPDGSSFTNQFPSDAPLEEARQFAAQTVGNTYGNFSLATMFPRREFTKEDYKKKLLDLELAPSASVVLLPAGRPTASIVHSSSGDIWTLLGTVLYPFLAIWRLISNFLFSNPPPTQTSVRVTSSEPPNPASSSKSEKREPVRKRVLEKRGDDFKKEGKIYRLRTQDDGEDENNTWNGNSTQQM

SEQ ID NO: 95412 - protein, 95 aa, Homo sapiens
  Payload ID: 19018
  Gene Name: UBX domain protein 4
  ENSP ID: ENSP00000391586
MLWFQGAIPAAIATAKRSGAVFVVFVAGDDEQSTQMAASWEDDKVTEASSNSFVAIKIDTKSEACLQFSQICILSVKNGLYIYIYLPSFWLIYEI

SEQ ID NO: 95413 - protein, 117 aa, Homo sapiens
  Payload ID: 19018
  Gene Name: UBX domain protein 4
  ENSP ID: ENSP00000401748
MLWFQGAIPAAIATAKRSGAVFVVFVADGLTVSPRLECSGAISAHCNFHLPSASNSPASASYVGDDEQSTQMAASWEDDKVTEASSNSFVAIKIDTKSEACLQFSQIYPVVCVPSSF

SEQ ID NO: 95414 - protein, 65 aa, Homo sapiens
  Payload ID: 19018
  Gene Name: UBX domain protein 4
  ENSP ID: ENSP00000410516
MLWFQGAIPAAIATAKRSGAVFVVFVAGDDEQSTQMAASWEDDKVTEASSNSFVAIKIDTKRCIC

SEQ ID NO: 95415 - protein, 441 aa, Homo sapiens
  Payload ID: 19019
  Gene Name: UBX domain protein 6
  Uniprot ID: Q9BZV1
  ENSP ID: ENSP00000301281
MKKFFQEFKADIKFKSAGPGQKLKESVGEKAHKEKPNQPAPRPPRQGPTNEAQMAAAAALARLEQKQSRAWGPTSQDTIRNQVRKELQAEATVSGSPEAPGTNVVSEPREEGSAHLAVPGVYFTCPLTGATLRKDQRDACIKEAILLHFSTDPVAASIMKIYTFNKDQDRVKLGVDTIAKYLDNIHLHPEEEKYRKIKLQNKVFQERINCLEGTHEFFEAIGFQKVLLPAQDQEDPEEFYVLSETTLAQPQSLERHKEQLLAAEPVRAKLDRQRRVFQPSPLASQFELPGDFFNLTAEEIKREQRLRSEAVERLSVLRTKAMREKEEQRGLRKYNYTLLRVRLPDGCLLQGTFYARERLGAVYGFVREALQSDWLPFELLASGGQKLSEDENLALNECGLVPSALLTFSWDMAVLEDIKAAGAEPDSILKPELLSAIEKLL

SEQ ID NO: 95416 - protein, 388 aa, Homo sapiens
  Payload ID: 19019
  Gene Name: UBX domain protein 6
  Uniprot ID: Q9BZV1
  ENSP ID: ENSP00000378246
MAAAAALARLEQKQSRAWGPTSQDTIRNQVRKELQAEATVSGSPEAPGTNVVSEPREEGSAHLAVPGVYFTCPLTGATLRKDQRDACIKEAILLHFSTDPVAASIMKIYTFNKDQDRVKLGVDTIAKYLDNIHLHPEEEKYRKIKLQNKVFQERINCLEGTHEFFEAIGFQKVLLPAQDQEDPEEFYVLSETTLAQPQSLERHKEQLLAAEPVRAKLDRQRRVFQPSPLASQFELPGDFFNLTAEEIKREQRLRSEAVERLSVLRTKAMREKEEQRGLRKYNYTLLRVRLPDGCLLQGTFYARERLGAVYGFVREALQSDWLPFELLASGGQKLSEDENLALNECGLVPSALLTFSWDMAVLEDIKAAGAEPDSILKPELLSAIEKLL

SEQ ID NO: 95417 - protein, 129 aa, Homo sapiens
  Payload ID: 19019
  Gene Name: UBX domain protein 6
  ENSP ID: ENSP00000464967
MRPGEKAHKEKPNQPAPRPPRQGPTNEAQMAAAAALARLEQKQSRAWGPTSQDTIRNQVRKELQAEATVSGSPEAPGTNVVSEPREEGSAHLAVPGVYFTCPLTGATLRKDQRDACIKEAILLHFSTDP

SEQ ID NO: 95418 - protein, 67 aa, Homo sapiens
  Payload ID: 19019
  Gene Name: UBX domain protein 6
  ENSP ID: ENSP00000466148
  MOD_RES (1)..(1): Any amino acid
XAKLDRQRRVFQPSPLASQFELPGDFFNLTAEEIKREQRLRHFLRSGAAGGGVRVRPGGPAERLAAF

SEQ ID NO: 95419 - protein, 371 aa, Homo sapiens
  Payload ID: 19019
  Gene Name: UBX domain protein 6
  ENSP ID: ENSP00000467206
  MOD_RES (1)..(1): Any amino acid
XEKAHKEKPNQPAPRPPRQGPTNEAQMAAAAALARLEQKQSRAWGPTSQDTIRNQVRKELQAEATVSGSPEAPGTNVHFSTDPVAASIMKIYTFNKDQDRVKLGVDTIAKYLDNIHLHPEEEKYRKIKLQNKVFQERINCLEGTHEFFEAIGFQKVLLPAQDQEDPEEFYVLSETTLAQPQSLERHKEQLLAAEPVRAKLDRQRRVFQPSPLASQFELPGDFFNLTAEEIKREQRLRSEAVERLSVLRTKAMREKEEQRGLRKYNYTLLRVRLPDGCLLQGTFYARERLGAVYGFVREALQSDWLPFELLASGGQKLSEDENLALNECGLVPSALLTFSWDMAVLEDIKAAGAEPDSILKPELLSAIEKLL

SEQ ID NO: 95420 - protein, 489 aa, Homo sapiens
  Payload ID: 19020
  Gene Name: UBX domain protein 7
  Uniprot ID: O94888
  ENSP ID: ENSP00000296328
MAAHGGSAASSALKGLIQQFTTITGASESVGKHMLEACNNNLEMAVTMFLDGGGIAEEPSTSSASVSTVRPHTEEEVRAPIPQKQEILVEPEPLFGAPKRRRPARSIFDGFRDFQTETIRQEQELRNGGAIDKKLTTLADLFRPPIDLMHKGSFETAKECGQMQNKWLMINIQNVQDFACQCLNRDVWSNEAVKNIIREHFIFWQVYHDSEEGQRYIQFYKLGDFPYVSILDPRTGQKLVEWHQLDVSSFLDQVTGFLGEHGQLDGLSSSPPKKCARSESLIDASEDSQLEAAIRASLQETHFDSTQTKQDSRSDEESESELFSGSEEFISVCGSDEEEEVENLAKSRKSPHKDLGHRKEENRRPLTEPPVRTDPGTATNHQGLPAVDSEILEMPPEKADGVVEGIDVNGPKAQLMLRYPDGKREQITLPEQAKLLALVKHVQSKGYPNERFELLTNFPRRKLSHLDYDITLQEAGLCPQETVFVQERN

SEQ ID NO: 95421 - protein, 125 aa, Homo sapiens
  Payload ID: 19020
  Gene Name: UBX domain protein 7
  ENSP ID: ENSP00000371311
  MOD_RES (1)..(1): Any amino acid
XAAHGGSAASSALKGLIQQFTTITGASESVGKHMLEACNNNLEMAVTMFLDGGGIAEEPSTSSASVSTVRPHTEEEVRAPIPQKQEILVEPEPLFGVRQEQELRNGGAIDKKLTTLADLFRPPID

SEQ ID NO: 95422 - protein, 75 aa, Homo sapiens
  Payload ID: 19020
  Gene Name: UBX domain protein 7
  ENSP ID: ENSP00000397238
MAAHGGSAASSALKGLIQQFTTITEKKFVPQFLKSRKYWWNQNHYLVLLKDDGLHVQFLMVSGIFRLKLFGKNKN

SEQ ID NO: 95423 - protein, 327 aa, Homo sapiens
  Payload ID: 19020
  Gene Name: UBX domain protein 7
  ENSP ID: ENSP00000397256
MQNKWLMINIQNVQDFACQCLNRDVWSNEAVKNIIREHFIFWQVYHDSEEGQRYIQFYKLGDFPYVSILDPRTGQKLVEWHQLDVSSFLDQVTGFLGEHGQLDGLSSSPPKKCARSESLIDASEDSQLEAAIRASLQETHFDSTQTKQDSRSDEESESELFSGSEEFISVCGSDEEEEVENLAKSRKSPHKDLGHRKEENRRPLTEPPVRTDPGTATNHQGLPAVDSEILEMPPEKADGVVEGIDVNGPKAQLMLRYPDGKREQITLPEQAKLLALVKHVQSKGYPNERFELLTNFPRRKLSHLDYDITLQEAGLCPQETVFVQERN

SEQ ID NO: 95424 - protein, 76 aa, Homo sapiens
  Payload ID: 19020
  Gene Name: UBX domain protein 7
  ENSP ID: ENSP00000404778
MLEACNNNLEMAVTMFLDGGGIAEEPSTSSASVSTVRPHTEEEVRAPIPQKQEILVEPEPLFGAPKRRRPARSIFD

SEQ ID NO: 95425 - protein, 310 aa, Homo sapiens
  Payload ID: 19021
  Gene Name: UBX domain protein 8
  ENSP ID: ENSP00000477532
MLYSGTWRTVGIRCPRKKAQICQQQECCIERPPLRLRGFGAALTTTPRLHRPCPPTSGADFTSRNLFPPGIKDFLLLCGRILLLLALLTLTISVTTSWLNSFKSPQVYLKEEEEKNEKRQKLVRKKQQEAQGEKASRYIENVLKPHQEMKLRKLEERFYQMTGEAWKLSSGHKLGGDEGTSQTSFETSNREAAKSQNLPKPLTEFPSPAEQPTCKEIPDLPEEPSQTAEEVVTVALRCPSGNVLRRRFLKSYSSQVLFDWMTRIGYHISLYSLSTSFPRRPLAVEGGQSLEDIGITVDTVLILEEKEQTN

SEQ ID NO: 95426 - protein, 229 aa, Homo sapiens
  Payload ID: 19021
  Gene Name: UBX domain protein 8
  ENSP ID: ENSP00000478502
MASRGVVGIFFLSAVPLVCLELRRGIPDIGIKDFLLLCGRILLLLALLTLTISVTTSWLNSFKSPQVYLKEEEEKNEKRQKLVRKKQQEAQGEKGDEGTSQTSFETSNREAAKSQNLPKPLTEFPSPAEQPTCKEIPDLPEEPSQTAEEVVTVALRCPSGNVLRRRFLKSYSSQVLFDWMTRIGYHISLYSLSTSFPRRPLAVEGGQSLEDIGITVDTVLILEEKEQTN

SEQ ID NO: 95427 - protein, 270 aa, Homo sapiens
  Payload ID: 19021
  Gene Name: UBX domain protein 8
  ENSP ID: ENSP00000479216
MASRGVVGIFFLSAVPLVCLELRRGIPDIGIKDFLLLCGRILLLLALLTLTISVTTSWLNSFKSPQVYLKEEEEKNEKRQKLVRKKQQEAQGEKASRYIENVLKPHQEMKLRKLEERFYQMTGEAWKLSSGHKLGGDEGTSQTSFETSNREAAKSQNLPKPLTEFPSPAEQPTCKEIPDLPEEPSQTAEEVVTVALRCPSGNVLRRRFLKSYSSQVLFDWMTRIGYHISLYSLSTSFPRRPLAVEGGQSLEDIGITVDTVLILEEKEQTN

SEQ ID NO: 95428 - protein, 94 aa, Homo sapiens
  Payload ID: 19021
  Gene Name: UBX domain protein 8
  ENSP ID: ENSP00000480065
  MOD_RES (1)..(1): Any amino acid
XIKDFLLLCGRILLLLALLTLTISVTTSWLNSFKSPQVYLKEEEEKNEKRQKLVRKKQQEAQGEKASRYIENVLKPHQEMKLRKLEERFYQMTG

SEQ ID NO: 95429 - protein, 233 aa, Homo sapiens
  Payload ID: 19021
  Gene Name: UBX domain protein 8
  Uniprot ID: O00124
  ENSP ID: ENSP00000481635
MASRGVVGIFFLSAVPLVCLELRRGIPDIVYLKEEEEKNEKRQKLVRKKQQEAQGEKASRYIENVLKPHQEMKLRKLEERFYQMTGEAWKLSSGHKLGGDEGTSQTSFETSNREAAKSQNLPKPLTEFPSPAEQPTCKEIPDLPEEPSQTAEEVVTVALRCPSGNVLRRRFLKSYSSQVLFDWMTRIGYHISLYSLSTSFPRRPLAVEGGQSLEDIGITVDTVLILEEKEQTN

SEQ ID NO: 95430 - protein, 42 aa, Homo sapiens
  Payload ID: 19021
  Gene Name: UBX domain protein 8
  ENSP ID: ENSP00000482772
MASRGVVGIFFLSAVPLVCLELRRGIPDIGKCDFFPSTVTAG

SEQ ID NO: 95431 - protein, 248 aa, Homo sapiens
  Payload ID: 19021
  Gene Name: UBX domain protein 8
  ENSP ID: ENSP00000483433
MCQREKRWQLGVLTQTVGPWPRPVAYLSKQLDGVFKGWPPCLRALAATALLVQEADKLTLGQNRNIKAPHAVVTLMNTKGHHWLMSARLTKYQSLLCENPRITIEVCNTLNPATLFPVSESPVEHDCVEVLDSVYSSRPDLRDQPWASVDWELYVDGSSFINPQGERFAGYAVVTLDTVVEARSLPQGTSAQKAELIALIRALELSEGIKDFLLLCGRILLLLALLTLTISVTTSWLNSFKSPQVYLK

SEQ ID NO: 95432 - protein, 533 aa, Homo sapiens
  Payload ID: 19022
  Gene Name: UDP glucuronosyltransferase 1 family, polypeptide A1
  Uniprot ID: P22309
  ENSP ID: ENSP00000304845
MAVESQGGRPLVLGLLLCVLGPVVSHAGKILLIPVDGSHWLSMLGAIQQLQQRGHEIVVLAPDASLYIRDGAFYTLKTYPVPFQREDVKESFVSLGHNVFENDSFLQRVIKTYKKIKKDSAMLLSGCSHLLHNKELMASLAESSFDVMLTDPFLPCSPIVAQYLSLPTVFFLHALPCSLEFEATQCPNPFSYVPRPLSSHSDHMTFLQRVKNMLIAFSQNFLCDVVYSPYATLASEFLQREVTVQDLLSSASVWLFRSDFVKDYPRPIMPNMVFVGGINCLHQNPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 95433 - protein, 444 aa, Homo sapiens
  Payload ID: 19022
  Gene Name: UDP glucuronosyltransferase 1 family, polypeptide A1
  Uniprot ID: P22309
  ENSP ID: ENSP00000353593
MAVESQGGRPLVLGLLLCVLGPVVSHAGKILLIPVDGSHWLSMLGAIQQLQQRGHEIVVLAPDASLYIRDGAFYTLKTYPVPFQREDVKESFVSLGHNVFENDSFLQRVIKTYKKIKKDSAMLLSGCSHLLHNKELMASLAESSFDVMLTDPFLPCSPIVAQYLSLPTVFFLHALPCSLEFEATQCPNPFSYVPRPLSSHSDHMTFLQRVKNMLIAFSQNFLCDVVYSPYATLASEFLQREVTVQDLLSSASVWLFRSDFVKDYPRPIMPNMVFVGGINCLHQNPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKRKKQQSGRQM

SEQ ID NO: 95434 - protein, 530 aa, Homo sapiens
  Payload ID: 19023
  Gene Name: UDP glucuronosyltransferase 1 family, polypeptide A10
  Uniprot ID: Q9HAW8
  ENSP ID: ENSP00000343838
MARAGWTSPVPLCVCLLLTCGFAEAGKLLVVPMDGSHWFTMQSVVEKLILRGHEVVVVMPEVSWQLERSLNCTVKTYSTSYTLEDQNREFMVFAHAQWKAQAQSIFSLLMSSSSGFLDLFFSHCRSLFNDRKLVEYLKESSFDAVFLDPFDTCGLIVAKYFSLPSVVFTRGIFCHHLEEGAQCPAPLSYVPNDLLGFSDAMTFKERVWNHIVHLEDHLFCQYLFRNALEIASEILQTPVTAYDLYSHTSIWLLRTDFVLDYPKPVMPNMIFIGGINCHQGKPLPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 95435 - protein, 441 aa, Homo sapiens
  Payload ID: 19023
  Gene Name: UDP glucuronosyltransferase 1 family, polypeptide A10
  Uniprot ID: Q9HAW8
  ENSP ID: ENSP00000362544
MARAGWTSPVPLCVCLLLTCGFAEAGKLLVVPMDGSHWFTMQSVVEKLILRGHEVVVVMPEVSWQLERSLNCTVKTYSTSYTLEDQNREFMVFAHAQWKAQAQSIFSLLMSSSSGFLDLFFSHCRSLFNDRKLVEYLKESSFDAVFLDPFDTCGLIVAKYFSLPSVVFTRGIFCHHLEEGAQCPAPLSYVPNDLLGFSDAMTFKERVWNHIVHLEDHLFCQYLFRNALEIASEILQTPVTAYDLYSHTSIWLLRTDFVLDYPKPVMPNMIFIGGINCHQGKPLPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKRKKQQSGRQM

SEQ ID NO: 95436 - protein, 534 aa, Homo sapiens
  Payload ID: 19024
  Gene Name: UDP glucuronosyltransferase 1 family, polypeptide A3
  Uniprot ID: P35503
  ENSP ID: ENSP00000418532
MATGLQVPLPWLATGLLLLLSVQPWAESGKVLVVPIDGSHWLSMREVLRELHARGHQAVVLTPEVNMHIKEENFFTLTTYAISWTQDEFDRHVLGHTQLYFETEHFLKKFFRSMAMLNNMSLVYHRSCVELLHNEALIRHLNATSFDVVLTDPVNLCAAVLAKYLSIPTVFFLRNIPCDLDFKGTQCPNPSSYIPRLLTTNSDHMTFMQRVKNMLYPLALSYICHAFSAPYASLASELFQREVSVVDILSHASVWLFRGDFVMDYPRPIMPNMVFIGGINCANRKPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 95437 - protein, 534 aa, Homo sapiens
  Payload ID: 19025
  Gene Name: UDP glucuronosyltransferase 1 family, polypeptide A4
  Uniprot ID: P22310
  ENSP ID: ENSP00000362508
MARGLQVPLPRLATGLLLLLSVQPWAESGKVLVVPTDGSPWLSMREALRELHARGHQAVVLTPEVNMHIKEEKFFTLTAYAVPWTQKEFDRVTLGYTQGFFETEHLLKRYSRSMAIMNNVSLALHRCCVELLHNEALIRHLNATSFDVVLTDPVNLCGAVLAKYLSIPAVFFWRYIPCDLDFKGTQCPNPSSYIPKLLTTNSDHMTFLQRVKNMLYPLALSYICHTFSAPYASLASELFQREVSVVDLVSYASVWLFRGDFVMDYPRPIMPNMVFIGGINCANGKPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 95438 - protein, 445 aa, Homo sapiens
  Payload ID: 19025
  Gene Name: UDP glucuronosyltransferase 1 family, polypeptide A4
  Uniprot ID: P22310
  ENSP ID: ENSP00000408608
MARGLQVPLPRLATGLLLLLSVQPWAESGKVLVVPTDGSPWLSMREALRELHARGHQAVVLTPEVNMHIKEEKFFTLTAYAVPWTQKEFDRVTLGYTQGFFETEHLLKRYSRSMAIMNNVSLALHRCCVELLHNEALIRHLNATSFDVVLTDPVNLCGAVLAKYLSIPAVFFWRYIPCDLDFKGTQCPNPSSYIPKLLTTNSDHMTFLQRVKNMLYPLALSYICHTFSAPYASLASELFQREVSVVDLVSYASVWLFRGDFVMDYPRPIMPNMVFIGGINCANGKPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKRKKQQSGRQM

SEQ ID NO: 95439 - protein, 534 aa, Homo sapiens
  Payload ID: 19026
  Gene Name: UDP glucuronosyltransferase 1 family, polypeptide A5
  Uniprot ID: P35504
  ENSP ID: ENSP00000362513
MATGLQVPLPQLATGLLLLLSVQPWAESGKVLVVPTDGSHWLSMREALRDLHARGHQVVVLTLEVNMYIKEENFFTLTTYAISWTQDEFDRLLLGHTQSFFETEHLLMKFSRRMAIMNNMSLIIHRSCVELLHNEALIRHLHATSFDVVLTDPFHLCAAVLAKYLSIPAVFFLRNIPCDLDFKGTQCPNPSSYIPRLLTTNSDHMTFLQRVKNMLYPLALSYLCHAVSAPYASLASELFQREVSVVDLVSHASVWLFRGDFVMDYPRPIMPNMVFIGGINCANGKPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 95440 - protein, 532 aa, Homo sapiens
  Payload ID: 19027
  Gene Name: UDP glucuronosyltransferase 1 family, polypeptide A6
  Uniprot ID: P19224
  ENSP ID: ENSP00000303174
MACLLRSFQRISAGVFFLALWGMVVGDKLLVVPQDGSHWLSMKDIVEVLSDRGHEIVVVVPEVNLLLKESKYYTRKIYPVPYDQEELKNRYQSFGNNHFAERSFLTAPQTEYRNNMIVIGLYFINCQSLLQDRDTLNFFKESKFDALFTDPALPCGVILAEYLGLPSVYLFRGFPCSLEHTFSRSPDPVSYIPRCYTKFSDHMTFSQRVANFLVNLLEPYLFYCLFSKYEELASAVLKRDVDIITLYQKVSVWLLRYDFVLEYPRPVMPNMVFIGGINCKKRKDLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 95441 - protein, 265 aa, Homo sapiens
  Payload ID: 19027
  Gene Name: UDP glucuronosyltransferase 1 family, polypeptide A6
  Uniprot ID: P19224
  ENSP ID: ENSP00000362523
MPNMVFIGGINCKKRKDLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 95442 - protein, 176 aa, Homo sapiens
  Payload ID: 19027
  Gene Name: UDP glucuronosyltransferase 1 family, polypeptide A6
  ENSP ID: ENSP00000386107
MPNMVFIGGINCKKRKDLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKRKKQQSGRQM

SEQ ID NO: 95443 - protein, 189 aa, Homo sapiens
  Payload ID: 19027
  Gene Name: UDP glucuronosyltransferase 1 family, polypeptide A6
  ENSP ID: ENSP00000389637
MACLLRSFQRISAGVFFLALWGMVVGDKLLVVPQDGSHWLSMKDIVEVLSDRGHEIVVVVPEVNLLLKESKYYTRKIYPVPYDQEELKNRYQSFGNNHFAERSFLTAPQTEYRNNMIVIGLYFINCQSLLQDRDTLNFFKESKFDALFTDPALPCGVILAEYLGLPSVYLFRGFPCSLEHTFSRSPDPV

SEQ ID NO: 95444 - protein, 176 aa, Homo sapiens; identical to SEQ ID NO: 95442
  Payload ID: 19027
  Gene Name: UDP glucuronosyltransferase 1 family, polypeptide A6
  ENSP ID: ENSP00000401541

SEQ ID NO: 95445 - protein, 67 aa, Homo sapiens
  Payload ID: 19027
  Gene Name: UDP glucuronosyltransferase 1 family, polypeptide A6
  ENSP ID: ENSP00000419780
LFYCLFSKYEELASAVLKRDVDIITLYQKVSVWLLRYDFVLEYPRPVMPNMVFIGGINCKKRKDLSQ

SEQ ID NO: 95446 - protein, 530 aa, Homo sapiens
  Payload ID: 19028
  Gene Name: UDP glucuronosyltransferase 1 family, polypeptide A7
  Uniprot ID: Q9HAW7
  ENSP ID: ENSP00000362525
MARAGWTGLLPLYVCLLLTCGFAKAGKLLVVPMDGSHWFTMQSVVEKLILRGHEVVVVMPEVSWQLGRSLNCTVKTYSTSYTLEDQDREFMVFADARWTAPLRSAFSLLTSSSNGIFDLFFSNCRSLFNDRKLVEYLKESCFDAVFLDPFDACGLIVAKYFSLPSVVFARGIFCHYLEEGAQCPAPLSYVPRLLLGFSDAMTFKERVWNHIMHLEEHLFCPYFFKNVLEIASEILQTPVTAYDLYSHTSIWLLRTDFVLEYPKPVMPNMIFIGGINCHQGKPVPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 95447 - protein, 157 aa, Homo sapiens
  Payload ID: 19028
  Gene Name: UDP glucuronosyltransferase 1 family, polypeptide A7
  ENSP ID: ENSP00000420181
  MOD_RES (1)..(1): Any amino acid
XVFLDPFDACGLIVAKYFSLPSVVFARGIFCHYLEEGAQCPAPLSYVPRLLLGFSDAMTFKERVWNHIMHLEEHLFCPYFFKNVLEIASEILQTPVTAYDLYSHTSIWLLRTDFVLEYPKPVMPNMIFIGGINCHQGKPVPMGQDLLLSPHWNMSQA

SEQ ID NO: 95448 - protein, 530 aa, Homo sapiens
  Payload ID: 19029
  Gene Name: UDP glucuronosyltransferase 1 family, polypeptide A8
  Uniprot ID: Q9HAW9
  ENSP ID: ENSP00000362549
MARTGWTSPIPLCVSLLLTCGFAEAGKLLVVPMDGSHWFTMQSVVEKLILRGHEVVVVMPEVSWQLGKSLNCTVKTYSTSYTLEDLDREFMDFADAQWKAQVRSLFSLFLSSSNGFFNLFFSHCRSLFNDRKLVEYLKESSFDAVFLDPFDACGLIVAKYFSLPSVVFARGIACHYLEEGAQCPAPLSYVPRILLGFSDAMTFKERVRNHIMHLEEHLFCQYFSKNALEIASEILQTPVTAYDLYSHTSIWLLRTDFVLDYPKPVMPNMIFIGGINCHQGKPLPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 95449 - protein, 530 aa, Homo sapiens
  Payload ID: 19030
  Gene Name: UDP glucuronosyltransferase 1 family, polypeptide A9
  Uniprot ID: O60656
  ENSP ID: ENSP00000346768
MACTGWTSPLPLCVCLLLTCGFAEAGKLLVVPMDGSHWFTMRSVVEKLILRGHEVVVVMPEVSWQLGRSLNCTVKTYSTSYTLEDLDREFKAFAHAQWKAQVRSIYSLLMGSYNDIFDLFFSNCRSLFKDKKLVEYLKESSFDAVFLDPFDNCGLIVAKYFSLPSVVFARGILCHYLEEGAQCPAPLSYVPRILLGFSDAMTFKERVRNHIMHLEEHLLCHRFFKNALEIASEILQTPVTEYDLYSHTSIWLLRTDFVLDYPKPVMPNMIFIGGINCHQGKPLPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 95450 - protein, 527 aa, Homo sapiens
  Payload ID: 19031
  Gene Name: UDP glucuronosyltransferase 2 family, polypeptide A1, complex locus
  Uniprot ID: Q9Y4X1
  ENSP ID: ENSP00000286604
MLNNLLLFSLQISLIGTTLGGNVLIWPMEGSHWLNVKIIIDELIKKEHNVTVLVASGALFITPTSNPSLTFEIYKVPFGKERIEGVIKDFVLTWLENRPSPSTIWRFYQEMAKVIKDFHMVSQEICDGVLKNQQLMAKLKKSKFEVLVSDPVFPCGDIVALKLGIPFMYSLRFSPASTVEKHCGKVPYPPSYVPAVLSELTDQMSFTDRIRNFISYHLQDYMFETLWKSWDSYYSKALGGLLLCCPGWSAVADLGSLQPLLPGFKRFSRLSLHCSWDYRLPAGRPTTLCETMGKAEIWLIRTYWDFEFPRPYLPNFEFVGGLHCKPAKPLPKVLWRYKGKKPATLGNNTQLFDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQPVKPLDRAVFWIEFVMRHKGAKHLRVAAHDLTWFQYHSLDVIGFLLVCVTTAIFLVIQCCLFSCQKFGKIGKKKKRE

SEQ ID NO: 95451 - protein, 483 aa, Homo sapiens
  Payload ID: 19031
  Gene Name: UDP glucuronosyltransferase 2 family, polypeptide A1, complex locus
  ENSP ID: ENSP00000421432
MLNNLLLFSLQISLIGTTLGGNVLIWPMEGSHWLNVKIIIDELIKKEHNVTVLVASGALFITPTSNPSLTFEIYKVPFGKERIEGVIKDFVLTWLENRPSPSTIWRFYQEMAKVIKDFHMVSQEICDGVLKNQQLMAKLKKSKFEVLVSDPVFPCGDIVALKLGIPFMYSLRFSPASTVEKHCGKVPYPPSYVPAVLSELTDQMSFTDRIRNFISYHLQDYMFETLWKSWDSYYSKALGRPTTLCETMGKAEIWLIRTYWDFEFPRPYLPNFEFVGGLHCKPAKPLPKVLWRYKGKKPATLGNNTQLFDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQPVKPLDRAVFWIEFVMRHKGAKHLRVAAHDLTWFQYHSLDVIGFLLVCVTTAIFLVIQCCLFSCQKFGKIGKKKKRE

SEQ ID NO: 95452 - protein, 527 aa, Homo sapiens
  Payload ID: 19031
  Gene Name: UDP glucuronosyltransferase 2 family, polypeptide A1, complex locus
  Uniprot ID: Q9Y4X1
  ENSP ID: ENSP00000424478
MLNNLLLFSLQISLIGTTLGGNVLIWPMEGSHWLNVKIIIDELIKKEHNVTVLVASGALFITPTSNPSLTFEIYKVPFGKERIEGVIKDFVLTWLENRPSPSTIWRFYQEMAKVIKDFHMVSQEICDGVLKNQQLMAKLKKSKFEVLVSDPVFPCGDIVALKLGIPFMYSLRFSPASTVEKHCGKVPYPPSYVPAVLSELTDQMSFTDRIRNFISYHLQDYMFETLWKSWDSYYSKALGRPTTLCETMGKAEIWLIRTYWDFEFPRPYLPNFEFVGGLHCKPAKPLPKEMEEFIQSSGKNGVVVFSLGSMVKNLTEEKANLIASALAQIPQKVLWRYKGKKPATLGNNTQLFDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQPVKPLDRAVFWIEFVMRHKGAKHLRVAAHDLTWFQYHSLDVIGFLLVCVTTAIFLVIQCCLFSCQKFGKIGKKKKRE

SEQ ID NO: 95453 - protein, 693 aa, Homo sapiens
  Payload ID: 19031
  Gene Name: UDP glucuronosyltransferase 2 family, polypeptide A1, complex locus
  Uniprot ID: Q9Y4X1
  ENSP ID: ENSP00000425497
MLNNLLLFSLQISLIGTTLGGNVLIWPMEGSHWLNVKIIIDELIKKEHNVTVLVASGALFITPTSNPSLTFEIYKVPFGKERIEGVIKDFVLTWLENRPSPSTIWRFYQEMAKVIKDFHMVSQEICDGVLKNQQLMAKLKKSKFEVLVSDPVFPCGDIVALKLGIPFMYSLRFSPASTVEKHCGKVPYPPSYVPAVLSELTDQMSFTDRIRNFISYHLQDYMFETLWKSWDSYYSKALDGSHWLNIKIILEELIQRNHNVTVLASSATLFINSNPDSPVNFEVIPVSYKKSNIDSLIEHMIMLWIDHRPTPLTIWAFYKELGKLLDTFFQINIQLCDGVLKNPKLMARLQKGGFDVLVADPVTICGDLVALKLGIPFMYTLRFSPASTVERHCGKIPAPVSYVPAALSELTDQMTFGERIKNTISYSLQDYIFQSYWGEWNSYYSKILGRPTTLCETMGKAEIWLIRTYWDFEFPRPYLPNFEFVGGLHCKPAKPLPKVLWRYKGKKPATLGNNTQLFDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQPVKPLDRAVFWIEFVMRHKGAKHLRVAAHDLTWFQYHSLDVIGFLLVCVTTAIFLVIQCCLFSCQKFGKIGKKKKRE

SEQ ID NO: 95454 - protein, 158 aa, Homo sapiens
  Payload ID: 19031
  Gene Name: UDP glucuronosyltransferase 2 family, polypeptide A1, complex locus
  ENSP ID: ENSP00000427709
MLNNLLLFSLQISLIGTTLGGNVLIWPMEGSHWLNVKIIIDELIKKEHNVTVLVASGALFITPTSNPSLTFEIYKVPFGKERIEGVIKDFVLTWLENRPSPSTIWRFYQEMAKVIKDFHMVSQEICDGVLKNQQLMAKLKKSKFEVLVSDPVFPCGDI

SEQ ID NO: 95455 - protein, 492 aa, Homo sapiens
  Payload ID: 19032
  Gene Name: UDP glucuronosyltransferase 2 family, polypeptide A2
  Uniprot ID: Q9Y4X1
  ENSP ID: ENSP00000474383
MVSIRDFTMPKKFVQMLVFNLTLTEVVLSGNVLIWPTDGSHWLNIKIILEELIQRNHNVTVLASSATLFINSNPDSPVNFEVIPVSYKKSNIDSLIEHMIMLWIDHRPTPLTIWAFYKELGKLLDTFFQINIQLCDGVLKNPKLMARLQKGGFDVLVADPVTICGDLVALKLGIPFMYTLRFSPASTVERHCGKIPAPVSYVPAALSELTDQMTFGERIKNTISYSLQDYIFQSYWGEWNSYYSKILGRPTTLCETMGKAEIWLIRTYWDFEFPRPYLPNFEFVGGLHCKPAKPLPKVLWRYKGKKPATLGNNTQLFDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQPVKPLDRAVFWIEFVMRHKGAKHLRVAAHDLTWFQYHSLDVIGFLLVCVTTAIFLVIQCCLFSCQKFGKIGKKKKRE

SEQ ID NO: 95456 - protein, 536 aa, Homo sapiens
  Payload ID: 19032
  Gene Name: UDP glucuronosyltransferase 2 family, polypeptide A2
  Uniprot ID: Q9Y4X1
  ENSP ID: ENSP00000475028
MVSIRDFTMPKKFVQMLVFNLTLTEVVLSGNVLIWPTDGSHWLNIKIILEELIQRNHNVTVLASSATLFINSNPDSPVNFEVIPVSYKKSNIDSLIEHMIMLWIDHRPTPLTIWAFYKELGKLLDTFFQINIQLCDGVLKNPKLMARLQKGGFDVLVADPVTICGDLVALKLGIPFMYTLRFSPASTVERHCGKIPAPVSYVPAALSELTDQMTFGERIKNTISYSLQDYIFQSYWGEWNSYYSKILGRPTTLCETMGKAEIWLIRTYWDFEFPRPYLPNFEFVGGLHCKPAKPLPKEMEEFIQSSGKNGVVVFSLGSMVKNLTEEKANLIASALAQIPQKVLWRYKGKKPATLGNNTQLFDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQPVKPLDRAVFWIEFVMRHKGAKHLRVAAHDLTWFQYHSLDVIGFLLVCVTTAIFLVIQCCLFSCQKFGKIGKKKKRE

SEQ ID NO: 95457 - protein, 527 aa, Homo sapiens
  Payload ID: 19033
  Gene Name: UDP glucuronosyltransferase 2 family, polypeptide A3
  Uniprot ID: Q6UWM9
  ENSP ID: ENSP00000251566
MRSDKSALVFLLLQLFCVGCGFCGKVLVWPCDMSHWLNVKVILEELIVRGHEVTVLTHSKPSLIDYRKPSALKFEVVHMPQDRTEENEIFVDLALNVLPGLSTWQSVIKLNDFFVEIRGTLKMMCESFIYNQTLMKKLQETNYDVMLIDPVIPCGDLMAELLAVPFVLTLRISVGGNMERSCGKLPAPLSYVPVPMTGLTDRMTFLERVKNSMLSVLFHFWIQDYDYHFWEEFYSKALGRPTTLCETVGKAEIWLIRTYWDFEFPQPYQPNFEFVGGLHCKPAKALPKEMENFVQSSGEDGIVVFSLGSLFQNVTEEKANIIASALAQIPQKVLWRYKGKKPSTLGANTRLYDWIPQNDLLGHPKTKAFITHGGMNGIYEAIYHGVPMVGVPIFGDQLDNIAHMKAKGAAVEINFKTMTSEDLLRALRTVITDSSYKENAMRLSRIHHDQPVKPLDRAVFWIEFVMRHKGAKHLRSAAHDLTWFQHYSIDVIGFLLACVATAIFLFTKCFLFSCQKFNKTRKIEKRE

SEQ ID NO: 95458 - protein, 172 aa, Homo sapiens
  Payload ID: 19033
  Gene Name: UDP glucuronosyltransferase 2 family, polypeptide A3
  ENSP ID: ENSP00000424092
MKKLQETNYDVMLIDPVIPCGDLMAELLAVPFVLTLRISVGGNMERSCGKLPAPLSYVPVPMTGLTDRMTFLERVKNSMLSVLFHFWIQDYDYHFWEEFYSKALGRPTTLCETVGKAEIWLIRTYWDFEFPQPYQPNFEFVGGLHCKPAKALPKESYTRKPSSLKPWHLYLK

SEQ ID NO: 95459 - protein, 527 aa, Homo sapiens; identical to SEQ ID NO: 95457
  Payload ID: 19033
  Gene Name: UDP glucuronosyltransferase 2 family, polypeptide A3
  Uniprot ID: Q6UWM9
  ENSP ID: ENSP00000479283

SEQ ID NO: 95460 - protein, 173 aa, Homo sapiens
  Payload ID: 19033
  Gene Name: UDP glucuronosyltransferase 2 family, polypeptide A3
  ENSP ID: ENSP00000487009
LMKKLQETNYDVMLIDPVIPCGDLMAELLAVPFVLTLRISVGGNMERSCGKLPAPLSYVPVPMTGLTDRMTFLERVKNSMLSVLFHFWIQDYDYHFWEEFYSKALGRPTTLCETVGKAEIWLIRTYWDFEFPQPYQPNFEFVGGLHCKPAKALPKESYTRKPSSLKPWHLYLK

SEQ ID NO: 95461 - protein, 528 aa, Homo sapiens
  Payload ID: 19034
  Gene Name: UDP glucuronosyltransferase 2 family, polypeptide B10
  Uniprot ID: P36537
  ENSP ID: ENSP00000265403
MALKWTTVLLIQLSFYFSSGSCGKVLVWAAEYSLWMNMKTILKELVQRGHEVTVLASSASILFDPNDSSTLKLEVYPTSLTKTEFENIIMQLVKRLSEIQKDTFWLPFSQEQEILWAINDIIRNFCKDVVSNKKLMKKLQESRFDIVFADAYLPCGELLAELFNIPFVYSHSFSPGYSFERHSGGFIFPPSYVPVVMSKLSDQMTFMERVKNMLYVLYFDFWFQIFNMKKWDQFYSEVLGRPTTLSETMRKADIWLMRNSWNFKFPHPFLPNVDFVGGLHCKPAKPLPKEMEEFVQSSGENGVVVFSLGSMVSNMTEERANVIATALAKIPQKVLWRFDGNKPDALGLNTRLYKWIPQNDLLGHPKTRAFITHGGANGIYEAIYHGIPMVGIPLFFDQPDNIAHMKAKGAAVRVDFNTMSSTDLLNALKTVINDPSYKENIMKLSRIQHDQPVKPLDRAVFWIEFVMRHKGAKHLRVAAHNLTWFQYHSLDVIGFLLACVATVLFIITKCCLFCFWKFARKGKKGKRD

SEQ ID NO: 95462 - protein, 444 aa, Homo sapiens
  Payload ID: 19034
  Gene Name: UDP glucuronosyltransferase 2 family, polypeptide B10
  Uniprot ID: P36537
  ENSP ID: ENSP00000413420
MALKWTTVLLIQLSFYFSSGSCGKVLVWAAEYSLWMNMKTILKELVQRGHEVTVLASSASILFDPNDSSTLKLEVYPTSLTKTEFENIIMQLVKRLSEIQKDTFWLPFSQEQEILWAINDIIRNFCKDVVSNKKLMKKLQESRFDIVFADAYLPCGRPTTLSETMRKADIWLMRNSWNFKFPHPFLPNVDFVGGLHCKPAKPLPKEMEEFVQSSGENGVVVFSLGSMVSNMTEERANVIATALAKIPQKVLWRFDGNKPDALGLNTRLYKWIPQNDLLGHPKTRAFITHGGANGIYEAIYHGIPMVGIPLFFDQPDNIAHMKAKGAAVRVDFNTMSSTDLLNALKTVINDPSYKENIMKLSRIQHDQPVKPLDRAVFWIEFVMRHKGAKHLRVAAHNLTWFQYHSLDVIGFLLACVATVLFIITKCCLFCFWKFARKGKKGKRD

SEQ ID NO: 95463 - protein, 528 aa, Homo sapiens; identical to SEQ ID NO: 95461
  Payload ID: 19034
  Gene Name: UDP glucuronosyltransferase 2 family, polypeptide B10
  Uniprot ID: P36537
  ENSP ID: ENSP00000478760

SEQ ID NO: 95464 - protein, 444 aa, Homo sapiens; identical to SEQ ID NO: 95462
  Payload ID: 19034
  Gene Name: UDP glucuronosyltransferase 2 family, polypeptide B10
  Uniprot ID: P36537
  ENSP ID: ENSP00000486876

SEQ ID NO: 95465 - protein, 529 aa, Homo sapiens
  Payload ID: 19035
  Gene Name: UDP glucuronosyltransferase 2 family, polypeptide B11
  Uniprot ID: O75310
  ENSP ID: ENSP00000387683
MTLKWTSVLLLIHLSCYFSSGSCGKVLVWAAEYSHWMNMKTILKELVQRGHEVTVLASSASILFDPNDASTLKFEVYPTSLTKTEFENIIMQQVKRWSDIRKDSFWLYFSQEQEILWELYDIFRNFCKDVVSNKKVMKKLQESRFDIVFADAVFPCGELLAALLNIRFVYSLRFTPGYTIERHSGGLIFPPSYIPIVMSKLSDQMTFMERVKNMIYVLYFDFWFQMSDMKKWDQFYSEVLGRPTTLFETMGKADIWLMRNSWSFQFPHPFLPNVDFVGGFHCKPAKPLPKEMEEFVQSSGENGVVVFSLGSVISNMTAERANVIATALAKIPQKVLWRFDGNKPDALGLNTRLYKWIPQNDLLGHPKTRAFITHGGANGIYEAIYHGIPMVGIPLFFDQPDNIAHMKAKGAAVRLDFNTMSSTDLLNALKTVINDPLYKENIMKLSRIQHDQPVKPLDRAVFWIEFVMPHKGAKHLRVAAHDLTWFQYHSLDVIGFLLACVATVIFIITKFCLFCFWKFARKGKKGKRD

SEQ ID NO: 95466 - protein, 529 aa, Homo sapiens; identical to SEQ ID NO: 95465
  Payload ID: 19035
  Gene Name: UDP glucuronosyltransferase 2 family, polypeptide B11
  Uniprot ID: O75310
  ENSP ID: ENSP00000477842

SEQ ID NO: 95467 - protein, 335 aa, Homo sapiens
  Payload ID: 19035
  Gene Name: UDP glucuronosyltransferase 2 family, polypeptide B11
  ENSP ID: ENSP00000478182
MTLKWTSVLLLIHLSCYFSSGSCGKVLVWAAEYSHWMNMKTILKELVQRGHEVTVLASSASILFDPNDASTLKFEVYPTSLTKTEFENIIMQQVKRWSDIRKDSFWLYFSQEQEILWELYDIFRNFCKDVVSNKKVMKKLQESRFDIVFADAVFPCGELLAALLNIRFVYSLRFTPGYTIERHSGGLIFPPSYIPIVMSKLSDQMTFMERVKNMIYVLYFDFWFQMSDMKKWDQFYSEVLGRPTTLFETMGKADIWLMRNSWSFQFPHPFLPNVDFVGGFHCKPAKPLPKEMEEFVQSSGENGVVVFSLGSVISNMTAERANVIATALAKIPQKI

SEQ ID NO: 95468 - protein, 530 aa, Homo sapiens
  Payload ID: 19036
  Gene Name: UDP glucuronosyltransferase 2 family, polypeptide B15
  Uniprot ID: P54855
  ENSP ID: ENSP00000341045
MSLKWTSVFLLIQLSCYFSSGSCGKVLVWPTEYSHWINMKTILEELVQRGHEVTVLTSSASTLVNASKSSAIKLEVYPTSLTKNYLEDSLLKILDRWIYGVSKNTFWSYFSQLQELCWEYYDYSNKLCKDAVLNKKLMMKLQESKFDVILADALNPCGELLAELFNIPFLYSLRFSVGYTFEKNGGGFLFPPSYVPVVMSELSDQMIFMERIKNMIHMLYFDFWFQIYDLKKWDQFYSEVLGRPTTLFETMGKAEMWLIRTYWDFEFPRPFLPNVDFVGGLHCKPAKPLPKEMEEFVQSSGENGIVVFSLGSMISNMSEESANMIASALAQIPQKVLWRFDGKKPNTLGSNTRLYKWLPQNDLLGHPKTKAFITHGGTNGIYEAIYHGIPMVGIPLFADQHDNIAHMKAKGAALSVDIRTMSSRDLLNALKSVINDPVYKENVMKLSRIHHDQPMKPLDRAVFWIEFVMRHKGAKHLRVAAHNLTWIQYHSLDVIAFLLACVATVIFIITKFCLFCFRKLAKKGKKKKRD

SEQ ID NO: 95469 - protein, 332 aa, Homo sapiens
  Payload ID: 19036
  Gene Name: UDP glucuronosyltransferase 2 family, polypeptide B15
  ENSP ID: ENSP00000480287
MSELSDQMIFMERIKNMIHMLYFDFWFQIYDLKKWDQFYSEVLGRPTTLFETMGKAEMWLIRTYWDFEFPRPFLPNVDFVGGLHCKPAKPLPKEMEEFVQSSGENGIVVFSLGSMISNMSEESANMIASALAQIPQKVLWRFDGKKPNTLGSNTRLYKWLPQNDLLGHPKTKAFITHGGTNGIYEAIYHGIPMVGIPLFADQHDNIAHMKAKGAALSVDIRTMSSRDLLNALKSVINDPVYKENVMKLSRIHHDQPMKPLDRAVFWIEFVMRHKGAKHLRVAAHNLTWIQYHSLDVIAFLLACVATVIFIITKFCLFCFRKLAKKGKKKKRD

SEQ ID NO: 95470 - protein, 530 aa, Homo sapiens; identical to SEQ ID NO: 95468
  Payload ID: 19036
  Gene Name: UDP glucuronosyltransferase 2 family, polypeptide B15
  Uniprot ID: P54855
  ENSP ID: ENSP00000482004

SEQ ID NO: 95471 - protein, 530 aa, Homo sapiens
  Payload ID: 19037
  Gene Name: UDP glucuronosyltransferase 2 family, polypeptide B17
  Uniprot ID: O75795
  ENSP ID: ENSP00000320401
MSLKWMSVFLLMQLSCYFSSGSCGKVLVWPTEYSHWINMKTILEELVQRGHEVIVLTSSASILVNASKSSAIKLEVYPTSLTKNDLEDFFMKMFDRWTYSISKNTFWSYFSQLQELCWEYSDYNIKLCEDAVLNKKLMRKLQESKFDVLLADAVNPCGELLAELLNIPFLYSLRFSVGYTVEKNGGGFLFPPSYVPVVMSELSDQMIFMERIKNMIYMLYFDFWFQAYDLKKWDQFYSEVLGRPTTLFETMGKAEMWLIRTYWDFEFPRPFLPNVDFVGGLHCKPAKPLPKEMEEFVQSSGENGIVVFSLGSMISNMSEESANMIASALAQIPQKVLWRFDGKKPNTLGSNTRLYKWLPQNDLLGHPKTKAFITHGGTNGIYEAIYHGIPMVGIPLFADQHDNIAHMKAKGAALSVDIRTMSSRDLLNALKSVINDPIYKENIMKLSRIHHDQPVKPLDRAVFWIEFVMRHKGAKHLRVAAHNLTWIQYHSLDVIAFLLACVATMIFMITKCCLFCFRKLAKTGKKKKRD

SEQ ID NO: 95472 - protein, 529 aa, Homo sapiens
  Payload ID: 19038
  Gene Name: UDP glucuronosyltransferase 2 family, polypeptide B28
  Uniprot ID: Q9BY64
  ENSP ID: ENSP00000334276
MALKWTSVLLLIHLGCYFSSGSCGKVLVWTGEYSHWMNMKTILKELVQRGHEVTVLASSASILFDPNDAFTLKLEVYPTSLTKTEFENIIMQQVKRWSDIQKDSFWLYFSQEQEILWEFHDIFRNFCKDVVSNKKVMKKLQESRFDIIFADAFFPCGELLAALLNIPFVYSLCFTPGYTIERHSGGLIFPPSYIPVVMSKLSDQMTFMERVKNMIYVLYFDFWFQMCDMKKWDQFYSEVLGRPTTLFETMGKADIWLMRNSWSFQFPHPFLPNIDFVGGLHCKPAKPLPKEMEEFVQSSGENGVVVFSLGSVISNMTAERANVIATALAKIPQKVLWRFDGNKPDALGLNTRLYKWIPQNDLLGLPKTRAFITHGGANGIYEAIYHGIPMVGIPLFWDQPDNIAHMKAKGAAVRLDFHTMSSTDLLNALKTVINDPSYKENVMKLSIIQHDQPVKPLHRAVFWIEFVMCHKGAKHLRVAARDLTWFQYHSLDVIGFLLACVATVIFVVTKFCLFCFWKFARKGKKGKRD

SEQ ID NO: 95473 - protein, 335 aa, Homo sapiens
  Payload ID: 19038
  Gene Name: UDP glucuronosyltransferase 2 family, polypeptide B28
  Uniprot ID: Q9BY64
  ENSP ID: ENSP00000427399
MALKWTSVLLLIHLGCYFSSGSCGKVLVWTGEYSHWMNMKTILKELVQRGHEVTVLASSASILFDPNDAFTLKLEVYPTSLTKTEFENIIMQQVKRWSDIQKDSFWLYFSQEQEILWEFHDIFRNFCKDVVSNKKVMKKLQESRFDIIFADAFFPCGELLAALLNIPFVYSLCFTPGYTIERHSGGLIFPPSYIPVVMSKLSDQMTFMERVKNMIYVLYFDFWFQMCDMKKWDQFYSEVLGRPTTLFETMGKADIWLMRNSWSFQFPHPFLPNIDFVGGLHCKPAKPLPKEMEEFVQSSGENGVVVFSLGSVISNMTAERANVIATALAKIPQKI

SEQ ID NO: 95474 - protein, 529 aa, Homo sapiens
  Payload ID: 19038
  Gene Name: UDP glucuronosyltransferase 2 family, polypeptide B28
  ENSP ID: ENSP00000481795
MALKWTSVLLLIHLGCYFSSGSCGKVLVWTGEYSHWMNMKTILKELVQRGHEVTVLASSASILFDPNDAFTLKLEVYPTSLTKTEFENIIMQQVKRWSDIQKDSFWLYFSQEQEILWEFHDIFRNFCKDVVSNKKVMKKLQESRFDIIFADAFFPCGELLAALLNIPFVYSLCFTPGYTIERHSGGLIFPPSYIPVVMSKLSDQMTFMERVKNMIYVLYFDFWFQMCDMKKWDQFYSEVLGRPTTLFETMGKADIWLMRNSWSFQFPHPFLPNIDFVGGLHCKPAKPLPKEMEEFVQSSGENGVVVFSLGSVISNMTAERANVIATALAKIPQKVLWRFDGNKPDALGLNTRLYKWIPQNDLLGHPKTRAFITHGGANGIYEAIYHGIPILGIPLFADQPDNIAHMKAKGAAVRLDFNTMSSTDLLNALKTVINVPLYKESVMKLSRIQHDQPVKPLDRAVFWIEFVMRHKGAKHLRVAARDLTWFQYHSLDVIGFLLACVATVTFIITKCCLFCFWKFTRKVKKEKRD

SEQ ID NO: 95475 - protein, 528 aa, Homo sapiens
  Payload ID: 19039
  Gene Name: UDP glucuronosyltransferase 2 family, polypeptide B4
  Uniprot ID: P06133
  ENSP ID: ENSP00000305221
MSMKWTSALLLIQLSCYFSSGSCGKVLVWPTEFSHWMNIKTILDELVQRGHEVTVLASSASISFDPNSPSTLKFEVYPVSLTKTEFEDIIKQLVKRWAELPKDTFWSYFSQVQEIMWTFNDILRKFCKDIVSNKKLMKKLQESRFDVVLADAVFPFGELLAELLKIPFVYSLRFSPGYAIEKHSGGLLFPPSYVPVVMSELSDQMTFIERVKNMIYVLYFEFWFQIFDMKKWDQFYSEVLGRPTTLSETMAKADIWLIRNYWDFQFPHPLLPNVEFVGGLHCKPAKPLPKEMEEFVQSSGENGVVVFSLGSMVSNTSEERANVIASALAKIPQKVLWRFDGNKPDTLGLNTRLYKWIPQNDLLGHPKTRAFITHGGANGIYEAIYHGIPMVGVPLFADQPDNIAHMKAKGAAVSLDFHTMSSTDLLNALKTVINDPLYKENAMKLSRIHHDQPVKPLDRAVFWIEFVMRHKGAKHLRVAAHDLTWFQYHSLDVTGFLLACVATVIFIITKCLFCVWKFVRTGKKGKRD

SEQ ID NO: 95476 - protein, 54 aa, Homo sapiens
  Payload ID: 19039
  Gene Name: UDP glucuronosyltransferase 2 family, polypeptide B4
  ENSP ID: ENSP00000421113
MSMKWTSALLLIQLSCYFSSGSCGKVLVWPTEFSHWMNIKTILDELVQRGHEVT

SEQ ID NO: 95477 - protein, 369 aa, Homo sapiens
  Payload ID: 19039
  Gene Name: UDP glucuronosyltransferase 2 family, polypeptide B4
  Uniprot ID: P06133
  ENSP ID: ENSP00000421290
MSMKWTSALLLIQLSCYFSSGSCGKVLVWPTEFSHWMNIKTILDELVQRGHEVTVLASSASISFDPNSPSTLKFEVYPVSLTKTEFEDIIKQLVKRWAELPKDTFWSYFSQVQEIMWTFNDILRKFCKDIVSNKKLMKKLQESRFDVVLADAVFPFGELLAELLKIPFVYSLRFSPGYAIEKHSGGLLFPPSYVPVVMSELSDQMTFIERVKNMIYVLYFEFWFQIFDMKKWDQFYSEVLGRPTTLSETMAKADIWLIRNYWDFQFPHPLLPNVEFVGGLHCKPAKPLPKEMEEFVQSSGENGVVVFSLGSMVSNTSEERANVIASALAKIPQKVLWRFDGNKPDTLGLNTRLYKWIPQNDLLDIKRML

SEQ ID NO: 95478 - protein, 529 aa, Homo sapiens
  Payload ID: 19040
  Gene Name: UDP glucuronosyltransferase 2 family, polypeptide B7
  Uniprot ID: P16662
  ENSP ID: ENSP00000304811
MSVKWTSVILLIQLSFCFSSGNCGKVLVWAAEYSHWMNIKTILDELIQRGHEVTVLASSASILFDPNNSSALKIEIYPTSLTKTELENFIMQQIKRWSDLPKDTFWLYFSQVQEIMSIFGDITRKFCKDVVSNKKFMKKVQESRFDVIFADAIFPCSELLAELFNIPFVYSLSFSPGYTFEKHSGGFIFPPSYVPVVMSELTDQMTFMERVKNMIYVLYFDFWFEIFDMKKWDQFYSEVLGRPTTLSETMGKADVWLIRNSWNFQFPYPLLPNVDFVGGLHCKPAKPLPKEMEDFVQSSGENGVVVFSLGSMVSNMTEERANVIASALAQIPQKVLWRFDGNKPDTLGLNTRLYKWIPQNDLLGHPKTRAFITHGGANGIYEAIYHGIPMVGIPLFADQPDNIAHMKARGAAVRVDFNTMSSTDLLNALKRVINDPSYKENVMKLSRIQHDQPVKPLDRAVFWIEFVMRHKGAKHLRVAAHDLTWFQYHSLDVIGFLLVCVATVIFIVTKCCLFCFWKFARKAKKGKND

SEQ ID NO: 95479 - protein, 156 aa, Homo sapiens
  Payload ID: 19040
  Gene Name: UDP glucuronosyltransferase 2 family, polypeptide B7
  ENSP ID: ENSP00000426206
MGKADVWLIRNSWNFQFPYPLLPNVDFVGGLHCKPAKPLPKEMEDFVQSSGENGVVVFSLGSMVSNMTEERANVIASALAQIPQKVLWRFDGNKPDTLGLNTRLYKWIPQNDLLGHPKTRAFITHGGANGIYEAIYHGIPMVGIPLFADQPDNIAH

SEQ ID NO: 95480 - protein, 369 aa, Homo sapiens
  Payload ID: 19040
  Gene Name: UDP glucuronosyltransferase 2 family, polypeptide B7
  ENSP ID: ENSP00000427659
MSVKWTSVILLIQLSFCFSSGNCGKVLVWAAEYSHWMNIKTILDELIQRGHEVTVLASSASILFDPNNSSALKIEIYPTSLTKTELENFIMQQIKRWSDLPKDTFWLYFSQVQEIMSIFGDITRKFCKDVVSNKKFMKKVQESRFDVIFADAIFPCSELLAELFNIPFVYSLSFSPGYTFEKHSGGFIFPPSYVPVVMSELTDQMTFMERVKNMIYVLYFDFWFEIFDMKKWDQFYSEVLGRPTTLSETMGKADVWLIRNSWNFQFPYPLLPNVDFVGGLHCKPAKPLPKEMEDFVQSSGENGVVVFSLGSMVSNMTEERANVIASALAQIPQKVLWRFDGNKPDTLGLNTRLYKWIPQNDLLDIKRML

SEQ ID NO: 95481 - protein, 335 aa, Homo sapiens
  Payload ID: 19040
  Gene Name: UDP glucuronosyltransferase 2 family, polypeptide B7
  ENSP ID: ENSP00000483172
MSVKWTSVILLIQLSFCFSSGNCGKVLVWAAEYSHWMNIKTILDELIQRGHEVTVLASSASILFDPNNSSALKIEIYPTSLTKTELENFIMQQIKRWSDLPKDTFWLYFSQVQEIMSIFGDITRKFCKDVVSNKKFMKKVQESRFDVIFADAIFPCSELLAELFNIPFVYSLSFSPGYTFEKHSGGFIFPPSYVPVVMSELTDQMTFMERVKNMIYVLYFDFWFEIFDMKKWDQFYSEVLGRPTTLSETMGKADVWLIRNSWNFQFPYPLLPNVDFVGGLHCKPAKPLPKEMEDFVQSSGENGVVVFSLGSMVSNMTEERANVIASALAQIPQKI

SEQ ID NO: 95482 - protein, 523 aa, Homo sapiens
  Payload ID: 19041
  Gene Name: UDP glycosyltransferase 3 family, polypeptide A1
  Uniprot ID: Q6NUS8
  ENSP ID: ENSP00000274278
MVGQRVLLLVAFLLSGVLLSEAAKILTISTLGGSHYLLLDRVSQILQEHGHNVTMLHQSGKFLIPDIKEEEKSYQVIRWFSPEDHQKRIKKHFDSYIETALDGRKESEALVKLMEIFGTQCSYLLSRKDIMDSLKNENYDLVFVEAFDFCSFLIAEKLVKPFVAILPTTFGSLDFGLPSPLSYVPVFPSLLTDHMDFWGRVKNFLMFFSFSRSQWDMQSTFDNTIKEHFPEGSRPVLSHLLLKAELWFVNSDFAFDFARPLLPNTVYIGGLMEKPIKPVPQDLDNFIANFGDAGFVLVAFGSMLNTHQSQEVLKKMHNAFAHLPQGVIWTCQSSHWPRDVHLATNVKIVDWLPQSDLLAHPSIRLFVTHGGQNSVMEAIRHGVPMVGLPVNGDQHGNMVRVVAKNYGVSIRLNQVTADTLTLTMKQVIEDKRYKSAVVAASVILHSQPLSPAQRLVGWIDHILQTGGATHLKPYAFQQPWHEQYLIDVFVFLLGLTLGTMWLCGKLLGVVARWLRGARKVKKT

SEQ ID NO: 95483 - protein, 252 aa, Homo sapiens
  Payload ID: 19041
  Gene Name: UDP glycosyltransferase 3 family, polypeptide A1
  Uniprot ID: Q6NUS8
  ENSP ID: ENSP00000328033
MLHQSGKFLIPDIKEEEKSYQVIRWFSPEDHQKRIKKHFDSYIETALDGRKESEALVKLMEIFGTQCSYLLSRKDIMDSLKNENYDLVFVEAFDFCSFLIAEKLVKPFVAILPTTFGSLDFGLPSPLSYVPVFPSLLTDHMDFWGRVKNFLMFFSFSRSQWDMQSTFDNTIKEHFPEGSRPVLSHLLLKAELWFVNSDFAFDFARPLLPNTVYIGGLMEKPIKPVPQNGQPALFTTPSLFSSGVYPEPLRWL

SEQ ID NO: 95484 - protein, 402 aa, Homo sapiens
  Payload ID: 19041
  Gene Name: UDP glycosyltransferase 3 family, polypeptide A1
  ENSP ID: ENSP00000426100
MVGQRVLLLVAFLLSGVLLSEAAKILTISTLDIKEEEKSYQVIRWFSPEDHQKRIKKHFDSYIETALDGRKESEALVKLMEIFGTQCSYLLSRKDIMDSLKNENYDLVFVEAFDFCSFLIAEKLVKPFVAILPTTFGSLDFGLPSPLSYVPVFPSLLTDHMDFWGRVKNFLMFFSFSRSQWDMQSTFDNTIKEHFPEGSRPVLSHLLLKAELWFVNSDFAFDFARPLLPNTVYIGGLMEKPIKPVPQDLDNFIANFGDAGFVLVAFGSMLNTHQSQEVLKKMHNAFAHLPQGVIWTCQSSHWPRDVHLATNVKIVDWLPQSDLLAHPSIRLFVTHGGQNSVMEAIRHGVPMVGLPVNGDQHGNMVRVVAKNYGVSIRLNQVTADTLTLTMKQVIEDKRYVAL

SEQ ID NO: 95485 - protein, 436 aa, Homo sapiens
  Payload ID: 19041
  Gene Name: UDP glycosyltransferase 3 family, polypeptide A1
  ENSP ID: ENSP00000427079
MVGQRVLLLVAFLLSGVLLSEAAKILTISTLGGSHYLLLDRVSQILQEHGHNVTMLHQSGKFLIPDIKEEEKSYQVIRWFSPEDHQKRIKKHFDSYIETALDGRKESEALVKLMEIFGTQCSYLLSRKDIMDSLKNENYDLVFVEAFDFCSFLIAEKLVKPFVAILPTTFGSLDFGLPSPLSYVPVFPSLLTDHMDFWGRVKNFLMFFSFSRSQWDMQSTFDNTIKEHFPEGSRPVLSHLLLKAELWFVNSDFAFDFARPLLPNTVYIGGLMEKPIKPVPQDLDNFIANFGDAGFVLVAFGSMLNTHQSQEVLKKMHNAFAHLPQGVIWTCQSSHWPRDVHLATNVKIVDWLPQSDLLAHPSIRLFVTHGGQNSVMEAIRHGVPMVGLPVNGDQHGNMVRVVAKNYGVSIRLNQVTADTLTLTMKQVIEDKRYVAL

SEQ ID NO: 95486 - protein, 57 aa, Homo sapiens
  Payload ID: 19041
  Gene Name: UDP glycosyltransferase 3 family, polypeptide A1
  ENSP ID: ENSP00000427630
MVGQRVLLLVAFLLSGVLLSEAAKILTISTLGECLAGEFPDRRVPDPRTARAPANGD

SEQ ID NO: 95487 - protein, 252 aa, Homo sapiens; identical to SEQ ID NO: 95483
  Payload ID: 19041
  Gene Name: UDP glycosyltransferase 3 family, polypeptide A1
  Uniprot ID: Q6NUS8
  ENSP ID: ENSP00000487376

SEQ ID NO: 95488 - protein, 523 aa, Homo sapiens
  Payload ID: 19042
  Gene Name: UDP glycosyltransferase 3 family, polypeptide A2
  Uniprot ID: Q3SY77
  ENSP ID: ENSP00000282507
MAGQRVLLLVGFLLPGVLLSEAAKILTISTVGGSHYLLMDRVSQILQDHGHNVTMLNHKRGPFMPDFKKEEKSYQVISWLAPEDHQREFKKSFDFFLEETLGGRGKFENLLNVLEYLALQCSHFLNRKDIMDSLKNENFDMVIVETFDYCPFLIAEKLGKPFVAILSTSFGSLEFGLPIPLSYVPVFRSLLTDHMDFWGRVKNFLMFFSFCRRQQHMQSTFDNTIKEHFTEGSRPVLSHLLLKAELWFINSDFAFDFARPLLPNTVYVGGLMEKPIKPVPQDLENFIAKFGDSGFVLVTLGSMVNTCQNPEIFKEMNNAFAHLPQGVIWKCQCSHWPKDVHLAANVKIVDWLPQSDLLAHPSIRLFVTHGGQNSIMEAIQHGVPMVGIPLFGDQPENMVRVEAKKFGVSIQLKKLKAETLALKMKQIMEDKRYKSAAVAASVILRSHPLSPTQRLVGWIDHVLQTGGATHLKPYVFQQPWHEQYLLDVFVFLLGLTLGTLWLCGKLLGMAVWWLRGARKVKET

SEQ ID NO: 95489 - protein, 138 aa, Homo sapiens
  Payload ID: 19042
  Gene Name: UDP glycosyltransferase 3 family, polypeptide A2
  ENSP ID: ENSP00000420865
MAGQRVLLLVGFLLPGVLLSEAAKILTISTVGGSHYLLMDRVSQILQDHGHNVTMLNHKRGPFMPDFKKEEKSYQVISWLAPEDHQREFKKSFDFFLEETLGGRGKFENLLNVLEYLALQCSHFLNRKDIMDSLKNEN

SEQ ID NO: 95490 - protein, 120 aa, Homo sapiens
  Payload ID: 19042
  Gene Name: UDP glycosyltransferase 3 family, polypeptide A2
  ENSP ID: ENSP00000426017
MAGQRVLLLVGFLLPGVLLSEAAKILTISTVGGSHYLLMDRVSQILQDHGHNVTMLNHKRGPFMPDFKKEEKSYQVISWLAPEDHQREFKKSFDFFLEETLGGRTWRTSLPSLGTLVLSL

SEQ ID NO: 95491 - protein, 489 aa, Homo sapiens
  Payload ID: 19042
  Gene Name: UDP glycosyltransferase 3 family, polypeptide A2
  Uniprot ID: Q3SY77
  ENSP ID: ENSP00000427404
MAGQRVLLLVGFLLPGVLLSEAAKILTISTVDFKKEEKSYQVISWLAPEDHQREFKKSFDFFLEETLGGRGKFENLLNVLEYLALQCSHFLNRKDIMDSLKNENFDMVIVETFDYCPFLIAEKLGKPFVAILSTSFGSLEFGLPIPLSYVPVFRSLLTDHMDFWGRVKNFLMFFSFCRRQQHMQSTFDNTIKEHFTEGSRPVLSHLLLKAELWFINSDFAFDFARPLLPNTVYVGGLMEKPIKPVPQDLENFIAKFGDSGFVLVTLGSMVNTCQNPEIFKEMNNAFAHLPQGVIWKCQCSHWPKDVHLAANVKIVDWLPQSDLLAHPSIRLFVTHGGQNSIMEAIQHGVPMVGIPLFGDQPENMVRVEAKKFGVSIQLKKLKAETLALKMKQIMEDKRYKSAAVAASVILRSHPLSPTQRLVGWIDHVLQTGGATHLKPYVFQQPWHEQYLLDVFVFLLGLTLGTLWLCGKLLGMAVWWLRGARKVKET

SEQ ID NO: 95492 - protein, 541 aa, Homo sapiens
  Payload ID: 19043
  Gene Name: UDP glycosyltransferase 8
  Uniprot ID: Q16880
  ENSP ID: ENSP00000311648
MKSYTPYFILLWSAVGIAKAAKIIIVPPIMFESHMYIFKTLASALHERGHHTVFLLSEGRDIAPSNHYSLQRYPGIFNSTTSDAFLQSKMRNIFSGRLTAIELFDILDHYTKNCDLMVGNHALIQGLKKEKFDLLLVDPNDMCGFVIAHLLGVKYAVFSTGLWYPAEVGAPAPLAYVPEFNSLLTDRMNLLQRMKNTGVYLISRLGVSFLVLPKYERIMQKYNLLPEKSMYDLVHGSSLWMLCTDVALEFPRPTLPNVVYVGGILTKPASPLPEDLQRWVNGANEHGFVLVSFGAGVKYLSEDIANKLAGALGRLPQKVIWRFSGPKPKNLGNNTKLIEWLPQNDLLGHSKIKAFLSHGGLNSIFETIYHGVPVVGIPLFGDHYDTMTRVQAKGMGILLEWKTVTEKELYEALVKVINNPSYRQRAQKLSEIHKDQPGHPVNRTIYWIDYIIRHNGAHHLRAAVHQISFCQYFLLDIAFVLLLGAALLYFLLSWVTKFIYRKIKSLWSRNKHSTVNGHYHNGILNGKYKRNGHIKHEKKVK

SEQ ID NO: 95493 - protein, 541 aa, Homo sapiens; identical to SEQ ID NO: 95492
  Payload ID: 19043
  Gene Name: UDP glycosyltransferase 8
  Uniprot ID: Q16880
  ENSP ID: ENSP00000378019

SEQ ID NO: 95494 - protein, 141 aa, Homo sapiens
  Payload ID: 19043
  Gene Name: UDP glycosyltransferase 8
  ENSP ID: ENSP00000421446
MKSYTPYFILLWSAVGIAKAAKIIIVPPIMFESHMYIFKTLASALHERGHHTVFLLSEGRDIAPSNHYSLQRYPGIFNSTTSDAFLQSKMRNIFSGRLTAIELFDILDHYTKNCDLMVGNHALIQGLKKEKFDLLLVDPND

SEQ ID NO: 95495 - protein, 329 aa, Homo sapiens
  Payload ID: 19044
  Gene Name: UDP-Gal:betaGal beta 1,3-galactosyltransferase polypeptide 6
  Uniprot ID: Q96L58
  ENSP ID: ENSP00000368496
MKLLRRAWRRRAALGLGTLALCGAALLYLARCAAEPGDPRAMSGRSPPPPAPARAAAFLAVLVASAPRAAERRSVIRSTWLARRGAPGDVWARFAVGTAGLGAEERRALEREQARHGDLLLLPALRDAYENLTAKVLAMLAWLDEHVAFEFVLKADDDSFARLDALLAELRAREPARRRRLYWGFFSGRGRVKPGGRWREAAWQLCDYYLPYALGGGYVLSADLVHYLRLSRDYLRAWHSEDVSLGAWLAPVDVQREHDPRFDTEYRSRGCSNQYLVTHKQSLEDMLEKHATLAREGRLCKREVQLRLSYVYDWSAPPSQCCQRREGIP

SEQ ID NO: 95496 - protein, 326 aa, Homo sapiens
  Payload ID: 19045
  Gene Name: UDP-Gal:betaGlcNAc beta 1,3-galactosyltransferase, polypeptide 1
  Uniprot ID: Q9Y5Z6
  ENSP ID: ENSP00000376456
MASKVSCLYVLTVVCWASALWYLSITRPTSSYTGSKPFSHLTVARKNFTFGNIRTRPINPHSFEFLINEPNKCEKNIPFLVILISTTHKEFDARQAIRETWGDENNFKGIKIATLFLLGKNADPVLNQMVEQESQIFHDIIVEDFIDSYHNLTLKTLMGMRWVATFCSKAKYVMKTDSDIFVNMDNLIYKLLKPSTKPRRRYFTGYVINGGPIRDVRSKWYMPRDLYPDSNYPPFCSGTGYIFSADVAELIYKTSLHTRLLHLEDVYVGLCLRKLGIHPFQNSGFNHWKMAYSLCRYRRVITVHQISPEEMHRIWNDMSSKKHLRC

SEQ ID NO: 95497 - protein, 422 aa, Homo sapiens
  Payload ID: 19046
  Gene Name: UDP-Gal:betaGlcNAc beta 1,3-galactosyltransferase, polypeptide 2
  Uniprot ID: O43825
  ENSP ID: ENSP00000356404
MLQWRRRHCCFAKMTWNAKRSLFRTHLIGVLSLVFLFAMFLFFNHHDWLPGRAGFKENPVTYTFRGFRSTKSETNHSSLRNIWKETVPQTLRPQTATNSNNTDLSPQGVTGLENTLSANGSIYNEKGTGHPNSYHFKYIINEPEKCQEKSPFLILLIAAEPGQIEARRAIRQTWGNESLAPGIQITRIFLLGLSIKLNGYLQRAILEESRQYHDIIQQEYLDTYYNLTIKTLMGMNWVATYCPHIPYVMKTDSDMFVNTEYLINKLLKPDLPPRHNYFTGYLMRGYAPNRNKDSKWYMPPDLYPSERYPVFCSGTGYVFSGDLAEKIFKVSLGIRRLHLEDVYVGICLAKLRIDPVPPPNEFVFNHWRVSYSSCKYSHLITSHQFQPSELIKYWNHLQQNKHNACANAAKEKAGRYRHRKLH

SEQ ID NO: 95498 - protein, 378 aa, Homo sapiens
  Payload ID: 19047
  Gene Name: UDP-Gal:betaGlcNAc beta 1,3-galactosyltransferase, polypeptide 4
  Uniprot ID: O96024
  ENSP ID: ENSP00000372696
MQLRLFRRLLLAALLLVIVWTLFGPSGLGEELLSLSLASLLPAPASPGPPLALPRLLIPNQEACSGPGAPPFLLILVCTAPENLNQRNAIRASWGGLREARGLRVQTLFLLGEPNAQHPVWGSQGSDLASESAAQGDILQAAFQDSYRNLTLKTLSGLNWAEKHCPMARYVLKTDDDVYVNVPELVSELVLRGGRWGQWERSTEPQREAEQEGGQVLHSEEVPLLYLGRVHWRVNPSRTPGGRHRVSEEQWPHTWGPFPPYASGTGYVLSASAVQLILKVASRAPLLPLEDVFVGVSARRGGLAPTQCVKLAGATHYPLDRCCYGKFLLTSHRLDPWKMQEAWKLVGGSDGERTAPFCSWFQGVLGILRCRAIAWLQS

SEQ ID NO: 95499 - protein, 378 aa, Homo sapiens; identical to SEQ ID NO: 95498
  Payload ID: 19047
  Gene Name: UDP-Gal:betaGlcNAc beta 1,3-galactosyltransferase, polypeptide 4
  Uniprot ID: O96024
  ENSP ID: ENSP00000390784

SEQ ID NO: 95500 - protein, 378 aa, Homo sapiens; identical to SEQ ID NO: 95498
  Payload ID: 19047
  Gene Name: UDP-Gal:betaGlcNAc beta 1,3-galactosyltransferase, polypeptide 4
  Uniprot ID: O96024
  ENSP ID: ENSP00000394876

SEQ ID NO: 95501 - protein, 378 aa, Homo sapiens; identical to SEQ ID NO: 95498
  Payload ID: 19047
  Gene Name: UDP-Gal:betaGlcNAc beta 1,3-galactosyltransferase, polypeptide 4
  Uniprot ID: O96024
  ENSP ID: ENSP00000398660

SEQ ID NO: 95502 - protein, 378 aa, Homo sapiens; identical to SEQ ID NO: 95498
  Payload ID: 19047
  Gene Name: UDP-Gal:betaGlcNAc beta 1,3-galactosyltransferase, polypeptide 4
  Uniprot ID: O96024
  ENSP ID: ENSP00000414880

SEQ ID NO: 95503 - protein, 310 aa, Homo sapiens
  Payload ID: 19048
  Gene Name: UDP-Gal:betaGlcNAc beta 1,3-galactosyltransferase, polypeptide 5
  Uniprot ID: Q9Y2C3
  ENSP ID: ENSP00000343318
MAFPKMRLMYICLLVLGALCLYFSMYSLNPFKEQSFVYKKDGNFLKLPDTDCRQTPPFLVLLVTSSHKQLAERMAIRQTWGKERMVKGKQLKTFFLLGTTSSAAETKEVDQESQRHGDIIQKDFLDVYYNLTLKTMMGIEWVHRFCPQAAFVMKTDSDMFINVDYLTELLLKKNRTTRFFTGFLKLNEFPIRQPFSKWFVSKSEYPWDRYPPFCSGTGYVFSGDVASQVYNVSKSVPYIKLEDVFVGLCLERLNIRLEELHSQPTFFPGGLRFSVCLFRRIVACHFIKPRTLLDYWQALENSRGEDCPPV

SEQ ID NO: 95504 - protein, 310 aa, Homo sapiens; identical to SEQ ID NO: 95503
  Payload ID: 19048
  Gene Name: UDP-Gal:betaGlcNAc beta 1,3-galactosyltransferase, polypeptide 5
  Uniprot ID: Q9Y2C3
  ENSP ID: ENSP00000369992

SEQ ID NO: 95505 - protein, 310 aa, Homo sapiens; identical to SEQ ID NO: 95503
  Payload ID: 19048
  Gene Name: UDP-Gal:betaGlcNAc beta 1,3-galactosyltransferase, polypeptide 5
  Uniprot ID: Q9Y2C3
  ENSP ID: ENSP00000369994

SEQ ID NO: 95506 - protein, 314 aa, Homo sapiens
  Payload ID: 19048
  Gene Name: UDP-Gal:betaGlcNAc beta 1,3-galactosyltransferase, polypeptide 5
  ENSP ID: ENSP00000381699
MCLEMAFPKMRLMYICLLVLGALCLYFSMYSLNPFKEQSFVYKKDGNFLKLPDTDCRQTPPFLVLLVTSSHKQLAERMAIRQTWGKERMVKGKQLKTFFLLGTTSSAAETKEVDQESQRHGDIIQKDFLDVYYNLTLKTMMGIEWVHRFCPQAAFVMKTDSDMFINVDYLTELLLKKNRTTRFFTGFLKLNEFPIRQPFSKWFVSKSEYPWDRYPPFCSGTGYVFSGDVASQVYNVSKSVPYIKLEDVFVGLCLERLNIRLEELHSQPTFFPGGLRFSVCLFRRIVACHFIKPRTLLDYWQALENSRGEDCPPV

SEQ ID NO: 95507 - protein, 310 aa, Homo sapiens; identical to SEQ ID NO: 95503
  Payload ID: 19048
  Gene Name: UDP-Gal:betaGlcNAc beta 1,3-galactosyltransferase, polypeptide 5
  Uniprot ID: Q9Y2C3
  ENSP ID: ENSP00000480285

SEQ ID NO: 95508 - protein, 398 aa, Homo sapiens
  Payload ID: 19049
  Gene Name: UDP-Gal:betaGlcNAc beta 1,4- galactosyltransferase, polypeptide 1
  Uniprot ID: P15291
  ENSP ID: ENSP00000369055
MRLREPLLSGSAAMPGASLQRACRLLVAVCALHLGVTLVYYLAGRDLSRLPQLVGVSTPLQGGSNSAAAIGQSSGELRTGGARPPPPLGASSQPRPGGDSSPVVDSGPGPASNLTSVPVPHTTALSLPACPEESPLLVGPMLIEFNMPVDLELVAKQNPNVKMGGRYAPRDCVSPHKVAIIIPFRNRQEHLKYWLYYLHPVLQRQQLDYGIYVINQAGDTIFNRAKLLNVGFQEALKDYDYTCFVFSDVDLIPMNDHNAYRCFSQPRHISVAMDKFGFSLPYVQYFGGVSALSKQQFLTINGFPNNYWGWGGEDDDIFNRLVFRGMSISRPNAVVGRCRMIRHSRDKKNEPNPQRFDRIAHTKETMLSDGLNSLTYQVLDVQRYPLYTQITVDIGTPS

SEQ ID NO: 95509 - protein, 225 aa, Homo sapiens
  Payload ID: 19049
  Gene Name: UDP-Gal:betaGlcNAc beta 1,4- galactosyltransferase, polypeptide 1
  ENSP ID: ENSP00000440341
MRLREPLLSGSAAMPGASLQRACRLLVAVCALHLGVTLVYYLAGRDLSRLPQLVGVSTPLQGGSNSAAAIGQSSGELRTGGARPPPPLGASSQPRPGGDSSPVVDSGPGPASNLTSVPVPHTTALSLPACPEESPLLVGPMLIEFNMPVDLELVAKQNPNVKMGGRYAPRDCVSPHKVAIIIPFRNRQEHLKYWLYYLHPVLQRQQLDYGIYVINQYEKIRRLLW

SEQ ID NO: 95510 - protein, 401 aa, Homo sapiens
  Payload ID: 19050
  Gene Name: UDP-Gal:betaGlcNAc beta 1,4- galactosyltransferase, polypeptide 2
  Uniprot ID: O60909
  ENSP ID: ENSP00000310696
MAVEVQEQWPCLPAAGCPGPLGGPVAACGMSRLLGGTLERVCKAVLLLCLLHFLVAVILYFDVYAQHLAFFSRFSARGPAHALHPAASSSSSSSNCSRPNATASSSGLPEVPSALPGPTAPTLPPCPDSPPGLVGRLLIEFTSPMPLERVQRENPGVLMGGRYTPPDCTPAQTVAVIIPFRHREHHLRYWLHYLHPILRRQRLRYGVYVINQHGEDTFNRAKLLNVGFLEALKEDAAYDCFIFSDVDLVPMDDRNLYRCGDQPRHFAIAMDKFGFRLPYAGYFGGVSGLSKAQFLRINGFPNEYWGWGGEDDDIFNRISLTGMKISRPDIRIGRYRMIKHDRDKHNEPNPQRFTKIQNTKLTMKRDGIGSVRYQVLEVSRQPLFTNITVDIGRPPSWPPRG

SEQ ID NO: 95511 - protein, 372 aa, Homo sapiens
  Payload ID: 19050
  Gene Name: UDP-Gal:betaGlcNAc beta 1,4- galactosyltransferase, polypeptide 2
  Uniprot ID: O60909
  ENSP ID: ENSP00000349293
MSRLLGGTLERVCKAVLLLCLLHFLVAVILYFDVYAQHLAFFSRFSARGPAHALHPAASSSSSSSNCSRPNATASSSGLPEVPSALPGPTAPTLPPCPDSPPGLVGRLLIEFTSPMPLERVQRENPGVLMGGRYTPPDCTPAQTVAVIIPFRHREHHLRYWLHYLHPILRRQRLRYGVYVINQHGEDTFNRAKLLNVGFLEALKEDAAYDCFIFSDVDLVPMDDRNLYRCGDQPRHFAIAMDKFGFRLPYAGYFGGVSGLSKAQFLRINGFPNEYWGWGGEDDDIFNRISLTGMKISRPDIRIGRYRMIKHDRDKHNEPNPQRFTKIQNTKLTMKRDGIGSVRYQVLEVSRQPLFTNITVDIGRPPSWPPRG

SEQ ID NO: 95512 - protein, 372 aa, Homo sapiens; identical to SEQ ID NO: 95511
  Payload ID: 19050
  Gene Name: UDP-Gal:betaGlcNAc beta 1,4- galactosyltransferase, polypeptide 2
  Uniprot ID: O60909
  ENSP ID: ENSP00000361399

SEQ ID NO: 95513 - protein, 306 aa, Homo sapiens
  Payload ID: 19050
  Gene Name: UDP-Gal:betaGlcNAc beta 1,4- galactosyltransferase, polypeptide 2
  Uniprot ID: O60909
  ENSP ID: ENSP00000407468
MPSTQLLAAAAAAATAPGPTPPPLAPGSLRSPVPCPVPRLPRCHPVLTRHLVLRVQRENPGVLMGGRYTPPDCTPAQTVAVIIPFRHREHHLRYWLHYLHPILRRQRLRYGVYVINQHGEDTFNRAKLLNVGFLEALKEDAAYDCFIFSDVDLVPMDDRNLYRCGDQPRHFAIAMDKFGFRLPYAGYFGGVSGLSKAQFLRINGFPNEYWGWGGEDDDIFNRISLTGMKISRPDIRIGRYRMIKHDRDKHNEPNPQRFTKIQNTKLTMKRDGIGSVRYQVLEVSRQPLFTNITVDIGRPPSWPPRG

SEQ ID NO: 95514 - protein, 393 aa, Homo sapiens
  Payload ID: 19051
  Gene Name: UDP-Gal:betaGlcNAc beta 1,4- galactosyltransferase, polypeptide 3
  Uniprot ID: O60512
  ENSP ID: ENSP00000320965
MLRRLLERPCTLALLVGSQLAVMMYLSLGGFRSLSALFGRDQGPTFDYSHPRDVYSNLSHLPGAPGGPPAPQGLPYCPERSPLLVGPVSVSFSPVPSLAEIVERNPRVEPGGRYRPAGCEPRSRTAIIVPHRAREHHLRLLLYHLHPFLQRQQLAYGIYVIHQAGNGTFNRAKLLNVGVREALRDEEWDCLFLHDVDLLPENDHNLYVCDPRGPRHVAVAMNKFGYSLPYPQYFGGVSALTPDQYLKMNGFPNEYWGWGGEDDDIATRVRLAGMKISRPPTSVGHYKMVKHRGDKGNEENPHRFDLLVRTQNSWTQDGMNSLTYQLLARELGPLYTNITADIGTDPRGPRAPSGPRYPPGSSQAFRQEMLQRRPPARPGPLSTANHTALRGSH

SEQ ID NO: 95515 - protein, 393 aa, Homo sapiens; identical to SEQ ID NO: 95514
  Payload ID: 19051
  Gene Name: UDP-Gal:betaGlcNAc beta 1,4- galactosyltransferase, polypeptide 3
  Uniprot ID: O60512
  ENSP ID: ENSP00000356977

SEQ ID NO: 95516 - protein, 393 aa, Homo sapiens; identical to SEQ ID NO: 95514
  Payload ID: 19051
  Gene Name: UDP-Gal:betaGlcNAc beta 1,4- galactosyltransferase, polypeptide 3
  Uniprot ID: O60512
  ENSP ID: ENSP00000480428

SEQ ID NO: 95517 - protein, 344 aa, Homo sapiens
  Payload ID: 19052
  Gene Name: UDP-Gal:betaGlcNAc beta 1,4- galactosyltransferase, polypeptide 4
  Uniprot ID: O60513
  ENSP ID: ENSP00000352144
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQAENPKVSRGRYRPQECKALQRVAILVPHRNREKHLMYLLEHLHPFLQRQQLDYGIYVIHQAEGKKFNRAKLLNVGYLEALKEENWDCFIFHDVDLVPENDFNLYKCEEHPKHLVVGRNSTGYRLRYSGYFGGVTALSREQFFKVNGFSNNYWGWGGEDDDLRLRVELQRMKISRPLPEVGKYTMVFHTRDKGNEVNAERMKLLHQVSRVWRTDGLSSCSYKLVSVEHNPLYINITVDFWFGA

SEQ ID NO: 95518 - protein, 344 aa, Homo sapiens; identical to SEQ ID NO: 95517
  Payload ID: 19052
  Gene Name: UDP-Gal:betaGlcNAc beta 1,4- galactosyltransferase, polypeptide 4
  Uniprot ID: O60513
  ENSP ID: ENSP00000377360

SEQ ID NO: 95519 - protein, 136 aa, Homo sapiens
  Payload ID: 19052
  Gene Name: UDP-Gal:betaGlcNAc beta 1,4- galactosyltransferase, polypeptide 4
  ENSP ID: ENSP00000417188
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQAENPKVSRGRYRPQECKALQRVAILVPHRNREKH

SEQ ID NO: 95520 - protein, 301 aa, Homo sapiens
  Payload ID: 19052
  Gene Name: UDP-Gal:betaGlcNAc beta 1,4- galactosyltransferase, polypeptide 4
  ENSP ID: ENSP00000417226
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQAENPKVSRGRYRPQECKALQRVAILVPHRNREKHLMYLLEHLHPFLQRQQLDYGIYVIHQAEGKKFNRAKLLNVGYLEALKEENWDCFIFHDVDLVPENDFNLYKCEEHPKHLVVGRNSTGYRLRYSGYFGGVTALSREQFFKVNGFSNNYWGWGGEDDDLRLRVELQRMKISRPLPEVGKYTMVFHTRDKGNEVNAER

SEQ ID NO: 95521 - protein, 62 aa, Homo sapiens
  Payload ID: 19052
  Gene Name: UDP-Gal:betaGlcNAc beta 1,4- galactosyltransferase, polypeptide 4
  ENSP ID: ENSP00000417527
MANFHKTLILGKGKTLTNEASTKKVELDNCPSVSPYLRGQSKLIFKPDLTLEEVQEIRLLNV

SEQ ID NO: 95522 - protein, 118 aa, Homo sapiens
  Payload ID: 19052
  Gene Name: UDP-Gal:betaGlcNAc beta 1,4- galactosyltransferase, polypeptide 4
  ENSP ID: ENSP00000417958
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQAENPKVSRGRYRPQEC

SEQ ID NO: 95523 - protein, 2 aa, Homo sapiens
  Payload ID: 19052
  Gene Name: UDP-Gal:betaGlcNAc beta 1,4- galactosyltransferase, polypeptide 4
  ENSP ID: ENSP00000418278
MG

SEQ ID NO: 95524 - protein, 41 aa, Homo sapiens
  Payload ID: 19052
  Gene Name: UDP-Gal:betaGlcNAc beta 1,4- galactosyltransferase, polypeptide 4
  ENSP ID: ENSP00000418436
MGFNLTFHLSYKFRLLLLLTLCLTVVGWATSNYFVGAIQEI

SEQ ID NO: 95525 - protein, 6 aa, Homo sapiens
  Payload ID: 19052
  Gene Name: UDP-Gal:betaGlcNAc beta 1,4- galactosyltransferase, polypeptide 4
  ENSP ID: ENSP00000419275
MGFNLT

SEQ ID NO: 95526 - protein, 21 aa, Homo sapiens
  Payload ID: 19052
  Gene Name: UDP-Gal:betaGlcNAc beta 1,4- galactosyltransferase, polypeptide 4
  ENSP ID: ENSP00000419916
MGFNLTFHLSYKFRLLLLLTL

SEQ ID NO: 95527 - protein, 25 aa, Homo sapiens
  Payload ID: 19052
  Gene Name: UDP-Gal:betaGlcNAc beta 1,4- galactosyltransferase, polypeptide 4
  ENSP ID: ENSP00000419919
MYLLEHLHPFLQRQQLDYGIYVIHQ

SEQ ID NO: 95528 - protein, 344 aa, Homo sapiens; identical to SEQ ID NO: 95517
  Payload ID: 19052
  Gene Name: UDP-Gal:betaGlcNAc beta 1,4- galactosyltransferase, polypeptide 4
  Uniprot ID: O60513
  ENSP ID: ENSP00000420161

SEQ ID NO: 95529 - protein, 54 aa, Homo sapiens
  Payload ID: 19052
  Gene Name: UDP-Gal:betaGlcNAc beta 1,4- galactosyltransferase, polypeptide 4
  ENSP ID: ENSP00000420535
MGFNLTFHLSYKFRLLLLLTLCLTVVGWATSNYFVGAIQEIPKAKEFMANFHKT

SEQ ID NO: 95530 - protein, 246 aa, Homo sapiens
  Payload ID: 19052
  Gene Name: UDP-Gal:betaGlcNAc beta 1,4- galactosyltransferase, polypeptide 4
  ENSP ID: ENSP00000420665
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQAENPKVSRGRYRPQECKALQRVAILVPHRNREKHLMYLLEHLHPFLQRQQLDYGIYVIHQAEGKKFNRAKLLNVGYLEALKEENWDCFIFHDVDLVPENDFNLYKCEEHPKHLVVGRNSTGYRLRYSGYFGGVTALSREQFFKG

SEQ ID NO: 95531 - protein, 388 aa, Homo sapiens
  Payload ID: 19053
  Gene Name: UDP-Gal:betaGlcNAc beta 1,4- galactosyltransferase, polypeptide 5
  Uniprot ID: O43286
  ENSP ID: ENSP00000360776
MRARRGLLRLPRRSLLAALFFFSLSSSLLYFVYVAPGIVNTYLFMMQAQGILIRDNVRTIGAQVYEQVLRSAYAKRNSSVNDSDYPLDLNHSETFLQTTTFLPEDFTYFANHTCPERLPSMKGPIDINMSEIGMDYIHELFSKDPTIKLGGHWKPSDCMPRWKVAILIPFRNRHEHLPVLFRHLLPMLQRQRLQFAFYVVEQVGTQPFNRAMLFNVGFQEAMKDLDWDCLIFHDVDHIPESDRNYYGCGQMPRHFATKLDKYMYLLPYTEFFGGVSGLTVEQFRKINGFPNAFWGWGGEDDDLWNRVQNAGYSVSRPEGDTGKYKSIPHHHRGEVQFLGRYALLRKSKERQGLDGLNNLNYFANITYDALYKNITVNLTPELAQVNEY

SEQ ID NO: 95532 - protein, 343 aa, Homo sapiens
  Payload ID: 19054
  Gene Name: UDP-Gal:betaGlcNAc beta 1,4- galactosyltransferase, polypeptide 6
  ENSP ID: ENSP00000237019
MSVLRRMMRVSNRSLLAFIFFFSLSSSCLYFIYVAPGIDYPEGNNSSDYLVQTTTYLPENFTYSPYLPCPEKLPYMRGFLNVNVSEVSFDEIHQLFSKDLDIEPGGHWRPKDCKPRWKVAVLIPFRNRHEHLPIFFLHLIPMLQKQRLEFAFYVIEQTGTQPFNRAMLFNVGFKEAMKDSVWDCVIFHDVDHLPENDRNYYGCGEMPRHFAAKLDKYMYILPYKEFFGGVSGLTVEQFRKINGFPNAFWGWGGEDDDLWNRVHYAGYNVTRPEGDLGKYKSIPHHHRGEVQFLGRYKLLRYSKERQYIDGLNNLIYRPKILVDRLYTNISVNLMPELAPIEDY

SEQ ID NO: 95533 - protein, 382 aa, Homo sapiens
  Payload ID: 19054
  Gene Name: UDP-Gal:betaGlcNAc beta 1,4- galactosyltransferase, polypeptide 6
  Uniprot ID: Q9UBX8
  ENSP ID: ENSP00000306459
MSVLRRMMRVSNRSLLAFIFFFSLSSSCLYFIYVAPGIANTYLFMVQARGIMLRENVKTIGHMIRLYTNKNSTLNGTDYPEGNNSSDYLVQTTTYLPENFTYSPYLPCPEKLPYMRGFLNVNVSEVSFDEIHQLFSKDLDIEPGGHWRPKDCKPRWKVAVLIPFRNRHEHLPIFFLHLIPMLQKQRLEFAFYVIEQTGTQPFNRAMLFNVGFKEAMKDSVWDCVIFHDVDHLPENDRNYYGCGEMPRHFAAKLDKYMYILPYKEFFGGVSGLTVEQFRKINGFPNAFWGWGGEDDDLWNRVHYAGYNVTRPEGDLGKYKSIPHHHRGEVQFLGRYKLLRYSKERQYIDGLNNLIYRPKILVDRLYTNISVNLMPELAPIEDY

SEQ ID NO: 95534 - protein, 343 aa, Homo sapiens
  Payload ID: 19054
  Gene Name: UDP-Gal:betaGlcNAc beta 1,4- galactosyltransferase, polypeptide 6
  Uniprot ID: Q9UBX8
  ENSP ID: ENSP00000372613
MSVLRRMMRVSNRSLLAFIFFFSLSSSCLYFIYVAPGIANTYLFMVQARGIMLRENVKTIGHMIRLYTNKNSTLNGTDYPEGNNSSDYLVQTTTYLPENFTYSPYLPCPEKLPYMRGFLNVNVSEVSFDEIHQLFSKDLDIEPGGHWRPKDCKPRWKTGTQPFNRAMLFNVGFKEAMKDSVWDCVIFHDVDHLPENDRNYYGCGEMPRHFAAKLDKYMYILPYKEFFGGVSGLTVEQFRKINGFPNAFWGWGGEDDDLWNRVHYAGYNVTRPEGDLGKYKSIPHHHRGEVQFLGRYKLLRYSKERQYIDGLNNLIYRPKILVDRLYTNISVNLMPELAPIEDY

SEQ ID NO: 95535 - protein, 71 aa, Homo sapiens
  Payload ID: 19054
  Gene Name: UDP-Gal:betaGlcNAc beta 1,4- galactosyltransferase, polypeptide 6
  ENSP ID: ENSP00000463961
MVQARGIMLRENVKTIGHMIRLYTNKNSTLNGTDYPEGNNSSDYLVQTTTYLPENFTYSPYLPCPEKLPYM

SEQ ID NO: 95536 - protein, 348 aa, Homo sapiens
  Payload ID: 19055
  Gene Name: UDP-galactose-4-epimerase
  Uniprot ID: Q14376
  ENSP ID: ENSP00000363621
MAEKVLVTGGAGYIGSHTVLELLEAGYLPVVIDNFHNAFRGGGSLPESLRRVQELTGRSVEFEEMDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRIYNLGTGTGYSVLQMVQAMEKASGKKIPYKVVARREGDVAACYANPSLAQEELGWTAALGLDRMCEDLWRWQKQNPSGFGTQA

SEQ ID NO: 95537 - protein, 194 aa, Homo sapiens
  Payload ID: 19055
  Gene Name: UDP-galactose-4-epimerase
  ENSP ID: ENSP00000393359
MAEKVLVTGGAGYIGSHTVLELLEAGYLPVVIDNFHNAFRGGGSLPESLRRVQELTGRSVEFEEMDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHAS

SEQ ID NO: 95538 - protein, 108 aa, Homo sapiens
  Payload ID: 19055
  Gene Name: UDP-galactose-4-epimerase
  ENSP ID: ENSP00000397045
VAIGRREALNVFGNDYDTEDGTGVRDYIHVVDLAKGHIAALRKLKEQCGCRIPYKVVARREGDVAACYANPSLAQEELGWTAALGLDRMCEDLWRWQKQNPSGFGTQA

SEQ ID NO: 95539 - protein, 194 aa, Homo sapiens; identical to SEQ ID NO: 95537
  Payload ID: 19055
  Gene Name: UDP-galactose-4-epimerase
  ENSP ID: ENSP00000398257

SEQ ID NO: 95540 - protein, 239 aa, Homo sapiens
  Payload ID: 19055
  Gene Name: UDP-galactose-4-epimerase
  ENSP ID: ENSP00000398585
MDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRIPYKVVARREGDVAACYANPSLAQEELGWTAALGLDRM

SEQ ID NO: 95541 - protein, 227 aa, Homo sapiens
  Payload ID: 19055
  Gene Name: UDP-galactose-4-epimerase
  ENSP ID: ENSP00000414719
MDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRIYNLGTGTGYSVLQMVQAMEKASGKK

SEQ ID NO: 95542 - protein, 348 aa, Homo sapiens; identical to SEQ ID NO: 95536
  Payload ID: 19055
  Gene Name: UDP-galactose-4-epimerase
  Uniprot ID: Q14376
  ENSP ID: ENSP00000483375

SEQ ID NO: 95543 - protein, 397 aa, Homo sapiens
  Payload ID: 19056
  Gene Name: UDP-GlcNAc:betaGal beta-1,3-N-acetylglucosaminyltransferase 2
  Uniprot ID: Q9NY97
  ENSP ID: ENSP00000305595
MSVGRRRIKLLGILMMANVFIYFIMEVSKSSSQEKNGKGEVIIPKEKFWKISTPPEAYWNREQEKLNRQYNPILSMLTNQTGEAGRLSNISHLNYCEPDLRVTSVVTGFNNLPDRFKDFLLYLRCRNYSLLIDQPDKCAKKPFLLLAIKSLTPHFARRQAIRESWGQESNAGNQTVVRVFLLGQTPPEDNHPDLSDMLKFESEKHQDILMWNYRDTFFNLSLKEVLFLRWVSTSCPDTEFVFKGDDDVFVNTHHILNYLNSLSKTKAKDLFIGDVIHNAGPHRDKKLKYYIPEVVYSGLYPPYAGGGGFLYSGHLALRLYHITDQVHLYPIDDVYTGMCLQKLGLVPEKHKGFRTFDIEEKNKNNICSYVDLMLVHSRKPQEMIDIWSQLQSAHLKC

SEQ ID NO: 95544 - protein, 397 aa, Homo sapiens; identical to SEQ ID NO: 95543
  Payload ID: 19056
  Gene Name: UDP-GlcNAc:betaGal beta-1,3-N-acetylglucosaminyltransferase 2
  Uniprot ID: Q9NY97
  ENSP ID: ENSP00000384692

SEQ ID NO: 95545 - protein, 372 aa, Homo sapiens
  Payload ID: 19057
  Gene Name: UDP-GlcNAc:betaGal beta-1,3-N-acetylglucosaminyltransferase 3
  Uniprot ID: Q9Y2A9
  ENSP ID: ENSP00000321874
MKYLRHRRPNATLILAIGAFTLLLFSLLVSPPTCKVQEQPPAIPEALAWPTPPTRPAPAPCHANTSMVTHPDFATQPQHVQNFLLYRHCRHFPLLQDVPPSKCAQPVFLLLVIKSSPSNYVRRELLRRTWGRERKVRGLQLRLLFLVGTASNPHEARKVNRLLELEAQTHGDILQWDFHDSFFNLTLKQVLFLQWQETRCANASFVLNGDDDVFAHTDNMVFYLQDHDPGRHLFVGQLIQNVGPIRAFWSKYYVPEVVTQNERYPPYCGGGGFLLSRFTAAALRRAAHVLDIFPIDDVFLGMCLELEGLKPASHSGIRTSGVRAPSQRLSSFDPCFYRDLLLVHRFLPYEMLLMWDALNQPNLTCGNQTQIY

SEQ ID NO: 95546 - protein, 127 aa, Homo sapiens
  Payload ID: 19057
  Gene Name: UDP-GlcNAc:betaGal beta-1,3-N-acetylglucosaminyltransferase 3
  ENSP ID: ENSP00000468914
MKYLRHRRPNATLILAIGAFTLLLFSLLVSPPTCKVQEQPPAIPEALAWPTPPTRPAPAPCHANTSMVTHPDFATQPQHVQNFLLYRHCRHFPLLQDVPPSKCAQPVFLLLVIKSSPSNYVRRELLR

SEQ ID NO: 95547 - protein, 250 aa, Homo sapiens
  Payload ID: 19057
  Gene Name: UDP-GlcNAc:betaGal beta-1,3-N-acetylglucosaminyltransferase 3
  ENSP ID: ENSP00000471733
MKYLRHRRPNATLILAIGAFTLLLFSLLVSPPTCKVQEQPPAIPEALAWPTPPTRPAPAPCHANTSMVTHPDFATQPQHVQNFLLYRHCRHFPLLQDVPPSKCAQPVFLLLVIKSSPSNYVRRELLRRTWGRERKVRGLQLRLLFLVGTASNPHEARKVNRLLELEAQTHGDILQWDFHDSFFNLTLKQVLFLQWQETRCANASFVLNGDDDVFAHTDNMVFYLQDHDPGRHLFVGQLIQNVGPIRAFWS

SEQ ID NO: 95548 - protein, 372 aa, Homo sapiens; identical to SEQ ID NO: 95545
  Payload ID: 19057
  Gene Name: UDP-GlcNAc:betaGal beta-1,3-N-acetylglucosaminyltransferase 3
  Uniprot ID: Q9Y2A9
  ENSP ID: ENSP00000472638

SEQ ID NO: 95549 - protein, 378 aa, Homo sapiens
  Payload ID: 19058
  Gene Name: UDP-GlcNAc:betaGal beta-1,3-N-acetylglucosaminyltransferase 4
  Uniprot ID: Q9C0J1
  ENSP ID: ENSP00000319636
MLPPQPSAAHQGRGGRSGLLPKGPAMLCRLCWLVSYSLAVLLLGCLLFLRKAAKPAGDPTAHQPFWAPPTPRHSRCPPNHTVSSASLSLPSRHRLFLTYRHCRNFSILLEPSGCSKDTFLLLAIKSQPGHVERRAAIRSTWGRVGGWARGRQLKLVFLLGVAGSAPPAQLLAYESREFDDILQWDFTEDFFNLTLKELHLQRWVVAACPQAHFMLKGDDDVFVHVPNVLEFLDGWDPAQDLLVGDVIRQALPNRNTKVKYFIPPSMYRATHYPPYAGGGGYVMSRATVRRLQAIMEDAELFPIDDVFVGMCLRRLGLSPMHHAGFKTFGIRRPLDPLDPCLYRGLLLVHRLSPLEMWTMWALVTDEGLKCAAGPIPQR

SEQ ID NO: 95550 - protein, 353 aa, Homo sapiens
  Payload ID: 19058
  Gene Name: UDP-GlcNAc:betaGal beta-1,3-N-acetylglucosaminyltransferase 4
  Uniprot ID: Q9C0J1
  ENSP ID: ENSP00000438840
MLCRLCWLVSYSLAVLLLGCLLFLRKAAKPAGDPTAHQPFWAPPTPRHSRCPPNHTVSSASLSLPSRHRLFLTYRHCRNFSILLEPSGCSKDTFLLLAIKSQPGHVERRAAIRSTWGRVGGWARGRQLKLVFLLGVAGSAPPAQLLAYESREFDDILQWDFTEDFFNLTLKELHLQRWVVAACPQAHFMLKGDDDVFVHVPNVLEFLDGWDPAQDLLVGDVIRQALPNRNTKVKYFIPPSMYRATHYPPYAGGGGYVMSRATVRRLQAIMEDAELFPIDDVFVGMCLRRLGLSPMHHAGFKTFGIRRPLDPLDPCLYRGLLLVHRLSPLEMWTMWALVTDEGLKCAAGPIPQR

SEQ ID NO: 95551 - protein, 353 aa, Homo sapiens; identical to SEQ ID NO: 95550
  Payload ID: 19058
  Gene Name: UDP-GlcNAc:betaGal beta-1,3-N-acetylglucosaminyltransferase 4
  Uniprot ID: Q9C0J1
  ENSP ID: ENSP00000444534

SEQ ID NO: 95552 - protein, 378 aa, Homo sapiens
  Payload ID: 19059
  Gene Name: UDP-GlcNAc:betaGal beta-1,3-N-acetylglucosaminyltransferase 5
  Uniprot ID: Q9BYG0
  ENSP ID: ENSP00000316173
MRMLVSGRRVKKWQLIIQLFATCFLASLMFFWEPIDNHIVSHMKSYSYRYLINSYDFVNDTLSLKHTSAGPRYQYLINHKEKCQAQDVLLLLFVKTAPENYDRRSGIRRTWGNENYVRSQLNANIKTLFALGTPNPLEGEELQRKLAWEDQRYNDIIQQDFVDSFYNLTLKLLMQFSWANTYCPHAKFLMTADDDIFIHMPNLIEYLQSLEQIGVQDFWIGRVHRGAPPIRDKSSKYYVSYEMYQWPAYPDYTAGAAYVISGDVAAKVYEASQTLNSSLYIDDVFMGLCANKIGIVPQDHVFFSGEGKTPYHPCIYEKMMTSHGHLEDLQDLWKNATDPKVKTISKGFFGQIYCRLMKIILLCKISYVDTYPCRAAFI

SEQ ID NO: 95553 - protein, 50 aa, Homo sapiens
  Payload ID: 19059
  Gene Name: UDP-GlcNAc:betaGal beta-1,3-N-acetylglucosaminyltransferase 5
  ENSP ID: ENSP00000417301
MRMLVSGRRVKKWQLIIQLFATCFLASLMFFWEPIDNHIVSHMKSYSYRY

SEQ ID NO: 95554 - protein, 378 aa, Homo sapiens; identical to SEQ ID NO: 95552
  Payload ID: 19059
  Gene Name: UDP-GlcNAc:betaGal beta-1,3-N-acetylglucosaminyltransferase 5
  Uniprot ID: Q9BYG0
  ENSP ID: ENSP00000417868

SEQ ID NO: 95555 - protein, 81 aa, Homo sapiens
  Payload ID: 19059
  Gene Name: UDP-GlcNAc:betaGal beta-1,3-N-acetylglucosaminyltransferase 5
  ENSP ID: ENSP00000418477
MRMLVSGRRVKKWQLIIQLFATCFLASLMFFWEPIDNHIVSHMKSYSYRYLINSYDFVNDTLSLKHTSAGPRYQYLINHKE

SEQ ID NO: 95556 - protein, 62 aa, Homo sapiens
  Payload ID: 19059
  Gene Name: UDP-GlcNAc:betaGal beta-1,3-N-acetylglucosaminyltransferase 5
  ENSP ID: ENSP00000418785
MRMLVSGRRVKKWQLIIQLFATCFLASLMFFWEPIDNHIVSHMKSYSYRYLINSYDFVNDTL

SEQ ID NO: 95557 - protein, 378 aa, Homo sapiens; identical to SEQ ID NO: 95552
  Payload ID: 19059
  Gene Name: UDP-GlcNAc:betaGal beta-1,3-N-acetylglucosaminyltransferase 5
  Uniprot ID: Q9BYG0
  ENSP ID: ENSP00000420778

SEQ ID NO: 95558 - protein, 121 aa, Homo sapiens
  Payload ID: 19060
  Gene Name: UDP-GlcNAc:betaGal beta-1,3-N-acetylglucosaminyltransferase 6
  ENSP ID: ENSP00000435628
MAFPCRRSLTAKTLACLLVGVSFLALQQWFLQAPRSPREERSPQEETPEGPTDAPAADEPPSELVPGPPCVANASANATADFEQLPARIQDFLRYRHCRHFPLLWDAPAKCAGGRGVFLLL

SEQ ID NO: 95559 - protein, 384 aa, Homo sapiens
  Payload ID: 19060
  Gene Name: UDP-GlcNAc:betaGal beta-1,3-N-acetylglucosaminyltransferase 6
  Uniprot ID: Q6ZMB0
  ENSP ID: ENSP00000484640
MAFPCRRSLTAKTLACLLVGVSFLALQQWFLQAPRSPREERSPQEETPEGPTDAPAADEPPSELVPGPPCVANASANATADFEQLPARIQDFLRYRHCRHFPLLWDAPAKCAGGRGVFLLLAVKSAPEHYERRELIRRTWGQERSYGGRPVRRLFLLGTPGPEDEARAERLAELVALEAREHGDVLQWAFADTFLNLTLKHLHLLDWLAARCPHARFLLSGDDDVFVHTANVVRFLQAQPPGRHLFSGQLMEGSVPIRDSWSKYFVPPQLFPGSAYPVYCSGGGFLLSGPTARALRAAARHTPLFPIDDAYMGMCLERAGLAPSGHEGIRPFGVQLPGAQQSSFDPCMYRELLLVHRFAPYEMLLMWKALHSPALSCDRGHRVS

SEQ ID NO: 95560 - protein, 401 aa, Homo sapiens
  Payload ID: 19061
  Gene Name: UDP-GlcNAc:betaGal beta-1,3-N-acetylglucosaminyltransferase 7
  Uniprot ID: Q8NFL0
  ENSP ID: ENSP00000287590
MSLWKKTVYRSLCLALALLVAVTVFQRSLTPGQFLQEPPPPTLEPQKAQKPNGQLVNPNNFWKNPKDVAAPTPMASQGPQAWDVTTTNCSANINLTHQPWFQVLEPQFRQFLFYRHCRYFPMLLNHPEKCRGDVYLLVVVKSVITQHDRREAIRQTWGRERQSAGGGRGAVRTLFLLGTASKQEERTHYQQLLAYEDRLYGDILQWGFLDTFFNLTLKEIHFLKWLDIYCPHVPFIFKGDDDVFVNPTNLLEFLADRQPQENLFVGDVLQHARPIRRKDNKYYIPGALYGKASYPPYAGGGGFLMAGSLARRLHHACDTLELYPIDDVFLGMCLEVLGVQPTAHEGFKTFGISRNRNSRMNKEPCFFRAMLVVHKLLPPELLAMWGLVHSNLTCSRKLQVL

SEQ ID NO: 95561 - protein, 397 aa, Homo sapiens
  Payload ID: 19062
  Gene Name: UDP-GlcNAc:betaGal beta-1,3-N-acetylglucosaminyltransferase 8
  Uniprot ID: Q7Z7M8
  ENSP ID: ENSP00000312700
MRCPKCLLCLSALLTLLGLKVYIEWTSESRLSKAYPSPRGTPPSPTPANPEPTLPANLSTRLGQTIPLPFAYWNQQQWRLGSLPSGDSTETGGCQAWGAAAATEIPDFASYPKDLRRFLLSAACRSFPQWLPGGGGSQVSSCSDTDVPYLLLAVKSEPGRFAERQAVRETWGSPAPGIRLLFLLGSPVGEAGPDLDSLVAWESRRYSDLLLWDFLDVPFNQTLKDLLLLAWLGRHCPTVSFVLRAQDDAFVHTPALLAHLRALPPASARSLYLGEVFTQAMPLRKPGGPFYVPESFFEGGYPAYASGGGYVIAGRLAPWLLRAAARVAPFPFEDVYTGLCIRALGLVPQAHPGFLTAWPADRTADHCAFRNLLLVRPLGPQASIRLWKQLQDPRLQC

SEQ ID NO: 95562 - protein, 402 aa, Homo sapiens
  Payload ID: 19063
  Gene Name: UDP-GlcNAc:betaGal beta-1,3-N-acetylglucosaminyltransferase 9
  Uniprot ID: Q6UX72
  ENSP ID: ENSP00000400157
MRRRLRLRRDALLTLLLGASLGLLLYAQRDGAAPTASAPRGRGRAAPRPTPGPRAFQLPDAGAAPPAYEGDTPAPPTPTGPFDFARYLRAKDQRRFPLLINQPHKCRGDGAPGGRPDLLIAVKSVAEDFERRQAVRQTWGAEGRVQGALVRRVFLLGVPRGAGSGGADEVGEGARTHWRALLRAESLAYADILLWAFDDTFFNLTLKEIHFLAWASAFCPDVRFVFKGDADVFVNVGNLLEFLAPRDPAQDLLAGDVIVHARPIRTRASKYYIPEAVYGLPAYPAYAGGGGFVLSGATLHRLAGACAQVELFPIDDVFLGMCLQRLRLTPEPHPAFRTFGIPQPSAAPHLSTFDPCFYRELVVVHGLSAADIWLMWRLLHGPHGPACAHPQPVAAGPFQWDS

SEQ ID NO: 95563 - protein, 361 aa, Homo sapiens
  Payload ID: 19064
  Gene Name: UDP-GlcNAc:betaGal beta-1,3-N-acetylglucosaminyltransferase-like 1
  Uniprot ID: Q67FW5
  ENSP ID: ENSP00000319979
MSGAGVGGASEESQAMQAHVSIILPVHNAEPWLDECLRSVLQQDFEGTMELSVFNDASKDKSGAIIEKWRVKLEDSGVHVIIGGHDSPSPRGVGYAKNQAVAQSSGSYLCFLDSDDVMMPQRVRLQHEAAVQHPSSIIGCRVRRDPPNSTERYTRWINQLTPEQLLTQVFTSNGPTVIMPTWFCSRAWFSHVGPFNEGGQGVPEDLLFFYEHLRKGGGVIRVDQSLLLYRHHPQAATHCVLETTIWTHRVRFLEEQALPRWAAFTIWNAGKQGRRLYRSLTAGSQRKVVAFCDVDENKIRKGFYCHEDSQERPKPRIPILHFRAARPPFVICVKLDLTGGAFEDNLRSLHLQEGQDFLHFS

SEQ ID NO: 95564 - protein, 53 aa, Homo sapiens
  Payload ID: 19064
  Gene Name: UDP-GlcNAc:betaGal beta-1,3-N-acetylglucosaminyltransferase-like 1
  ENSP ID: ENSP00000458682
MSGAGVGGASEESQAMQAHVSIILPVHNAEPWLDECLRSVLQQDFEGQVWGYH

SEQ ID NO: 95565 - protein, 183 aa, Homo sapiens
  Payload ID: 19064
  Gene Name: UDP-GlcNAc:betaGal beta-1,3-N-acetylglucosaminyltransferase-like 1
  ENSP ID: ENSP00000459327
MPTWFCSRAWFSHVGPFNEGGQGVPEDLLFFYEHLRKGGGVIRVDQSLLLYRHHPQAATHCVLETTIWTHRVRFLEEQALPRWAAFTIWNAGKQGRRLYRSLTAGSQRKVVAFCDVDENKIRKGFYCHEDSQERPKPRIPILHFRAARPPFVICVKLDLTGGAFEDNLRSLHLQEGQDFLHFS

SEQ ID NO: 95566 - protein, 250 aa, Homo sapiens
  Payload ID: 19064
  Gene Name: UDP-GlcNAc:betaGal beta-1,3-N-acetylglucosaminyltransferase-like 1
  ENSP ID: ENSP00000461127
MEQVQTGGLRTGSGFLTSTLHVIQEIIGCRVRRDPPNSTERYTRWINQLTPEQLLTQVFTSNGPTVIMPTWFCSRAWFSHVGPFNEGGQGVPEDLLFFYEHLRKGGGVIRVDQSLLLYRHHPQAATHCVLETTIWTHRVRFLEEQALPRWAAFTIWNAGKQGRRLYRSLTAGSQRKVVAFCDVDENKIRKGFYCHEDSQERPKPRIPILHFRAARPPFVICVKLDLTGGAFEDNLRSLHLQEGQDFLHFS

SEQ ID NO: 95567 - protein, 361 aa, Homo sapiens; identical to SEQ ID NO: 95563
  Payload ID: 19064
  Gene Name: UDP-GlcNAc:betaGal beta-1,3-N-acetylglucosaminyltransferase-like 1
  Uniprot ID: Q67FW5
  ENSP ID: ENSP00000480784

SEQ ID NO: 95568 - protein, 53 aa, Homo sapiens; identical to SEQ ID NO: 95564
  Payload ID: 19064
  Gene Name: UDP-GlcNAc:betaGal beta-1,3-N-acetylglucosaminyltransferase-like 1
  ENSP ID: ENSP00000487675

SEQ ID NO: 95569 - protein, 183 aa, Homo sapiens; identical to SEQ ID NO: 95565
  Payload ID: 19064
  Gene Name: UDP-GlcNAc:betaGal beta-1,3-N-acetylglucosaminyltransferase-like 1
  ENSP ID: ENSP00000487755

SEQ ID NO: 95570 - protein, 250 aa, Homo sapiens; identical to SEQ ID NO: 95566
  Payload ID: 19064
  Gene Name: UDP-GlcNAc:betaGal beta-1,3-N-acetylglucosaminyltransferase-like 1
  ENSP ID: ENSP00000488207

SEQ ID NO: 95571 - protein, 494 aa, Homo sapiens
  Payload ID: 19065
  Gene Name: UDP-glucose 6-dehydrogenase
  Uniprot ID: O60701
  ENSP ID: ENSP00000319501
MFEIKKICCIGAGYVGGPTCSVIAHMCPEIRVTVVDVNESRINAWNSPTLPIYEPGLKEVVESCRGKNLFFSTNIDDAIKEADLVFISVNTPTKTYGMGKGRAADLKYIEACARRIVQNSNGYKIVTEKSTVPVRAAESIRRIFDANTKPNLNLQVLSNPEFLAEGTAIKDLKNPDRVLIGGDETPEGQRAVQALCAVYEHWVPREKILTTNTWSSELSKLAANAFLAQRISSINSISALCEATGADVEEVATAIGMDQRIGNKFLKASVGFGGSCFQKDVLNLVYLCEALNLPEVARYWQQVIDMNDYQRRRFASRIIDSLFNTVTDKKIAILGFAFKKDTGDTRESSSIYISKYLMDEGAHLHIYDPKVPREQIVVDLSHPGVSEDDQVSRLVTISKDPYEACDGAHAVVICTEWDMFKELDYERIHKKMLKPAFIFDGRRVLDGLHNELQTIGFQIETIGKKVSSKRIPYAPSGEIPKFSLQDPPNKKPKV

SEQ ID NO: 95572 - protein, 494 aa, Homo sapiens; identical to SEQ ID NO: 95571
  Payload ID: 19065
  Gene Name: UDP-glucose 6-dehydrogenase
  Uniprot ID: O60701
  ENSP ID: ENSP00000421757

SEQ ID NO: 95573 - protein, 181 aa, Homo sapiens
  Payload ID: 19065
  Gene Name: UDP-glucose 6-dehydrogenase
  ENSP ID: ENSP00000421954
MWSSGLLIQDSTIMFEIKKICCIGAGYVGGPTCSVIAHMCPEIRVTVVDVNESRINAWNSPTLPIYEPGLKEVVESCRGKNLFFSTNIDDAIKEADLVFISVNTPTKTYGMGKGRAADLKYIEACARRIVQNSNGYKIVTEKSTVPVRAAESIRRIFDANTKPNLNLQVLSNPEFLAEGTA

SEQ ID NO: 95574 - protein, 84 aa, Homo sapiens
  Payload ID: 19065
  Gene Name: UDP-glucose 6-dehydrogenase
  ENSP ID: ENSP00000422565
MFEIKKICCIGAGYVGGPTCSVIAHMCPEIRVTVVDVNESRINAWNSPTLPIYEPGLKEVVESCRGKNLFFSTNIDDAIKEADL

SEQ ID NO: 95575 - protein, 130 aa, Homo sapiens
  Payload ID: 19065
  Gene Name: UDP-glucose 6-dehydrogenase
  ENSP ID: ENSP00000422603
MFEIKKICCIGAGYVGGPTCSVIAHMCPEIRVTVVDVNESRINAWNSPTLPIYEPGLKEVVESCRGKNLFFSTNIDDAIKEADLVFISVNTPTKTYGMGKGRAADLKYIEACARRIVQNSNGYKIVTEKS

SEQ ID NO: 95576 - protein, 427 aa, Homo sapiens
  Payload ID: 19065
  Gene Name: UDP-glucose 6-dehydrogenase
  Uniprot ID: O60701
  ENSP ID: ENSP00000422909
MFEIKKICCIGAGYVGGPTCSVIAHMCPEIRVTVVDVNESRINAWNSPTLPIYEPGLKEVVESCRGKNLFFSTNIDDAIKEADLVFISVLSNPEFLAEGTAIKDLKNPDRVLIGGDETPEGQRAVQALCAVYEHWVPREKILTTNTWSSELSKLAANAFLAQRISSINSISALCEATGADVEEVATAIGMDQRIGNKFLKASVGFGGSCFQKDVLNLVYLCEALNLPEVARYWQQVIDMNDYQRRRFASRIIDSLFNTVTDKKIAILGFAFKKDTGDTRESSSIYISKYLMDEGAHLHIYDPKVPREQIVVDLSHPGVSEDDQVSRLVTISKDPYEACDGAHAVVICTEWDMFKELDYERIHKKMLKPAFIFDGRRVLDGLHNELQTIGFQIETIGKKVSSKRIPYAPSGEIPKFSLQDPPNKKPKV

SEQ ID NO: 95577 - protein, 55 aa, Homo sapiens
  Payload ID: 19065
  Gene Name: UDP-glucose 6-dehydrogenase
  ENSP ID: ENSP00000424059
MFEIKKICCIGAGYVGGPTCSVIAHMCPEIRVTVVDVNESRINAWNSPTLPIYED

SEQ ID NO: 95578 - protein, 55 aa, Homo sapiens; identical to SEQ ID NO: 95577
  Payload ID: 19065
  Gene Name: UDP-glucose 6-dehydrogenase
  ENSP ID: ENSP00000424435

SEQ ID NO: 95579 - protein, 153 aa, Homo sapiens
  Payload ID: 19065
  Gene Name: UDP-glucose 6-dehydrogenase
  ENSP ID: ENSP00000425834
MFEIKKICCIGAGYVGGPTCSVIAHMCPEIRVTVVDVNESRINAWNSPTLPIYEPGLKEVVESCRGKNLFFSTNIDDAIKEADLVFISVNTPTKTYGMGKGRAADLKYIEACARRIVQNSNGYKIVTEKSTVPVRAAESIRRIFDANTKPNLN

SEQ ID NO: 95580 - protein, 397 aa, Homo sapiens
  Payload ID: 19065
  Gene Name: UDP-glucose 6-dehydrogenase
  Uniprot ID: O60701
  ENSP ID: ENSP00000426560
MGKGRAADLKYIEACARRIVQNSNGYKIVTEKSTVPVRAAESIRRIFDANTKPNLNLQVLSNPEFLAEGTAIKDLKNPDRVLIGGDETPEGQRAVQALCAVYEHWVPREKILTTNTWSSELSKLAANAFLAQRISSINSISALCEATGADVEEVATAIGMDQRIGNKFLKASVGFGGSCFQKDVLNLVYLCEALNLPEVARYWQQVIDMNDYQRRRFASRIIDSLFNTVTDKKIAILGFAFKKDTGDTRESSSIYISKYLMDEGAHLHIYDPKVPREQIVVDLSHPGVSEDDQVSRLVTISKDPYEACDGAHAVVICTEWDMFKELDYERIHKKMLKPAFIFDGRRVLDGLHNELQTIGFQIETIGKKVSSKRIPYAPSGEIPKFSLQDPPNKKPKV

SEQ ID NO: 95581 - protein, 53 aa, Homo sapiens
  Payload ID: 19065
  Gene Name: UDP-glucose 6-dehydrogenase
  ENSP ID: ENSP00000427708
MFEIKKICCIGAGYVGGPTCSVIAHMCPEIRVTVVDVNESRINAWNSPTLPIY

SEQ ID NO: 95582 - protein, 394 aa, Homo sapiens
  Payload ID: 19066
  Gene Name: UDP-glucose ceramide glucosyltransferase
  Uniprot ID: Q16739
  ENSP ID: ENSP00000363397
MALLDLALEGMAVFGFVLFLVLWLMHFMAIIYTRLHLNKKATDKQPYSKLPGVSLLKPLKGVDPNLINNLETFFELDYPKYEVLLCVQDHDDPAIDVCKKLLGKYPNVDARLFIGGKKVGINPKINNLMPGYEVAKYDLIWICDSGIRVIPDTLTDMVNQMTEKVGLVHGLPYVADRQGFAATLEQVYFGTSHPRYYISANVTGFKCVTGMSCLMRKDVLDQAGGLIAFAQYIAEDYFMAKAIADRGWRFAMSTQVAMQNSGSYSISQFQSRMIRWTKLRINMLPATIICEPISECFVASLIIGWAAHHVFRWDIMVFFMCHCLAWFIFDYIQLRGVQGGTLCFSKLDYAVAWFIRESMTIYIFLSALWDPTISWRTGRYRLRCGGTAEEILDV

SEQ ID NO: 95583 - protein, 1555 aa, Homo sapiens
  Payload ID: 19067
  Gene Name: UDP-glucose glycoprotein glucosyltransferase 1
  Uniprot ID: Q9NYU2
  ENSP ID: ENSP00000259253
MGCKGDASGACAAGALPVTGVCYKMGVLVVLTVLWLFSSVKADSKAITTSLTTKWFSTPLLLEASEFLAEDSQEKFWNFVEASQNIGSSDHDGTDYSYYHAILEAAFQFLSPLQQNLFKFCLSLRSYSATIQAFQQIAADEPPPEGCNSFFSVHGKKTCESDTLEALLLTASERPKPLLFKGDHRYPSSNPESPVVIFYSEIGSEEFSNFHRQLISKSNAGKINYVFRHYIFNPRKEPVYLSGYGVELAIKSTEYKAKDDTQVKGTEVNTTVIGENDPIDEVQGFLFGKLRDLHPDLEGQLKELRKHLVESTNEMAPLKVWQLQDLSFQTAARILASPVELALVVMKDLSQNFPTKARAITKTAVSSELRTEVEENQKYFKGTLGLQPGDSALFINGLHMDLDTQDIFSLFDVLRNEARVMEGLHRLGIEGLSLHNVLKLNIQPSEADYAVDIRSPAISWVNNLEVDSRYNSWPSSLQELLRPTFPGVIRQIRKNLHNMVFIVDPAHETTAELMNTAEMFLSNHIPLRIGFIFVVNDSEDVDGMQDAGVAVLRAYNYVAQEVDDYHAFQTLTHIYNKVRTGEKVKVEHVVSVLEKKYPYVEVNSILGIDSAYDRNRKEARGYYEQTGVGPLPVVLFNGMPFEREQLDPDELETITMHKILETTTFFQRAVYLGELPHDQDVVEYIMNQPNVVPRINSRILTAERDYLDLTASNNFFVDDYARFTILDSQGKTAAVANSMNYLTKKGMSSKEIYDDSFIRPVTFWIVGDFDSPSGRQLLYDAIKHQKSSNNVRISMINNPAKEISYENTQISRAIWAALQTQTSNAAKNFITKMAKEGAAEALAAGADIAEFSVGGMDFSLFKEVFESSKMDFILSHAVYCRDVLKLKKGQRAVISNGRIIGPLEDSELFNQDDFHLLENIILKTSGQKIKSHIQQLRVEEDVASDLVMKVDALLSAQPKGDPRIEYQFFEDRHSAIKLRPKEGETYFDVVAVVDPVTREAQRLAPLLLVLAQLINMNLRVFMNCQSKLSDMPLKSFYRYVLEPEISFTSDNSFAKGPIAKFLDMPQSPLFTLNLNTPESWMVESVRTPYDLDNIYLEEVDSVVAAEYELEYLLLEGHCYDITTGQPPRGLQFTLGTSANPVIVDTIVMANLGYFQLKANPGAWILRLRKGRSEDIYRIYSHDGTDSPPDADEVVIVLNNFKSKIIKVKVQKKADMVNEDLLSDGTSENESGFWDSFKWGFTGQKTEEVKQDKDDIINIFSVASGHLYERFLRIMMLSVLKNTKTPVKFWFLKNYLSPTFKEFIPYMANEYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKRAKTIDLCNNPMTKEPKLEAAVRIVPEWQDYDQEIKQLQIRFQKEKETGALYKEKTKEPSREGPQKREEL

SEQ ID NO: 95584 - protein, 46 aa, Homo sapiens
  Payload ID: 19067
  Gene Name: UDP-glucose glycoprotein glucosyltransferase 1
  ENSP ID: ENSP00000365913
MGCKGDASGACAAGALPVTGTQGWREEASWTKRGFGAQGDPVPLSH

SEQ ID NO: 95585 - protein, 131 aa, Homo sapiens
  Payload ID: 19067
  Gene Name: UDP-glucose glycoprotein glucosyltransferase 1
  ENSP ID: ENSP00000389441
  MOD_RES (1)..(1): Any amino acid
XIMMLSVLKNTKTPVKFWFLKNYLSPTFKDLPNNMIHQVPIKSLPQEWLWCETWCDDASKKRAKTIDLCNNPMTKEPKLEAAVRIVPEWQDYDQEIKQLQIRFQKEKETGALYKEKTKEPSREGPQKREEL

SEQ ID NO: 95586 - protein, 54 aa, Homo sapiens
  Payload ID: 19067
  Gene Name: UDP-glucose glycoprotein glucosyltransferase 1
  ENSP ID: ENSP00000392701
MGCKGDASGVCYKMGVLVVLTVLWLFSSVKADSKAITTSLTTKWFSTPLLLEAR

SEQ ID NO: 95587 - protein, 58 aa, Homo sapiens
  Payload ID: 19067
  Gene Name: UDP-glucose glycoprotein glucosyltransferase 1
  ENSP ID: ENSP00000400426
MGCKGDASGVCYKMGVLVVLTVLWLFSSVKADSKAITTSLTTKWFSTPLLLEASCGVE

SEQ ID NO: 95588 - protein, 280 aa, Homo sapiens
  Payload ID: 19068
  Gene Name: UDP-glucose glycoprotein glucosyltransferase 2
  ENSP ID: ENSP00000365902
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKLVY

SEQ ID NO: 95589 - protein, 278 aa, Homo sapiens
  Payload ID: 19068
  Gene Name: UDP-glucose glycoprotein glucosyltransferase 2
  Uniprot ID: Q9NYU1
  ENSP ID: ENSP00000365904
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKS

SEQ ID NO: 95590 - protein, 1516 aa, Homo sapiens
  Payload ID: 19068
  Gene Name: UDP-glucose glycoprotein glucosyltransferase 2
  Uniprot ID: Q9NYU1
  ENSP ID: ENSP00000365938
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKEIYSDLRDNLTAFQKYLIESNKQMMPLKVWELQDLSFQAASQIMSAPVYDSIKLMKDISQNFPIKARSLTRIAVNQHMREEIKENQKDLQVRFKIQPGDARLFINGLRVDMDVYDAFSILDMLKLEGKMMNGLRNLGINGEDMSKFLKLNSHIWEYTYVLDIRHSSIMWINDLENDDLYITWPTSCQKLLKPVFPGSVPSIRRNFHNLVLFIDPAQEYTLDFIKLADVFYSHEVPLRIGFVFILNTDDEVDGANDAGVALWRAFNYIAEEFDISEAFISIVHMYQKVKKDQNILTVDNVKSVLQNTFPHANIWDILGIHSKYDEERKAGASFYKMTGLGPLPQALYNGEPFKHEEMNIKELKMAVLQRMMDASVYLQREVFLGTLNDRTNAIDFLMDRNNVVPRINTLILRTNQQYLNLISTSVTADVEDFSTFFFLDSQDKSAVIAKNMYYLTQDDESIISAVTLWIIADFDKPSGRKLLFNALKHMKTSVHSRLGIIYNPTSKINEENTAISRGILAAFLTQKNMFLRSFLGQLAKEEIATAIYSGDKIKTFLIEGMDKNAFEKKYNTVGVNIFRTHQLFCQDVLKLRPGEMGIVSNGRFLGPLDEDFYAEDFYLLEKITFSNLGEKIKGIVENMGINANNMSDFIMKVDALMSSVPKRASRYDVTFLRENHSVIKTNPQENDMFFNVIAIVDPLTREAQKMAQLLVVLGKIINMKIKLFMNCRGRLSEAPLESFYRFVLEPELMSGANDVSSLGPVAKFLDIPESPLLILNMITPEGWLVETVHSNCDLDNIHLKDTEKTVTAEYELEYLLLEGQCFDKVTEQPPRGLQFTLGTKNKPAVVDTIVMAHHGYFQLKANPGAWILRLHQGKSEDIYQIVGHEGTDSQADLEDIIVVLNSFKSKILKVKVKKETDKIKEDILTDEDEKTKGLWDSIKSFTVSLHKENKKEKDVLNIFSVASGHLYERFLRIMMLSVLRNTKTPVKFWLLKNYLSPTFKEVIPHMAKEYGFRYELVQYRWPRWLRQQTERQRIIWGYKILFLDVLFPLAVDKIIFVDADQIVRHDLKELRDFDLDGAPYGYTPFCDSRREMDGYRFWKTGYWASHLLRRKYHISALYVVDLKKFRRIGAGDRLRSQYQALSQDPNSLSNLDQDLPNNMIYQVAIKSLPQDWLWCETWCDDESKQRAKTIDLCNNPKTKESKLKAAARIVPEWVEYDAEIRQLLDHLENKKQDTILTHDEL

SEQ ID NO: 95591 - protein, 372 aa, Homo sapiens
  Payload ID: 19068
  Gene Name: UDP-glucose glycoprotein glucosyltransferase 2
  ENSP ID: ENSP00000380743
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKEIYSDLRDNLTAFQKYLIESNKQMMPLKVWELQDLSFQAASQIMSAPVYDSIKLMKDISQNFPIKARLRMNILICLFQSTLNVKNLRSRHLYNKT

SEQ ID NO: 95592 - protein, 261 aa, Homo sapiens [sequence omitted]

SEQ ID NO: 95593 - protein, 508 aa, Homo sapiens
  Payload ID: 19069
  Gene Name: UDP-glucose pyrophosphorylase 2
  Uniprot ID: Q16851
  ENSP ID: ENSP00000338703
MSRFVQDLSKAMSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 95594 - protein, 497 aa, Homo sapiens
  Payload ID: 19069
  Gene Name: UDP-glucose pyrophosphorylase 2
  Uniprot ID: Q16851
  ENSP ID: ENSP00000377939
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 95595 - protein, 517 aa, Homo sapiens
  Payload ID: 19069
  Gene Name: UDP-glucose pyrophosphorylase 2
  ENSP ID: ENSP00000411803
MLLYPAGFSFASLKSDLSKAMSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 95596 - protein, 38 aa, Homo sapiens
  Payload ID: 19069
  Gene Name: UDP-glucose pyrophosphorylase 2
  ENSP ID: ENSP00000417286
MSQDGASQFQEVIRQELELSVKKELEKILTTASSHEFE

SEQ ID NO: 95597 - protein, 52 aa, Homo sapiens
  Payload ID: 19069
  Gene Name: UDP-glucose pyrophosphorylase 2
  ENSP ID: ENSP00000417358
MSQDGASQFQEVIRQELELSVKKELEKILTTASSHEFETPGFAILPRLVSNS

SEQ ID NO: 95598 - protein, 48 aa, Homo sapiens
  Payload ID: 19069
  Gene Name: UDP-glucose pyrophosphorylase 2
  ENSP ID: ENSP00000417801
MSQDGASQFQEVIRQELELSVKKELEKILTTASSHEFERVTSDRTMLL

SEQ ID NO: 95599 - protein, 76 aa, Homo sapiens
  Payload ID: 19069
  Gene Name: UDP-glucose pyrophosphorylase 2
  ENSP ID: ENSP00000418179
MSQDGASQFQEVIRQELELSVKKELEKILTTASSHEFEHTKKDLDGFRKLFHRFLQEKGPSVDWGKIQRPPEDSAG

SEQ ID NO: 95600 - protein, 48 aa, Homo sapiens; identical to SEQ ID NO: 95598
  Payload ID: 19069
  Gene Name: UDP-glucose pyrophosphorylase 2
  ENSP ID: ENSP00000418206

SEQ ID NO: 95601 - protein, 49 aa, Homo sapiens
  Payload ID: 19069
  Gene Name: UDP-glucose pyrophosphorylase 2
  ENSP ID: ENSP00000418375
MSRFVQDLSKAMSQDGASQFQEVIRQELELSVKKELEKILTTASSHEFE

SEQ ID NO: 95602 - protein, 52 aa, Homo sapiens; identical to SEQ ID NO: 95597
  Payload ID: 19069
  Gene Name: UDP-glucose pyrophosphorylase 2
  ENSP ID: ENSP00000418619

SEQ ID NO: 95603 - protein, 29 aa, Homo sapiens
  Payload ID: 19069
  Gene Name: UDP-glucose pyrophosphorylase 2
  ENSP ID: ENSP00000418642
SFASLKSGTCACTQTGRAGEAGGLRKAGS

SEQ ID NO: 95604 - protein, 76 aa, Homo sapiens; identical to SEQ ID NO: 95599
  Payload ID: 19069
  Gene Name: UDP-glucose pyrophosphorylase 2
  ENSP ID: ENSP00000419019

SEQ ID NO: 95605 - protein, 150 aa, Homo sapiens
  Payload ID: 19069
  Gene Name: UDP-glucose pyrophosphorylase 2
  ENSP ID: ENSP00000419238
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVL

SEQ ID NO: 95606 - protein, 170 aa, Homo sapiens
  Payload ID: 19069
  Gene Name: UDP-glucose pyrophosphorylase 2
  ENSP ID: ENSP00000419335
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHC

SEQ ID NO: 95607 - protein, 135 aa, Homo sapiens
  Payload ID: 19069
  Gene Name: UDP-glucose pyrophosphorylase 2
  ENSP ID: ENSP00000419442
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQI

SEQ ID NO: 95608 - protein, 104 aa, Homo sapiens
  Payload ID: 19069
  Gene Name: UDP-glucose pyrophosphorylase 2
  ENSP ID: ENSP00000419548
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNG

SEQ ID NO: 95609 - protein, 52 aa, Homo sapiens; identical to SEQ ID NO: 95597
  Payload ID: 19069
  Gene Name: UDP-glucose pyrophosphorylase 2
  ENSP ID: ENSP00000419551

SEQ ID NO: 95610 - protein, 175 aa, Homo sapiens
  Payload ID: 19069
  Gene Name: UDP-glucose pyrophosphorylase 2
  ENSP ID: ENSP00000420131
MSRFVQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRV

SEQ ID NO: 95611 - protein, 212 aa, Homo sapiens
  Payload ID: 19069
  Gene Name: UDP-glucose pyrophosphorylase 2
  ENSP ID: ENSP00000420342
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGH

SEQ ID NO: 95612 - protein, 37 aa, Homo sapiens
  Payload ID: 19069
  Gene Name: UDP-glucose pyrophosphorylase 2
  ENSP ID: ENSP00000420760
MLLYPAGFSFASLKSGTCACTQTGRAGEAGGLRKAGS

SEQ ID NO: 95613 - protein, 497 aa, Homo sapiens; identical to SEQ ID NO: 95594
  Payload ID: 19069
  Gene Name: UDP-glucose pyrophosphorylase 2
  Uniprot ID: Q16851
  ENSP ID: ENSP00000420793

SEQ ID NO: 95614 - protein, 508 aa, Homo sapiens [sequence omitted]

SEQ ID NO: 95615 - protein, 48 aa, Homo sapiens; identical to SEQ ID NO: 95598
  Payload ID: 19069
  Gene Name: UDP-glucose pyrophosphorylase 2
  ENSP ID: ENSP00000486008

SEQ ID NO: 95616 - protein, 52 aa, Homo sapiens; identical to SEQ ID NO: 95597
  Payload ID: 19069
  Gene Name: UDP-glucose pyrophosphorylase 2
  ENSP ID: ENSP00000486332

SEQ ID NO: 95617 - protein, 425 aa, Homo sapiens
  Payload ID: 19070
  Gene Name: UDP-glucuronate decarboxylase 1
  Uniprot ID: Q8NBZ7
  ENSP ID: ENSP00000283148
MVSKALLRLVSAVNRRRMKLLLGIALLAYVASVWGNFVNMSFLLNRSIQENGELKIESKIEEMVEPLREKIRDLEKSFTQKYPPVKFLSEKDRKRILITGGAGFVGSHLTDKLMMDGHEVTVVDNFFTGRKRNVEHWIGHENFELINHDVVEPLYIEVDQIYHLASPASPPNYMYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLGNPEEHTILEFAQLIKNLVGSGSEIQFLSEAQDDPQKRKPDIKKAKLMLGWEPVVPLEEGLNKAIHYFRKELEYQANNQYIPKPKPARIKKGRTRHS

SEQ ID NO: 95618 - protein, 420 aa, Homo sapiens
  Payload ID: 19070
  Gene Name: UDP-glucuronate decarboxylase 1
  Uniprot ID: Q8NBZ7
  ENSP ID: ENSP00000387019
MVSKALLRLVSAVNRRRMKLLLGIALLAYVASVWGNFVNMRSIQENGELKIESKIEEMVEPLREKIRDLEKSFTQKYPPVKFLSEKDRKRILITGGAGFVGSHLTDKLMMDGHEVTVVDNFFTGRKRNVEHWIGHENFELINHDVVEPLYIEVDQIYHLASPASPPNYMYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLGNPEEHTILEFAQLIKNLVGSGSEIQFLSEAQDDPQKRKPDIKKAKLMLGWEPVVPLEEGLNKAIHYFRKELEYQANNQYIPKPKPARIKKGRTRHS

SEQ ID NO: 95619 - protein, 252 aa, Homo sapiens
  Payload ID: 19070
  Gene Name: UDP-glucuronate decarboxylase 1
  Uniprot ID: Q8NBZ7
  ENSP ID: ENSP00000387096
MYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLGNPEEHTILEFAQLIKNLVGSGSEIQFLSEAQDDPQKRKPDIKKAKLMLGWEPVVPLEEGLNKAIHYFRKELEYQANNQYIPKPKPARIKKGRTRHS

SEQ ID NO: 95620 - protein, 52 aa, Homo sapiens
  Payload ID: 19070
  Gene Name: UDP-glucuronate decarboxylase 1
  ENSP ID: ENSP00000397049
MYNPIKTLKTNTIGTLNMLGLAKRVGARLLLASTSEVYGDPEVHPQSEDYWG

SEQ ID NO: 95621 - protein, 190 aa, Homo sapiens
  Payload ID: 19070
  Gene Name: UDP-glucuronate decarboxylase 1
  ENSP ID: ENSP00000399316
MVEPLREKIRDLEKSFTQKYPPVKFLSEKDRKRILITGGAGFVGSHLTDKLMMDGHEVTVVDNFFTGRKRNVEHWIGHENFELINHDVVEPLYIEVDQIYHLASPASPPNYMYNPIKTLKTNTIGTLNMLGLAKRVGARLLLASTSEVYGDPEVHPQSEDYWGHVNPIGPRACYDEGKRVAETMCYAYMK

SEQ ID NO: 95622 - protein, 134 aa, Homo sapiens
  Payload ID: 19070
  Gene Name: UDP-glucuronate decarboxylase 1
  ENSP ID: ENSP00000403612
MYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYV

SEQ ID NO: 95623 - protein, 121 aa, Homo sapiens
  Payload ID: 19070
  Gene Name: UDP-glucuronate decarboxylase 1
  ENSP ID: ENSP00000404468
MYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTV

SEQ ID NO: 95624 - protein, 170 aa, Homo sapiens
  Payload ID: 19070
  Gene Name: UDP-glucuronate decarboxylase 1
  ENSP ID: ENSP00000416656
MVSKALLRLVSAVNRRRMKLLLGIALLAYVAWLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLVSA

SEQ ID NO: 95625 - protein, 522 aa, Homo sapiens
  Payload ID: 19071
  Gene Name: UDP-N-acetylglucosamine pyrophosphorylase 1
  Uniprot ID: Q16222
  ENSP ID: ENSP00000271469
MNINDLKLTLSKAGQEHLLRFWNELEEAQQVELYAELQAMNFEELNFFFQKAIEGFNQSSHQKNVDARMEPVPREVLGSATRDQDQLQAWESEGLFQISQNKVAVLLLAGGQGTRLGVAYPKGMYDVGLPSRKTLFQIQAERILKLQQVAEKYYGNKCIIPWYIMTSGRTMESTKEFFTKHKYFGLKKENVIFFQQGMLPAMSFDGKIILEEKNKVSMAPDGNGGLYRALAAQNIVEDMEQRGIWSIHVYCVDNILVKVADPRFIGFCIQKGADCGAKVVEKTNPTEPVGVVCRVDGVYQVVEYSEISLATAQKRSSDGRLLFNAGNIANHFFTVPFLRDVVNVYEPQLQHHVAQKKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRSATNGKSETITADVNHNLKDANDVPIQCEISPLISYAGEGLESYVADKEFHAPLIIDENGVHELVKNGI

SEQ ID NO: 95626 - protein, 521 aa, Homo sapiens
  Payload ID: 19071
  Gene Name: UDP-N-acetylglucosamine pyrophosphorylase 1
  Uniprot ID: Q16222
  ENSP ID: ENSP00000356901
MNINDLKLTLSKAGQEHLLRFWNELEEAQQVELYAELQAMNFEELNFFFQKAIEGFNQSSHQKNVDARMEPVPREVLGSATRDQDQLQAWESEGLFQISQNKVAVLLLAGGQGTRLGVAYPKGMYDVGLPSRKTLFQIQAERILKLQQVAEKYYGNKCIIPWYIMTSGRTMESTKEFFTKHKYFGLKKENVIFFQQGMLPAMSFDGKIILEEKNKVSMAPDGNGGLYRALAAQNIVEDMEQRGIWSIHVYCVDNILVKVADPRFIGFCIQKGADCGAKVVEKTNPTEPVGVVCRVDGVYQVVEYSEISLATAQKRSSDGRLLFNAGNIANHFFTVPFLRDVVNVYEPQLQHHVAQKKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRATNGKSETITADVNHNLKDANDVPIQCEISPLISYAGEGLESYVADKEFHAPLIIDENGVHELVKNGI

SEQ ID NO: 95627 - protein, 522 aa, Homo sapiens; identical to SEQ ID NO: 95625
  Payload ID: 19071
  Gene Name: UDP-N-acetylglucosamine pyrophosphorylase 1
  Uniprot ID: Q16222
  ENSP ID: ENSP00000356902

SEQ ID NO: 95628 - protein, 505 aa, Homo sapiens
  Payload ID: 19071
  Gene Name: UDP-N-acetylglucosamine pyrophosphorylase 1
  Uniprot ID: Q16222
  ENSP ID: ENSP00000356903
MNINDLKLTLSKAGQEHLLRFWNELEEAQQVELYAELQAMNFEELNFFFQKAIEGFNQSSHQKNVDARMEPVPREVLGSATRDQDQLQAWESEGLFQISQNKVAVLLLAGGQGTRLGVAYPKGMYDVGLPSRKTLFQIQAERILKLQQVAEKYYGNKCIIPWYIMTSGRTMESTKEFFTKHKYFGLKKENVIFFQQGMLPAMSFDGKIILEEKNKVSMAPDGNGGLYRALAAQNIVEDMEQRGIWSIHVYCVDNILVKVADPRFIGFCIQKGADCGAKVVEKTNPTEPVGVVCRVDGVYQVVEYSEISLATAQKRSSDGRLLFNAGNIANHFFTVPFLRDVVNVYEPQLQHHVAQKKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRLKDANDVPIQCEISPLISYAGEGLESYVADKEFHAPLIIDENGVHELVKNGI

SEQ ID NO: 95629 - protein, 384 aa, Homo sapiens
  Payload ID: 19072
  Gene Name: UDP-N-acetylglucosamine pyrophosphorylase 1 like 1
  Uniprot ID: Q3KQV9
  ENSP ID: ENSP00000353409
MGPGPSPNWTLDPEPRCRLWSEPRLPAGPGVLAAGSPRLPCRYVMTSEFTLGPTAEFFREHNFFHLDPANVVMFEQRLLPAVTFDGKVILERKDKVAMAPDGNGGLYCALEDHKILEDMERRGVEFVHVYCVDNILVRLADPVFIGFCVLQGADCGAKVVEKAYPEEPVGVVCQVDGVPQVVEYSEISPETAQLRASDGSLLYNAGNICNHFFTRGFLKAVTREFEPLLKPHVAVKKVPYVDEEGNLVKPLKPNGIKMEKFVFDVFRFAKNFAALEVLREEEFSPLKNAEPADRDSPRTARQALLTQHYRWALRAGARFLDAHGAWLPELPSLPPNGDPPAICEISPLVSYSGEGLEVYLQGREFQSPLILDEDQAREPQLQES

SEQ ID NO: 95630 - protein, 507 aa, Homo sapiens
  Payload ID: 19072
  Gene Name: UDP-N-acetylglucosamine pyrophosphorylase 1 like 1
  Uniprot ID: Q3KQV9
  ENSP ID: ENSP00000386935
MASEQDVRARLQRAGQEHLLRFWAELAPEPRAALLAELALLEPEALREHCRRAAEACARPHGPPPDLAARLRPLPPERVGRASRSDPETRRRWEEEGFRQISLNKVAVLLLAGGQGTRLGVTYPKGMYRVGLPSRKTLYQLQAERIRRVEQLAGERHGTRCTVPWYVMTSEFTLGPTAEFFREHNFFHLDPANVVMFEQRLLPAVTFDGKVILERKDKVAMAPDGNGGLYCALEDHKILEDMERRGVEFVHVYCVDNILVRLADPVFIGFCVLQGADCGAKVVEKAYPEEPVGVVCQVDGVPQVVEYSEISPETAQLRASDGSLLYNAGNICNHFFTRGFLKAVTREFEPLLKPHVAVKKVPYVDEEGNLVKPLKPNGIKMEKFVFDVFRFAKNFAALEVLREEEFSPLKNAEPADRDSPRTARQALLTQHYRWALRAGARFLDAHGAWLPELPSLPPNGDPPAICEISPLVSYSGEGLEVYLQGREFQSPLILDEDQAREPQLQES

SEQ ID NO: 95631 - protein, 99 aa, Homo sapiens
  Payload ID: 19072
  Gene Name: UDP-N-acetylglucosamine pyrophosphorylase 1 like 1
  ENSP ID: ENSP00000484649
MASEQDVRARLQRAGQEHLLRFWAELAPEPRAALLAELALLEPEALREHCRRAAEACARPHGPPPDLAARLRPLPPERVGRASRSDPETRRRWEEEGTS

SEQ ID NO: 95632 - protein, 215 aa, Homo sapiens
  Payload ID: 19073
  Gene Name: UEV and lactate/malate dehyrogenase domains
  Uniprot ID: Q8IX04
  ENSP ID: ENSP00000300038
MEFDCEGLRRLLGKYKFRDLTVEELRNVNVFFPHFKYSMDTYVFKDSSQKDLLNFTGTIPVMYQGNTYNIPIRFWILDSHPFAPPICFLKPTANMGILVGKHVDAQGRIYLPYLQNWSHPKSVIVGLIKEMIAKFQEELPMYSLSSSDEARQVDLLAYIAKITEGVSDTNSKSWANHENKTVNKITVVGGGELGIACTLAISAKVESRSVTQAGV

SEQ ID NO: 95633 - protein, 357 aa, Homo sapiens
  Payload ID: 19073
  Gene Name: UEV and lactate/malate dehyrogenase domains
  Uniprot ID: Q8IX04
  ENSP ID: ENSP00000323353
MEFDCEGLRRLLGKYKFRDLTVEELRNVNVFFPHFKYSMDTYGNTYNIPIRFWILDSHPFAPPICFLKPTANMGILVGKHVDAQGRIYLPYLQNWSHPKSVIVGLIKEMIAKFQEELPMYSLSSSDEARQVDLLAYIAKITEGVSDTNSKSWANHENKTVNKITVVGGGELGIACTLAISAKGIADRLVLLDLSEGTKGATMDLEIFNLPNVEISKDLSASAHSKVVIFTVNSLGSSQSYLDVVQSNVDMFRALVPALGHYSQHSVLLVASQPVEIMTYVTWKLSTFPANRVIGIGCNLDSQRLQYIITNVLKAQTSGKEVWVIGEQGEDKVLTWSGQEEVVSHTSQVQLSNRDIMI

SEQ ID NO: 95634 - protein, 449 aa, Homo sapiens
  Payload ID: 19073
  Gene Name: UEV and lactate/malate dehyrogenase domains
  Uniprot ID: Q8IX04
  ENSP ID: ENSP00000368697
MEFDCEGLRRLLGKYKFRDLTVEELRNVNVFFPHFKYSMDTYGNTYNIPIRFWILDSHPFAPPICFLKPTANMGILVGKHVDAQGRIYLPYLQNWSHPKSVIVGLIKEMIAKFQEELPMYSLSSSDEARQVDLLAYIAKITEGVSDTNSKSWANHENKTVNKITVVGGGELGIACTLAISAKGIADRLVLLDLSEGTKGATMDLEIFNLPNVEISKDLSASAHSKVVIFTVNSLGSSQSYLDVVQSNVDMFRALVPALGHYSQHSVLLVASQPVEIMTYVTWKLSTFPANRVIGIGCNLDSQRLQYIITNVLKAQTSGKEVWVIGEQGEDKVLTWSGQEEVVSHTSQVQLSNRAMELLRVKGQRSWSVGLSVADMVDSIVNNKKKVHSVSALAKGYYDINSEVFLSLPCILGTNGVSEVIKTTLKEDTVTEKLQSSASSIHSLQQQLKL

SEQ ID NO: 95635 - protein, 65 aa, Homo sapiens
  Payload ID: 19073
  Gene Name: UEV and lactate/malate dehyrogenase domains
  ENSP ID: ENSP00000379499
MEFDCEGLRRLLGKYKFRDLTVEELRNVNVFFPHFKYSMDTYVFKDSSQKDLLNFTGTIPVMYQA

SEQ ID NO: 95636 - protein, 471 aa, Homo sapiens
  Payload ID: 19073
  Gene Name: UEV and lactate/malate dehyrogenase domains
  Uniprot ID: Q8IX04
  ENSP ID: ENSP00000379500
MEFDCEGLRRLLGKYKFRDLTVEELRNVNVFFPHFKYSMDTYVFKDSSQKDLLNFTGTIPVMYQGNTYNIPIRFWILDSHPFAPPICFLKPTANMGILVGKHVDAQGRIYLPYLQNWSHPKSVIVGLIKEMIAKFQEELPMYSLSSSDEARQVDLLAYIAKITEGVSDTNSKSWANHENKTVNKITVVGGGELGIACTLAISAKGIADRLVLLDLSEGTKGATMDLEIFNLPNVEISKDLSASAHSKVVIFTVNSLGSSQSYLDVVQSNVDMFRALVPALGHYSQHSVLLVASQPVEIMTYVTWKLSTFPANRVIGIGCNLDSQRLQYIITNVLKAQTSGKEVWVIGEQGEDKVLTWSGQEEVVSHTSQVQLSNRAMELLRVKGQRSWSVGLSVADMVDSIVNNKKKVHSVSALAKGYYDINSEVFLSLPCILGTNGVSEVIKTTLKEDTVTEKLQSSASSIHSLQQQLKL

SEQ ID NO: 95637 - protein, 199 aa, Homo sapiens
  Payload ID: 19073
  Gene Name: UEV and lactate/malate dehyrogenase domains
  Uniprot ID: Q8IX04
  ENSP ID: ENSP00000437538
MEFDCEGLRRLLGKYKFRDLTVEELRNVNVFFPHFKYSMDTYVFKDSSQKDLLNFTGTIPVMYQGVSDTNSKSWANHENKTVNKITVVGGGELGIACTLAISAKGIADRLVLLDLSEGTKGATMDLEIFNLPNVEISKVEIMTYVTWKLSTFPANRVIGIGCNLDSQRLQYIITNVLKAQTSGKEVWVIGEQGEDKGIL

SEQ ID NO: 95638 - protein, 341 aa, Homo sapiens
  Payload ID: 19073
  Gene Name: UEV and lactate/malate dehyrogenase domains
  Uniprot ID: Q8IX04
  ENSP ID: ENSP00000441092
MDTYVFKDSSQKDLLNFTGTIPVMYQGNTYNIPIRFWILDSHPFAPPICFLKPTANMGILVGKHVDAQGRIYLPYLQNWSHPKSVIVGLIKEMIAKFQEELPMYSLSSSDEARQVDLLAYIAKITEGVSDTNSKSWANHENKTVNKITVVGGGELGIACTLAISAKGIADRLVLLDLSEGTKGATMDLEIFNLPNVEISKDLSASAHSKVVIFTVNSLGSSQSYLDVVQSNVDMFRALVPALGHYSQHSVLLVASQPVEIMTYVTWKLSTFPANRVIGIGCNLDSQRLQYIITNVLKAQTSGKEVWVIGEQGEDKVLTWSGQEEVVSHTSQVQLSNRDIMI

SEQ ID NO: 95639 - protein, 379 aa, Homo sapiens
  Payload ID: 19073
  Gene Name: UEV and lactate/malate dehyrogenase domains
  Uniprot ID: Q8IX04
  ENSP ID: ENSP00000442974
MEFDCEGLRRLLGKYKFRDLTVEELRNVNVFFPHFKYSMDTYVFKDSSQKDLLNFTGTIPVMYQGNTYNIPIRFWILDSHPFAPPICFLKPTANMGILVGKHVDAQGRIYLPYLQNWSHPKSVIVGLIKEMIAKFQEELPMYSLSSSDEARQVDLLAYIAKITEGVSDTNSKSWANHENKTVNKITVVGGGELGIACTLAISAKGIADRLVLLDLSEGTKGATMDLEIFNLPNVEISKDLSASAHSKVVIFTVNSLGSSQSYLDVVQSNVDMFRALVPALGHYSQHSVLLVASQPVEIMTYVTWKLSTFPANRVIGIGCNLDSQRLQYIITNVLKAQTSGKEVWVIGEQGEDKVLTWSGQEEVVSHTSQVQLSNRDIMI

SEQ ID NO: 95640 - protein, 794 aa, Homo sapiens
  Payload ID: 19074
  Gene Name: UFM1-specific ligase 1
  Uniprot ID: O94874
  ENSP ID: ENSP00000358283
MADAWEEIRRLAADFQRAQFAEATQRLSERNCIEIVNKLIAQKQLEVVHTLDGKEYITPAQISKEMRDELHVRGGRVNIVDLQQVINVDLIHIENRIGDIIKSEKHVQLVLGQLIDENYLDRLAEEVNDKLQESGQVTISELCKTYDLPGNFLTQALTQRLGRIISGHIDLDNRGVIFTEAFVARHKARIRGLFSAITRPTAVNSLISKYGFQEQLLYSVLEELVNSGRLRGTVVGGRQDKAVFVPDIYSRTQSTWVDSFFRQNGYLEFDALSRLGIPDAVSYIKKRYKTTQLLFLKAACVGQGLVDQVEASVEEAISSGTWVDIAPLLPTSLSVEDAAILLQQVMRAFSKQASTVVFSDTVVVSEKFINDCTELFRELMHQKAEKEMKNNPVHLITEEDLKQISTLESVSTSKKDKKDERRRKATEGSGSMRGGGGGNAREYKIKKVKKKGRKDDDSDDESQSSHTGKKKPEISFMFQDEIEDFLRKHIQDAPEEFISELAEYLIKPLNKTYLEVVRSVFMSSTTSASGTGRKRTIKDLQEEVSNLYNNIRLFEKGMKFFADDTQAALTKHLLKSVCTDITNLIFNFLASDLMMAVDDPAAITSEIRKKILSKLSEETKVALTKLHNSLNEKSIEDFISCLDSAAEACDIMVKRGDKKRERQILFQHRQALAEQLKVTEDPALILHLTSVLLFQFSTHSMLHAPGRCVPQIIAFLNSKIPEDQHALLVKYQGLVVKQLVSQSKKTGQGDYPLNNELDKEQEDVASTTRKELQELSSSIKDLVLKSRKSSVTEE

SEQ ID NO: 95641 - protein, 142 aa, Homo sapiens
  Payload ID: 19075
  Gene Name: UFM1-specific peptidase 1 (non-functional)
  Uniprot ID: Q6NVU6
  ENSP ID: ENSP00000373413
MGDKPPGFRGSRDWIGCVEASLCLAHFGGPQGRLCHVPRGVGLHGELERLYSHFAGGGGPVMVGGDADARSKALLGVCVGSGTEAYVLVLDPHYWGTPKSPSELQAAGWVGWQEVSAAFDPNSFYNLCLTSLSSQQQQRTLD

SEQ ID NO: 95642 - protein, 469 aa, Homo sapiens
  Payload ID: 19076
  Gene Name: UFM1-specific peptidase 2
  Uniprot ID: Q9NUQ7
  ENSP ID: ENSP00000264689
MVISESMDILFRIRGGLDLAFQLATPNEIFLKKALKHVLSDLSTKLSSNALVFRICHSSVYIWPSSDINTIPGELTDASACKNILRFIQFEPEEDIKRKFMRKKDKKLSDMHQIVNIDLMLEMSTSLAAVTPIIERESGGHHYVNMTLPVDAVISVAPEETWGKVRKLLVDAIHNQLTDMEKCILKYMKGTSIVVPEPLHFLLPGKKNLVTISYPSGIPDGQLQAYRKELHDLFNLPHDRPYFKRSNAYHFPDEPYKDGYIRNPHTYLNPPNMETGMIYVVQGIYGYHHYMQDRIDDNGWGCAYRSLQTICSWFKHQGYTERSIPTHREIQQALVDAGDKPATFVGSRQWIGSIEVQLVLNQLIGITSKILFVSQGSEIASQGRELANHFQSEGTPVMIGGGVLAHTILGVAWNEITGQIKFLILDPHYTGAEDLQVILEKGWCGWKGPDFWNKDAYYNLCLPQRPNMI

SEQ ID NO: 95643 - protein, 387 aa, Homo sapiens
  Payload ID: 19076
  Gene Name: UFM1-specific peptidase 2
  ENSP ID: ENSP00000421133
MVISESMDILFRIRGGLDLAFQLATPNEIFLKKALKHVLSDLSTKLSSNALVFRICHSSVYIWPSSDINTIPGELTDASACKNILRFIQFEPEEDIKRKFMRKKDKKLSDMHQIVNIDLMLEMSTSLAAVTPIIERESGGHHYVNMTLPVDAVISVAPEETWGKVRKLLVDAIHNQLTDMEKCILKYMKGTSIVVPEPLHFLLPGKKNLVTISYPSGIPDGQLQAYRKELHDLFNLPHDRPYFKRSNAYHFPDEPYKDGYIRNPHTYLNPPNMETGMIYVVQGIYGYHHYMQDRIDDNGWGCAYRSLQTICSWFKHQGYTERSIPTHREIQQALVDAGDKPATFVGSRQWIGSIEVQLVLNQLIGITSKILFVSNTRKNKKVGNIVS

SEQ ID NO: 95644 - protein, 124 aa, Homo sapiens
  Payload ID: 19076
  Gene Name: UFM1-specific peptidase 2
  ENSP ID: ENSP00000423108
MDILFRIRGGLDLAFQLATPNEIFLKKALKHVLSDLSTKLSSNALVFRICHSSVYIWPSSDINTIPGELTDASACKNILRFIQFEPEEDIKRKFMRKKDKKLSDMHQIVNIDLMLEMSTSLAAV

SEQ ID NO: 95645 - protein, 87 aa, Homo sapiens
  Payload ID: 19076
  Gene Name: UFM1-specific peptidase 2
  ENSP ID: ENSP00000423599
MVISESMDILFRIRGGLDLAFQLATPNEIFLKKALKHVLSDLSTKLSSNALVFRICHSSVYIWPSSDINTIPGELTDASAYLSQKKI

SEQ ID NO: 95646 - protein, 197 aa, Homo sapiens
  Payload ID: 19076
  Gene Name: UFM1-specific peptidase 2
  ENSP ID: ENSP00000423657
  MOD_RES (1)..(1): Any amino acid
XMETGMIYVVQGIYGYHHYMQDRIDDNGWGCAYRSLQTICSWFKHQGYTERSIPTHREIQQALVDAGDKPATFVGSRQWIGSIEVQLVLNQLIGITSKILFVSQGSEIASQGRELANHFQSEGTPVMIGGGVLAHTILGVAWNEITGQIKFLILDPHYTGAEDLQVILEKHLEFEVYKRFFDWCMYLTEYSSNILVL

SEQ ID NO: 95647 - protein, 112 aa, Homo sapiens
  Payload ID: 19076
  Gene Name: UFM1-specific peptidase 2
  ENSP ID: ENSP00000424419
MVISESMDILFRIRGGLDLAFQLATPNEIFLKKALKHVLSDLSTKLSSNALVFRICHSSVYIWPSSDINTIPGELTDASACKNILRFIQFEPEEDIKRKFMRKKDKKLSDML

SEQ ID NO: 95648 - protein, 368 aa, Homo sapiens
  Payload ID: 19076
  Gene Name: UFM1-specific peptidase 2
  ENSP ID: ENSP00000425855
  MOD_RES (1)..(1): Any amino acid
XFRFEPEEDIKRKFMRKKDKKLSDMHQIVNIDLMLEMSTSLAAVTPIIERESGGHHYVNMTLPVDAVISVAPEETWGKVRKLLVDAIHNQLTDMEKCILKYMKGTSIVVPEPLHFLLPGKKNLVTISYPSGIPDGQLQAYRKELHDLFNLPHDRPYFKRSNAYHFPDEPYKDGYIRNPHTYLNPPNMETGMDRIDDNGWGCAYRSLQTICSWFKHQGYTERSIPTHREIQQALVDAGDKPATFVGSRQWIGSIEVQLVLNQLIGITSKILFVSQGSEIASQGRELANHFQSEGTPVMIGGGVLAHTILGVAWNEITGQIKFLILDPHYTGAEDLQVILEKGWCGWKGPDFWNKDAYYNLCLPQRPNMI

SEQ ID NO: 95649 - protein, 1440 aa, Homo sapiens
  Payload ID: 19077
  Gene Name: UHRF1 binding protein 1
  Uniprot ID: Q6BDS2
  ENSP ID: ENSP00000192788
MAGIIKKQILKHLSRFTKNLSPDKINLSTLKGEGQLTNLELDEEVLQNVLELPTWLAITRVYCNRASIRIQWTKLKTHPICLCLDKVEVEMKTCEDPRPPNGQSPIALASGQSEYGFAEKVVEGMFIIVNSITIKIHSKAFHASFELWQLQGYSVNPNWQQSDLRLTRITDPCRGEVLTFKEITWQTLRIEADATDNGDQDPVTTPLRLITNQGRIQIALKRRTKDCNVISSKLMFLLDDLLWVLTDSQLKAMMKYAESLSEAMEKSAHQRKSLAPEPVQITPPAPSAQQSWAQAFGGSQGNSNSSSSRLSQYFEKFDVKESSYHLLISRLDLHICDDSQSREPGVSANRLMGGAMQLTFRKMAFDYYPFHWAGDSCKHWVRHCEAMETRGQWAQKLVMEFQSKMEKWHEETGLKPPWHLGVDSLFRRKADSLSSPRKNPLERSPSQGRQPAFQPPAWNRLRSSCMVVRVDDLDIHQVSTAGQPSKKPSTLLSCSRKLHNLPTQVSAIHIEFTEYYFPDNQELPVPCPNLYIQLNGLTFTMDPVSLLWGNLFCLDLYRSLEQFKAIYKLEDSSQKDEHLDIRLDAFWLKVSFPLEKRERAELHRPQALVFSASGMIATNTRHAPHCSCSDLQSLFRGFAAAEFFHSNYDHFPKVPGGFSLLHMLFLHHAFQMDSCLPQPNTLPPQRPKASWDLWSVHFTQISLDFEGTENFKGHTLNFVAPFPLSIWACLPLRWQQAQARKLLLASEGRLKPSASFGSPVQSEALAPDSMSHPRSKTEHDLKSLSGLTEVMEILKEGSSGMDNKGPLTELEDVADVHMLVHSPAHVRVRLDHYQYLALLRLKEVLQRLQEQLTKDTESMTGSPLQNQTACIGVLFPSAEVALLMHPAPGAVDADSAGSDSTSLVDSELSPSEDRELKSDASSDQGPASPEKVLEESSIENQDVSQERPHSNGELQDSGPLAQQLAGKGHEAVESLQAKKLSRTQASSSPAALKPPAGRETAVNGQGELIPLKNIEGELSSAIHMTKDATKEALHATMDLTKEAVSLTKDAFSLGRDRMTSTMHKMLSLPPAKEPMAKTDEGVAAPVSGGAARLRFFSMKRTVSQQSFDGVSLDSSGPEDRISVDSDGSDSFVMLLESESGPESVPPGSLSNVSDNAGVQGSPLVNNYGQGSPAANSSVSPSGEDLIFHPVSVLVLKVNEVSFGIEVRGEDLTVALQAEELTLQQLGTVGLWQFLHGQCPGTCFQESSTLKTGHIRPAVGLRFEVGPGAAVHSPLASQNGFLHLLLHGCDLELLTSVLSGLGPFLEDEEIPVVVPMQIELLNSSITLKDDIPPIYPTSPGPIPITLAMEHVVLKRSDDGVFHIGAAAQDKPSAEVLKSEKRQPPKEQVFLVPTGEVFEQQVKELPILQKELIETKQALANANQDKEKLLQEIRKYNPFFEL

SEQ ID NO: 95650 - protein, 1400 aa, Homo sapiens
  Payload ID: 19077
  Gene Name: UHRF1 binding protein 1
  ENSP ID: ENSP00000400628
MAGIIKKQILKHLSRFTKNLSPDKINLSTLKGEGQLTNLELDEEVLQNVLELPTWLAITRVYCNRASIRIQWTKLKTHPICLCLDKVEVEMKTCEDPRPPNGQSPIALASGQSEYGFAEKVVEGMFIIVNSITIKIHSKAFHASFELWQLQGYSVNPNWQQSDLRLTRITDPCRGEVLTFKEITWQTLRIEADATDNGDQDPVTTPLRLITNQGRIQIALKRRTKDCNVISSKLMFLLDDLLWVLTDSQLKAMMKYAESLSEAMEKSAHQRKSLAPEPVQITPPAPSAQQSWAQAFGGSQGNSNSSSSRLSQYFEKFDVKESSYHLLISRLDLHICDDSQSREPGVSANRLMGGAMQLTFRKMAFDYYPFHWAGDSCKHWVRHCEAMETRGQWAQKLVMEFQSKMEKWHEETGLKPPWHLGVDSLFRRKADSLSSPRKNPLERSPSQGRQPAFQPPAWNRLRSSCMVVRVDDLDIHQVSTAGQPSKKPSTLLSCSRKLHNLPTQVSAIHIEFTEYYFPDNQELPVPCPNLYIQLNGLTFTMDPVSLLWGNLFCLDLYRSLEQFKAIYKLEDSSQKDEHLDIRLDAFWLKVSFPLEKRERAELHRPQALVFSASGMIATNTRHAPHCSCSDLQSLFRGFAAAEFFHSNYDHFPKVPGGFSLLHMLFLHHAFQMDSCLPQPNTLPPQRPKASWDLWSVHFTQISLDFEGTENFKGHTLNFVAPFPLSIWACLPLRWQQAQARKLLLASEGRLKPSASFGSPVQSEALAPDSMSHPRSKTEHDLKSLSGLTEVMEILKEGSSGMDNKGPLTELEDVADVHMLVHSPAHVRVRLDHYQYLALLRLKEVLQRLQEQLTKDTESMTGSPLQNQTACIGVLFPSAEVALLMHPAPGAVDADSAGSDSTSLVDSELSPSEDRELKSDASSDQGPASPEKVLEESSIENQDVSQERPHSNGELQDSGPLAQQLAGKGHEAVESLQAKKLSRTQASSSPAALKPPAGRETAVNGQGELIPLKNIEGELSSAIHMTKDATKEALHATMDLTKEAVSLTKDAFSLGRDRMTSTMHKMLSLPPAKEPMAKTDEGVAAPVSGGAARLRFFSMKRTVSQQSFDGVSLDSSGPEDRISVDSDGSDSFVMLLESESGPESVPPGSLSNVSDNAGVQGSPLVNNYGQGSPAANSSVSPSGEDLIFHPVSVLVLKVNEVSFGIEVRGEDLTVALQAEELTLQQLGTVGLWQFLHGQCPGTCFQESSTLKTGHIRPAVGLRFEVGPGAAVHSPLASQNGFLHLLLHGCDLELLTSVLSGLGPFLEDEEIPVVVPMQIELLNSSITLKDDIPPIYPTSPGPIPITLAMEHVVLKRSDDGVFHIGAAAQDKPSAEVLKSEKRQPPKEQVFLVPTGEVFEQQT

SEQ ID NO: 95651 - protein, 1464 aa, Homo sapiens
  Payload ID: 19078
  Gene Name: UHRF1 binding protein 1-like
  Uniprot ID: A0JNW5
  ENSP ID: ENSP00000279907
MAGIIKKQILKHLSRFTKNLSPDKINLSTLKGEGELKNLELDEEVLQNMLDLPTWLAINKVFCNKASIRIPWTKLKTHPICLSLDKVIMEMSTCEEPRSPNGPSPIATASGQSEYGFAEKVVEGISVSVNSIVIRIGAKAFNASFELSQLRIYSVNAHWEHGDLRFTRIQDPQRGEVLTFKEINWQMIRIEADATQSSHLEIMCAPVRLITNQSKIRVTLKRRLKDCNVIATKLVLILDDLLWVLTDSQLKAMVQYAKSLSEAIEKSTEQRKSMAPEPTQSSTVVASAQQVKTTQTSNAPDVNDAIVKLFNDFDVKETSHHLVISHLDLHICDDIHAKEKESNRRITGGAMQLSFTQLTIDYYPYHKAGDSCNHWMYFSDATKTKNGWANELLHEFECNVEMLKQAVKDHNVGSPPKSPTHASPQHTQTEKDYPLKGTCRTPSVLSQQSKAKLMSSSVVVRLADFNIYQVSTAEQCRSSPKSMICCNKKSLYLPQEMSAVYIEFTEYYYPDGKDFPIPSPNLYSQLNALQFTVDERSILWLNQFLLDLKQSLNQFMAVYKLNDNSKSDEHVDVRVDGLMLKFVIPSEVKSECHQDQPRAISIQSSEMIATNTRHCPNCRHSDLEALFQDFKDCDFFSKTYTSFPKSCDNFNLLHPIFQRHAHEQDTKMHEIYKGNITPQLNKNTLKTSAATDVWAVYFSQFWIDYEGMKSGKGRPISFVDSFPLSIWICQPTRYAESQKEPQTCNQVSLNTSQSESSDLAGRLKRKKLLKEYYSTESEPLTNGGQKPSSSDTFFRFSPSSSEADIHLLVHVHKHVSMQINHYQYLLLLFLHESLILLSENLRKDVEAVTGSPASQTSICIGILLRSAELALLLHPVDQANTLKSPVSESVSPVVPDYLPTENGDFLSSKRKQISRDINRIRSVTVNHMSDNRSMSVDLSHIPLKDPLLFKSASDTNLQKGISFMDYLSDKHLGKISEDESSGLVYKSGSGEIGSETSDKKDSFYTDSSSILNYREDSNILSFDSDGNQNILSSTLTSKGNETIESIFKAEDLLPEAASLSENLDISKEETPPVRTLKSQSSLSGKPKERCPPNLAPLCVSYKNMKRSSSQMSLDTISLDSMILEEQLLESDGSDSHMFLEKGNKKNSTTNYRGTAESVNAGANLQNYGETSPDAISTNSEGAQENHDDLMSVVVFKITGVNGEIDIRGEDTEICLQVNQVTPDQLGNISLRHYLCNRPVGSDQKAVIHSKSSPEISLRFESGPGAVIHSLLAEKNGFLQCHIENFSTEFLTSSLMNIQHFLEDETVATVMPMKIQVSNTKINLKDDSPRSSTVSLEPAPVTVHIDHLVVERSDDGSFHIRDSHMLNTGNDLKENVKSDSVLLTSGKYDLKKQRSVTQATQTSPGVPWPSQSANFPEFSFDFTREQLMEENESLKQELAKAKMALAEAHLEKDALLHHIKKMTVE

SEQ ID NO: 95652 - protein, 522 aa, Homo sapiens
  Payload ID: 19078
  Gene Name: UHRF1 binding protein 1-like
  Uniprot ID: A0JNW5
  ENSP ID: ENSP00000349285
MAGIIKKQILKHLSRFTKNLSPDKINLSTLKGEGELKNLELDEEVLQNMLDLPTWLAINKVFCNKASIRIPWTKLKTHPICLSLDKVIMEMSTCEEPRSPNGPSPIATASGQSEYGFAEKVVEGISVSVNSIVIRIGAKAFNASFELSQLRIYSVNAHWEHGDLRFTRIQDPQRGEVLTFKEINWQMIRIEADATQSSHLEIMCAPVRLITNQSKIRVTLKRRLKDCNVIATKLVLILDDLLWVLTDSQLKAMVQYAKSLSEAIEKSTEQRKSMAPEPTQSSTVVASAQQVKTTQTSNAPDVNDAIVKLFNDFDVKETSHHLVISHLDLHICDDIHAKEKESNRRITGGAMQLSFTQLTIDYYPYHKAGDSCNHWMYFSDATKTKNGWANELLHEFECNVEMLKQAVKDHNVGSPPKSPTHASPQHTQTEKDYPLKGTCRTPSVLSQQSKAKLMSSSVVVRLADFNIYQVSTAEQCRSSPKSMICCNKKSLYLPQEMSAVYIEFTEYYYPDGKDFPTAFLSR

SEQ ID NO: 95653 - protein, 1114 aa, Homo sapiens
  Payload ID: 19078
  Gene Name: UHRF1 binding protein 1-like
  ENSP ID: ENSP00000444824
MQLSFTQLTIDYYPYHKAGDSCNHWMYFSDATKTKNGWANELLHEFECNVEMLKQAVKDHNVGSPPKSPTHASPQHTQTEKDYPLKGTCRTPSVLSQQSKAKLMSSSVVVRLADFNIYQVSTAEQCRSSPKSMICCNKKSLYLPQEMSAVYIEFTEYYYPDGKDFPIPSPNLYSQLNALQFTVDERSILWLNQFLLDLKQSLNQFMAVYKLNDNSKSDEHVDVRVDGLMLKFVIPSEVKSECHQDQPRAISIQSSEMIATNTRHCPNCRHSDLEALFQDFKDCDFFSKTYTSFPKSCDNFNLLHPIFQRHAHEQDTKMHEIYKGNITPQLNKNTLKTSAATDVWAVYFSQFWIDYEGMKSGKGRPISFVDSFPLSIWICQPTRYAESQKEPQTCNQVSLNTSQSESSDLAGRLKRKKLLKEYYSTESEPLTNGGQKPSSSDTFFRFSPSSSEADIHLLVHVHKHVSMQINHYQYLLLLFLHESLILLSENLRKDVEAVTGSPASQTSICIGILLRSAELALLLHPVDQANTLKSPVSESVSPVVPDYLPTENGDFLSSKRKQISRDINRIRSVTVNHMSDNRSMSVDLSHIPLKDPLLFKSASDTNLQKGISFMDYLSDKHLGKISEDESSGLVYKSGSGEIGSETSDKKDSFYTDSSSILNYREDSNILSFDSDGNQNILSSTLTSKGNETIESIFKAEDLLPEAASLSENLDISKEETPPVRTLKSQSSLSGKPKERCPPNLAPLCVSYKNMKRSSSQMSLDTISLDSMILEEQLLESDGSDSHMFLEKGNKKNSTTNYRGTAESVNAGANLQNYGETSPDAISTNSEGAQENHDDLMSVVVFKITGVNGEIDIRGEDTEICLQVNQVTPDQLGNISLRHYLCNRPVGSDQKAVIHSKSSPEISLRFESGPGAVIHSLLAEKNGFLQCHIENFSTEFLTSSLMNIQHFLEDETVATVMPMKIQVSNTKINLKDDSPRSSTVSLEPAPVTVHIDHLVVERSDDGSFHIRDSHMLNTGNDLKENVKSDSVLLTSGKYDLKKQRSVTQATQTSPGVPWPSQSANFPEFSFDFTREQLMEENESLKQELAKAKMALAEAHLEKDALLHHIKKMTVE

SEQ ID NO: 95654 - protein, 67 aa, Homo sapiens
  Payload ID: 19078
  Gene Name: UHRF1 binding protein 1-like
  ENSP ID: ENSP00000447043
MQLSFTQLTIDYYPYHKAEKDYPLKGTCRTPSVLSQQSKAKLMSSSVVVRLADFNIYQVSTAEQCRS

SEQ ID NO: 95655 - protein, 204 aa, Homo sapiens
  Payload ID: 19078
  Gene Name: UHRF1 binding protein 1-like
  ENSP ID: ENSP00000447809
  MOD_RES (1)..(1): Any amino acid
XSDQKAVIHSKSSPEISLRFESGPGAVIHSLLAEKNGFLQCHIENFSTEFLTSSLMNIQHFLEDETVATVMPMKIQVSNTKINLKDDSPRSSTVSLEPAPVTVHIDHLVVERSDDGSFHIRDSHMLNTGNDLKENVKSDSVLLTSGKYDLKKQRSVTQATQTSPGVPWPSQSANFPEFSFDFTREQLNKRFFNQDFGTTKMEEI

SEQ ID NO: 95656 - protein, 130 aa, Homo sapiens
  Payload ID: 19078
  Gene Name: UHRF1 binding protein 1-like
  ENSP ID: ENSP00000448226
MQLSFTQLTIDYYPYHKAGDSCNHWMYFSDATKTKNGWANELLHEFECNVEMLKQAVKDHNVGSPPKSPTHASPQHTQTEKDYPLKGTCRTPSVLSQQSKAKLMSSSVVVRLADFNIYQVSTAEQCRSSP

SEQ ID NO: 95657 - protein, 45 aa, Homo sapiens
  Payload ID: 19078
  Gene Name: UHRF1 binding protein 1-like
  ENSP ID: ENSP00000448420
MAGIIKKQILKHLSSVPCWLWWRLVCCELHNHPNEYQRSLRNPGN

SEQ ID NO: 95658 - protein, 103 aa, Homo sapiens
  Payload ID: 19078
  Gene Name: UHRF1 binding protein 1-like
  ENSP ID: ENSP00000449112
MQLSFTQLTIDYYPYHKAEKDYPLKGTCRTPSVLSQQSKAKLMSSSVVVRLADFNIYQVSTAEQCRSSPKSMICCNKKSLYLPQEMSAVYIEFTEYYYPDGKD

SEQ ID NO: 95659 - protein, 60 aa, Homo sapiens
  Payload ID: 19078
  Gene Name: UHRF1 binding protein 1-like
  ENSP ID: ENSP00000449189
MQLSFTQLTIDYYPYHKAGDSCNHWMYFSDATKTKNGWANELLHEFECNVEMLKQAVKDH

SEQ ID NO: 95660 - protein, 244 aa, Homo sapiens
  Payload ID: 19079
  Gene Name: UL16 binding protein 1
  Uniprot ID: Q9BZM6
  ENSP ID: ENSP00000229708
MAAAASPAFLLCLPLLHLLSGWSRAGWVDTHCLCYDFIITPKSRPEPQWCEVQGLVDERPFLHYDCVNHKAKAFASLGKKVNVTKTWEEQTETLRDVVDFLKGQLLDIQVENLIPIEPLTLQARMSCEHEAHGHGRGSWQFLFNGQKFLLFDSNNRKWTALHPGAKKMTEKWEKNRDVTMFFQKISLGDCKMWLEEFLMYWEQMLDPTKPPSLAPGTTQPKAMATTLSPWSLLIIFLCFILAGR

SEQ ID NO: 95661 - protein, 246 aa, Homo sapiens
  Payload ID: 19080
  Gene Name: UL16 binding protein 2
  Uniprot ID: Q9BZM5
  ENSP ID: ENSP00000356320
MAAAAATKILLCLPLLLLLSGWSRAGRADPHSLCYDITVIPKFRPGPRWCAVQGQVDEKTFLHYDCGNKTVTPVSPLGKKLNVTTAWKAQNPVLREVVDILTEQLRDIQLENYTPKEPLTLQARMSCEQKAEGHSSGSWQFSFDGQIFLLFDSEKRMWTTVHPGARKMKEKWENDKVVAMSFHYFSMGDCIGWLEDFLMGMDSTLEPSAGAPLAMSSGTTQLRATATTLILCCLLIILPCFILPGI

SEQ ID NO: 95662 - protein, 244 aa, Homo sapiens
  Payload ID: 19081
  Gene Name: UL16 binding protein 3
  Uniprot ID: Q9BZM4
  ENSP ID: ENSP00000356308
MAAAASPAILPRLAILPYLLFDWSGTGRADAHSLWYNFTIIHLPRHGQQWCEVQSQVDQKNFLSYDCGSDKVLSMGHLEEQLYATDAWGKQLEMLREVGQRLRLELADTELEDFTPSGPLTLQVRMSCECEADGYIRGSWQFSFDGRKFLLFDSNNRKWTVVHAGARRMKEKWEKDSGLTTFFKMVSMRDCKSWLRDFLMHRKKRLEPTAPPTMAPGLAQPKAIATTLSPWSFLIILCFILPGI

SEQ ID NO: 95663 - protein, 244 aa, Homo sapiens; identical to SEQ ID NO: 95662
  Payload ID: 19081
  Gene Name: UL16 binding protein 3
  Uniprot ID: Q9BZM4
  ENSP ID: ENSP00000403562

SEQ ID NO: 95664 - protein, 531 aa, Homo sapiens
  Payload ID: 19082
  Gene Name: UNC homeobox
  Uniprot ID: A6NJT0
  ENSP ID: ENSP00000314480
MMDGRLLEHPHAQFGGSLGGVVGFPYPLGHHHVYELAGHQLQSAAAAASVPFSIDGLLGGSCAAAASVVNPTPLLPAACGVGGDGQPFKLSDSGDPDKESPGCKRRRTRTNFTGWQLEELEKAFNESHYPDVFMREALALRLDLVESRVQVWFQNRRAKWRKKENTKKGPGRPAHNSHPTTCSGEPMDPEEIARKELEKMEKKKRKHEKKLLKSQGRHLHSPGGLSLHSAPSSDSDSGGGGLSPEPPEPPPPAAKGPGAHASGAAGTAPAPPGEPPAPGTCDPAFYPSQRSGAGPQPRPGRPADKDAASCGPGAAVAAVERGAAGLPKASPFSVESLLSDSPPRRKAASNAAAAAAAGLDFAPGLPCAPRTLIGKGHFLLYPITQPLGFLVPQAALKGGAGLEPAPKDAPPAPAVPPAPPAQASFGAFSGPGGAPDSAFARRSPDAVASPGAPAPAPAPFRDLASAAATEGGGGDCADAGTAGPAPPPPAPSPRPGPRPPSPAEEPATCGVPEPGAAAGPSPPEGEELDMD

SEQ ID NO: 95665 - protein, 220 aa, Homo sapiens
  Payload ID: 19083
  Gene Name: unc-119 lipid binding chaperone
  Uniprot ID: Q13432
  ENSP ID: ENSP00000301032
MKVKKGGGGAGTATESAPGPSGQSVAPIPQPPAESESGSESEPDAGPGPRPGPLQRKQPIGPEDVLGLQRITGDYLCSPEENIYKIDFVRFKIRDMDSGTVLFEIKKPPVSERLPINRRDLDPNAGRFVRYQFTPAFLRLRQVGATVEFTVGDKPVNNFRMIERHYFRNQLLKSFDFHFGFCIPSSKNTCEHIYDFPPLSEELSARAGSSGSGEVGASRD

SEQ ID NO: 95666 - protein, 240 aa, Homo sapiens
  Payload ID: 19083
  Gene Name: unc-119 lipid binding chaperone
  Uniprot ID: Q13432
  ENSP ID: ENSP00000337040
MKVKKGGGGAGTATESAPGPSGQSVAPIPQPPAESESGSESEPDAGPGPRPGPLQRKQPIGPEDVLGLQRITGDYLCSPEENIYKIDFVRFKIRDMDSGTVLFEIKKPPVSERLPINRRDLDPNAGRFVRYQFTPAFLRLRQVGATVEFTVGDKPVNNFRMIERHYFRNQLLKSFDFHFGFCIPSSKNTCEHIYDFPPLSEELISEMIRHPYETQSDSFYFVDDRLVMHNKADYSYSGTP

SEQ ID NO: 95667 - protein, 208 aa, Homo sapiens
  Payload ID: 19083
  Gene Name: unc-119 lipid binding chaperone
  ENSP ID: ENSP00000414639
MKVKKGGGGAGTATESAPGPSGQSVAPIPQPPAESESGSESEPDAGPGPRPGPLQRKQPIGPEDVLGLQRITGGARPLFPAWRFKIRDMDSGTVLFEIKKPPVSERLPINRRDLDPNAGRFVRYQFTPAFLRLRQVGATVEFTVGDKPVNNFRMIERHYFRNQLLKSFDFHFGFCIPSSKNTCEHIYDFPPLSEELSARAGSSGSGEV

SEQ ID NO: 95668 - protein, 86 aa, Homo sapiens
  Payload ID: 19083
  Gene Name: unc-119 lipid binding chaperone
  ENSP ID: ENSP00000463893
  MOD_RES (1)..(1): Any amino acid
XKKGGGGAGTATESAPGPSGQSVAPIPQPPAESESGSESEPDAGPGPRPGPLQRKQPIGPEDVLGLQRITGGWSSQWETSLSTTSA

SEQ ID NO: 95669 - protein, 125 aa, Homo sapiens
  Payload ID: 19083
  Gene Name: unc-119 lipid binding chaperone
  ENSP ID: ENSP00000465323
MDSGTVLFEIKKPPVSERLPINRRDLDPNAGRFVRYQFTPAFLRLRQVGATVEFTVGDKPVNNFRMIERHYFRNQLLKSFDFHFGFCIPSSKNTCEHIYDFPPLSEELSARAGSSGSGEVGASRD

SEQ ID NO: 95670 - protein, 145 aa, Homo sapiens
  Payload ID: 19083
  Gene Name: unc-119 lipid binding chaperone
  ENSP ID: ENSP00000466831
MDSGTVLFEIKKPPVSERLPINRRDLDPNAGRFVRYQFTPAFLRLRQVGATVEFTVGDKPVNNFRMIERHYFRNQLLKSFDFHFGFCIPSSKNTCEHIYDFPPLSEELISEMIRHPYETQSDSFYFVDDRLVMHNKADYSYSGTP

SEQ ID NO: 95671 - protein, 251 aa, Homo sapiens
  Payload ID: 19084
  Gene Name: unc-119 lipid binding chaperone B
  Uniprot ID: A6NIH7
  ENSP ID: ENSP00000344942
MSGSNPKAAAAASAAGPGGLVAGKEEKKKAGGGVLNRLKARRQAPHHAADDGVGAAVTEQELLALDTIRPEHVLRLSRVTENYLCKPEDNIYSIDFTRFKIRDLETGTVLFEIAKPCVSDQEEDEEEGGGDVDISAGRFVRYQFTPAFLRLRTVGATVEFTVGDKPVSNFRMIERHYFREHLLKNFDFDFGFCIPSSRNTCEHIYEFPQLSEDVIRLMIENPYETRSDSFYFVDNKLIMHNKADYAYNGGQ

SEQ ID NO: 95672 - protein, 1703 aa, Homo sapiens
  Payload ID: 19085
  Gene Name: unc-13 homolog A (C. elegans)
  ENSP ID: ENSP00000252773
LSLLCVSLKKAKFDGAQEKFNTYVTLKVQNVKSTTIAVRGSQPSWEQDFMFEINRLDLGLTVEVWNKGLIWDTMVGTVWIPLRTIRQSNEEGPGEWLTLDSQVIMADSEICGTKDPTFHRILLDTRFELPLDIPEEEARYWAKKLEQLNAMRDQDEYSFQDEQDKPLPVPSNQCCNWNYFGWGEQHNDDPDSAVDDRDSDYRSETSNSIPPPYYTTSQPNASVHQYSVRPPPLGSRESYSDSMHSYEEFSEPQALSPTGSSRYASSGELSQGSSQLSEDFDPDEHSLQGSDMEDERDRDSYHSCHSSVSYHKDSPRWDQDEEELEEDLEDFLEEEELPEDEEELEEEEEEVPDDLGSYAQREDVAVAEPKDFKRISLPPAAPGKEDKAPVAPTEAPDMAKVAPKPATPDKVPAAEQIPEAEPPKDEESFRPREDEEGQEGQDSMSRAKANWLRAFNKVRMQLQEARGEGEMSKSLWFKGGPGGGLIIIDSMPDIRKRKPIPLVSDLAMSLVQSRKAGITSALASSTLNNEELKNHVYKKTLQALIYPISCTTPHNFEVWTATTPTYCYECEGLLWGIARQGMRCTECGVKCHEKCQDLLNADCLQRAAEKSSKHGAEDRTQNIIMVLKDRMKIRERNKPEIFELIQEIFAVTKTAHTQQMKAVKQSVLDGTSKWSAKISITVVCAQGLQAKDKTGSSDPYVTVQVGKTKKRTKTIYGNLNPVWEENFHFECHNSSDRIKVRVWDEDDDIKSRVKQRFKRESDDFLGQTIIEVRTLSGEMDVWYNLDKRTDKSAVSGAIRLHISVEIKGEEKVAPYHVQYTCLHENLFHFVTDVQNNGVVKIPDAKGDDAWKVYYDETAQEIVDEFAMRYGVESIYQAMTHFACLSSKYMCPGVPAVMSTLLANINAYYAHTTASTNVSASDRFAASNFGKERFVKLLDQLHNSLRIDLSMYRNNFPASSPERLQDLKSTVDLLTSITFFRMKVQELQSPPRASQVVKDCVKACLNSTYEYIFNNCHELYSREYQTDPAKKGEVLPEEQGPSIKNLDFWSKLITLIVSIIEEDKNSYTPCLNQFPQELNVGKISAEVMWNLFAQDMKYAMEEHDKHRLCKSADYMNLHFKVKWLYNEYVTELPAFKDRVPEYPAWFEPFVIQWLDENEEVSRDFLHGALERDKKDGFQQTSEHALFSCSVVDVFSQLNQSFEIIKKLECPDPQIVGHYMRRFAKTISNVLLQYADIISKDFASYCSKEKEKVPCILMNNTQQLRVQLEKMFEAMGGKELDAEASDILKELQVKLNNVLDELSRVFATSFQPHIEECVKQMGDILSQVKGTGNVPASACSSVAQDADNVLQPIMDLLDSNLTLFAKICEKTVLKRVLKELWKLVMNTMEKTIVLPPLTDQTMIGNLLRKHGKGLEKGRVKLPSHSDGTQMIFNAAKELGQLSKLKDHMVREEAKSLTPKQCAVVELALDTIKQYFHAGGVGLKKTFLEKSPDLQSLRYALSLYTQATDLLIKTFVQTQSAQGLGVEDPVGEVSVHVELFTHPGTGEHKVTVKVVAANDLKWQTSGIFRPFIEVNIIGPQLSDKKRKFATKSKNNSWAPKYNESFQFTLSADAGPECYELQVCVKDYCFAREDRTVGLAVLQLRELAQRGSAACWLPLGRRIHMDDTGLTVLRILSQRSNDEVAKEFVKLKSDTRSAEEGGAAPAP

SEQ ID NO: 95673 - protein, 1703 aa, Homo sapiens
  Payload ID: 19085
  Gene Name: unc-13 homolog A (C. elegans)
  Uniprot ID: Q9UPW8
  ENSP ID: ENSP00000429562
MSLLCVGVKKAKFDGAQEKFNTYVTLKVQNVKSTTIAVRGSQPSWEQDFMFEINRLDLGLTVEVWNKGLIWDTMVGTVWIPLRTIRQSNEEGPGEWLTLDSQVIMADSEICGTKDPTFHRILLDTRFELPLDIPEEEARYWAKKLEQLNAMRDQDEYSFQDEQDKPLPVPSNQCCNWNYFGWGEQHNDDPDSAVDDRDSDYRSETSNSIPPPYYTTSQPNASVHQYSVRPPPLGSRESYSDSMHSYEEFSEPQALSPTGSSRYASSGELSQGSSQLSEDFDPDEHSLQGSDMEDERDRDSYHSCHSSVSYHKDSPRWDQDEEELEEDLEDFLEEEELPEDEEELEEEEEEVPDDLGSYAQREDVAVAEPKDFKRISLPPAAPGKEDKAPVAPTEAPDMAKVAPKPATPDKVPAAEQIPEAEPPKDEESFRPREDEEGQEGQDSMSRAKANWLRAFNKVRMQLQEARGEGEMSKSLWFKGGPGGGLIIIDSMPDIRKRKPIPLVSDLAMSLVQSRKAGITSALASSTLNNEELKNHVYKKTLQALIYPISCTTPHNFEVWTATTPTYCYECEGLLWGIARQGMRCTECGVKCHEKCQDLLNADCLQRAAEKSSKHGAEDRTQNIIMVLKDRMKIRERNKPEIFELIQEIFAVTKTAHTQQMKAVKQSVLDGTSKWSAKISITVVCAQGLQAKDKTGSSDPYVTVQVGKTKKRTKTIYGNLNPVWEENFHFECHNSSDRIKVRVWDEDDDIKSRVKQRFKRESDDFLGQTIIEVRTLSGEMDVWYNLDKRTDKSAVSGAIRLHISVEIKGEEKVAPYHVQYTCLHENLFHFVTDVQNNGVVKIPDAKGDDAWKVYYDETAQEIVDEFAMRYGVESIYQAMTHFACLSSKYMCPGVPAVMSTLLANINAYYAHTTASTNVSASDRFAASNFGKERFVKLLDQLHNSLRIDLSMYRNNFPASSPERLQDLKSTVDLLTSITFFRMKVQELQSPPRASQVVKDCVKACLNSTYEYIFNNCHELYSREYQTDPAKKGEVLPEEQGPSIKNLDFWSKLITLIVSIIEEDKNSYTPCLNQFPQELNVGKISAEVMWNLFAQDMKYAMEEHDKHRLCKSADYMNLHFKVKWLYNEYVTELPAFKDRVPEYPAWFEPFVIQWLDENEEVSRDFLHGALERDKKDGFQQTSEHALFSCSVVDVFSQLNQSFEIIKKLECPDPQIVGHYMRRFAKTISNVLLQYADIISKDFASYCSKEKEKVPCILMNNTQQLRVQLEKMFEAMGGKELDAEASDILKELQVKLNNVLDELSRVFATSFQPHIEECVKQMGDILSQVKGTGNVPASACSSVAQDADNVLQPIMDLLDSNLTLFAKICEKTVLKRVLKELWKLVMNTMEKTIVLPPLTDQTMIGNLLRKHGKGLEKGRVKLPSHSDGTQMIFNAAKELGQLSKLKDHMVREEAKSLTPKQCAVVELALDTIKQYFHAGGVGLKKTFLEKSPDLQSLRYALSLYTQATDLLIKTFVQTQSAQGLGVEDPVGEVSVHVELFTHPGTGEHKVTVKVVAANDLKWQTSGIFRPFIEVNIIGPQLSDKKRKFATKSKNNSWAPKYNESFQFTLSADAGPECYELQVCVKDYCFAREDRTVGLAVLQLRELAQRGSAACWLPLGRRIHMDDTGLTVLRILSQRSNDEVAKEFVKLKSDTRSAEEGGAAPAP

SEQ ID NO: 95674 - protein, 1676 aa, Homo sapiens
  Payload ID: 19085
  Gene Name: unc-13 homolog A (C. elegans)
  ENSP ID: ENSP00000446831
MSLLCVGVKKAKFDGAQEKFNTYVTLKVQNVKSTTIAVRGSQPSWEQDFMFEINRLDLGLTVEVWNKGLIWDTMVGTVWIPLRTIRQSNEEGPGEWLTLDSQVIMADSEICGTKDPTFHRILLDTRFELPLDIPEEEARYWAKKLEQLNAMRDQDEYSFQDEQDKPLPVPSNQCCNWNYFGWGEQHNDDPDSAVDDRDSDYRSETSNSIPPPYYTTSQPNASVHQYSVRPPPLGSRESYSDSMHSYEEFSEPQALSPTGSSRYASSGELSQGSSQLSEDFDPDEHSLQGSDMEDERDRDSYHSCHSSVSYHKDSPRWDQDEEELEEDLEDFLEEEELPEDEEELEEEEEEVPDDLGSYAQREDVAVAEPKDFKRISLPPAAPGKEDKAPVAPTEAPDMAKVAPKPATPDKVPAAEQIPEAEPPKDEESFRPREDEEGQEGQDSMSRAKANWLRAFNKVRMQLQEARGEGEMSKSLWFKGGPGGGLIIIDSMPDIRKRKPIPLVSDLSLVQSRKAGITSALASSTLNNEELKNHVYKKTLQALIYPISCTTPHNFEVWTATTPTYCYECEGLLWGIARQGMRCTECGVKCHEKCQDLLNADCLQRAAEKSSKHGAEDRTQNIIMVLKDRMKIRERNKPEIFELIQEIFAVTKTAHTQQMKAVKQSVLDGTSKWSAKISITVVCAQGLQAKDKTGSSDPYVTVQVGKTKKRTKTIYGNLNPVWEENFHFECHNSSDRIKVRVWDEDDDIKSRVKQRFKRESDDFLGQTIIEVRTLSGEMDVWYNLDKRTDKSAVSGAIRLHISVEIKGEEKVAPYHVQYTCLHENLFHFVTDVQNNGVVKIPDAKGDDAWKVYYDETAQEIVDEFAMRYGVESIYQAMTHFACLSSKYMCPGVPAVMSTLLANINAYYAHTTASTNVSASDRFAASNFGKERFVKLLDQLHNSLRIDLSMYRNNFPASSPERLQDLKSTVDLLTSITFFRMKVQELQSPPRASQVVKDCVKACLNSTYEYIFNNCHELYSREYQTDPAKKGEVLPEEQGPSIKNLDFWSKLITLIVSIIEEDKNSYTPCLNQFPQELNVGKISAEVMWNLFAQDMKYAMEEHDKHRLCKSADYMNLHFKVKWLYNEYVTELPAFKDRVPEYPAWFEPFVIQWLDENEEVSRDFLHGALERDKKDGFQQTSEHALFSCSVVDVFSQLNQSFEIIKKLECPDPQIVGHYMRRFAKTISNVLLQYADIISKDFASYCSKEKEKVPCILMNNTQQLRVQLEKMFEAMGGKELDAEASDILKELQVKLNNVLDELSRVFATSFQPHIEECVKQMGDILSQVKGTGNVPASACSSVAQDADNVLQPIMDLLDSNLTLFAKICEKTVLKRVLKELWKLVMNTMEKTIVLPPLTDQTGTQMIFNAAKELGQLSKLKDHMVREEAKSLTPKQCAVVELALDTIKQYFHAGGVGLKKTFLEKSPDLQSLRYALSLYTQATDLLIKTFVQTQSAQGLGVEDPVGEVSVHVELFTHPGTGEHKVTVKVVAANDLKWQTSGIFRPFIEVNIIGPQLSDKKRKFATKSKNNSWAPKYNESFQFTLSADAGPECYELQVCVKDYCFAREDRTVGLAVLQLRELAQRGSAACWLPLGRRIHMDDTGLTVLRILSQRSNDEVAKEFVKLKSDTRSAEEGGAAPAP

SEQ ID NO: 95675 - protein, 1722 aa, Homo sapiens
  Payload ID: 19085
  Gene Name: unc-13 homolog A (C. elegans)
  ENSP ID: ENSP00000447236
MSLLCVGVKKAKFDGAQEKFNTYVTLKVQNVKSTTIAVRGSQPSWEQDFMFEINRLDLGLTVEVWNKGLIWDTMVGTVWIPLRTIRQSNEEGPGEWLTLDSQVIMADSEICGTKDPTFHRILLDTRFELPLDIPEEEARYWAKKLEQLNAMRDQDEYSFQDEQDKPLPVPSNQCCNWNYFGWGEQHNDDPDSAVDDRDSDYRSETSNSIPPPYYTTSQPNASVHQYSVRPPPLGSRESYSDSMHSYEEFSEPQALSPTGSSRYASSGELSQGSSQLSEDFDPDEHSLQGSDMEDERDRDSYHSCHSSVSYHKDSPRWDQDEEELEEDLEDFLEEEELPEDEEELEEEEEEVPDDLGSYAQREDVAVAEPKDFKRISLPPAAPGKEDKAPVAPTEAPDMAKVAPKPATPDKVPAAEQIPEAEPPKDEESFRPREDEEGQEGQDSMSRAKANWLRAFNKVRMQLQEARGEGEMSKSLWFKGGPGGGLIIIDSMPDIRKRKPIPLVSDLAMSLVQSRKAGITSALASSTLNNEELKNHVYKKTLQALIYPISCTTPHNFEVWTATTPTYCYECEGLLWGIARQGMRCTECGVKCHEKCQDLLNADCLQRAAEKSSKHGAEDRTQNIIMVLKDRMKIRERNKPEIFELIQEIFAVTKTAHTQQMKAVKQSVLDGTSKWSAKISITVVCAQGLQAKDKTGSSDPYVTVQVGKTKKRTKTIYGNLNPVWEENFHFECHNSSDRIKVRVWDEDDDIKSRVKQRFKRESDDFLGQTIIEVRTLSGEMDVWYNLDKRTDKSAVSGAIRLHISVEIKGEEKVAPYHVQYTCLHENLFHFVTDVQNNGVVKIPDAKGDDAWKVYYDETAQEIVDEFAMRYGVESIYQAMTHFACLSSKYMCPGVPAVMSTLLANINAYYAHTTASTNVSASDRFAASNFGKERFVKLLDQLHNSLRIDLSMYRNNFPASSPERLQDLKSTVDLLTSITFFRMKVQELQSPPRASQVVKDCVKACLNSTYEYIFNNCHELYSREYQTDPAKKGEVLPEEQGPSIKNLDFWSKLITLIVSIIEEDKNSYTPCLNQFPQELNVGKISAEVMWNLFAQDMKYAMEEHDKHRLCKSADYMNLHFKVKWLYNEYVTELPAFKDRVPEYPAWFEPFVIQWLDENEEVSRDFLHGALERDKKDGFQQTSEHALFSCSVVDVFSQLNQSFEIIKKLECPDPQIVGHYMRRFAKTISNVLLQYADIISKDFASYCSKEKEKVPCILMNNTQQLRVQLEKMFEAMGGKELDAEASDILKELQVKLNNVLDELSRVFATSFQPHIEECVKQMGDILSQVKGTGNVPASACSSVAQDADNVLQPIMDLLDSNLTLFAKICEKTVLKRVLKELWKLVMNTMEKTIVLPPLTDQTMIGNLLRKHGKGLEKGRVKLPSHSDGTQMIFNAAKELGQLSKLKDHMVREEAKSLTPKQCAVVELALDTIKQYFHAGGVGLKKTFLEKSPDLQSLRYALSLYTQATDLLIKTFVQTQSAQVHGGKGTRFTLSEDIYPEKGLGVEDPVGEVSVHVELFTHPGTGEHKVTVKVVAANDLKWQTSGIFRPFIEVNIIGPQLSDKKRKFATKSKNNSWAPKYNESFQFTLSADAGPECYELQVCVKDYCFAREDRTVGLAVLQLRELAQRGSAACWLPLGRRIHMDDTGLTVLRILSQRSNDEVAKEFVKLKSDTRSAEEGGAAPAP

SEQ ID NO: 95676 - protein, 1697 aa, Homo sapiens
  Payload ID: 19085
  Gene Name: unc-13 homolog A (C. elegans)
  ENSP ID: ENSP00000447572
MSLLCVGVKKAKFDGAQEKFNTYVTLKVQNVKSTTIAVRGSQPSWEQDFMFEINRLDLGLTVEVWNKGLIWDTMVGTVWIPLRTIRQSNEEGPGEWLTLDSQVIMADSEICGTKDPTFHRILLDTRFELPLDIPEEEARYWAKKLEQLNAMRDQDEYSFQDEQDKPLPVPSNQCCNWNYFGWGEQHNDDPDSAVDDRDSDYRSETSNSIPPPYYTTSQPNASVHQYSVRPPPLGSRESYSDSMHSYEEFSEPQALSPTGSSRYASSGELSQGSSQLSEDFDPDEHSLQGSDMEDERDRDSYHSCHSSVSYHKDSPRWDQDEEELEEDLEDFLEEEELPEDEEELEEEEEEVPDDLGSYAQREDVAVAEPKDFKRISLPPAAPGKEDKAPVAPTEAPDMAKVAPKPATPDKVPAAEQIPEAEPPKDEESFRPREDEEGQEGQDSMSRAKANWLRAFNKVRMQLQEARGEGEMSKSLWFKGGPGGGLIIIDSMPDIRKRKPIPLVSDLAMSLVQSRKAGITSALASSTLNNEELKNHVYKKTLQALIYPISCTTPHNFEVWTATTPTYCYECEGLLWGIARQGMRCTECGVKCHEKCQDLLNADCLQRAAEKSSKHGAEDRTQNIIMVLKDRMKIRERNKPEIFELIQEIFAVTKTAHTQQMKAVKQSVLDGTSKWSAKISITVVCAQGLQAKDKTGSSDPYVTVQVGKTKKRTKTIYGNLNPVWEENFHFECHNSSDRIKVRVWDEDDDIKSRVKQRFKRESDDFLGQTIIEVRTLSGEMDVWYNLDKRTDKSAVSGAIRLHISVEIKGEEKVAPYHVQYTCLHENLFHFVTDVQNNGVVKIPDAKGDDAWKVYYDETAQEIVDEFAMRYGVESIYQAMTHFACLSSKYMCPGVPAVMSTLLANINAYYAHTTASTNVSASDRFAASNFGKERFVKLLDQLHNSLRIDLSMYRNNFPASSPERLQDLKSTVDLLTSITFFRMKVQELQSPPRASQVVKDCVKACLNSTYEYIFNNCHELYSREYQTDPAKKGEVLPEEQGPSIKNLDFWSKLITLIVSIIEEDKNSYTPCLNQFPQELNVGKISAEVMWNLFAQDMKYAMEEHDKHRLCKSADYMNLHFKVKWLYNEYVTELPAFKDRVPEYPAWFEPFVIQWLDENEEVSRDFLHGALERDKKDGFQQTSEHALFSCSVVDVFSQLNQSFEIIKKLECPDPQIVGHYMRRFAKTISNVLLQYADIISKDFASYCSKEKEKVPCILMNNTQQLRVQLEKMFEAMGGKELDAEASDILKELQVKLNNVLDELSRVFATSFQPHIEECVKQMGDILSQVKGTGNVPASACSSVAQDADNVLQPIMDLLDSNLTLFAKICEKTVLKRVLKELWKLVMNTMEKTIVLPPLTDQTGTQMIFNAAKELGQLSKLKDHMVREEAKSLTPKQCAVVELALDTIKQYFHAGGVGLKKTFLEKSPDLQSLRYALSLYTQATDLLIKTFVQTQSAQVHGGKGTRFTLSEDIYPEKGLGVEDPVGEVSVHVELFTHPGTGEHKVTVKVVAANDLKWQTSGIFRPFIEVNIIGPQLSDKKRKFATKSKNNSWAPKYNESFQFTLSADAGPECYELQVCVKDYCFAREDRTVGLAVLQLRELAQRGSAACWLPLGRRIHMDDTGLTVLRILSQRSNDEVAKEFVKLKSDTRSAEEGGAAPAP

SEQ ID NO: 95677 - protein, 1591 aa, Homo sapiens
  Payload ID: 19086
  Gene Name: unc-13 homolog B (C. elegans)
  Uniprot ID: O14795
  ENSP ID: ENSP00000367756
MSLLCVRVKRAKFQGSPDKFNTYVTLKVQNVKSTTVAVRGDQPSWEQDFMFEISRLDLGLSVEVWNKGLIWDTMVGTVWIALKTIRQSDEEGPGEWSTLEAETLMKDDEICGTRNPTPHKILLDTRFELPFDIPEEEARYWTYKWEQINALGADNEYSSQEESQRKPLPTAAAQCSFEDPDSAVDDRDSDYRSETSNSFPPPYHTASQPNASVHQFPVPVRSPQQLLLQGSSRDSCNDSMQSYDLDYPERRAISPTSSSRYGSSCNVSQGSSQLSELDQYHEQDDDHRETDSIHSCHSSHSLSRDGQAGFGEQEKPLEVTGQAEKEAACEPKEMKEDATTHPPPDLVLQKDHFLGPQESFPEENASSPFTQARAHWIRAVTKVRLQLQEIPDDGDPSLPQWLPEGPAGGLYGIDSMPDLRRKKPLPLVSDLSLVQSRKAGITSAMATRTSLKDEELKSHVYKKTLQALIYPISCTTPHNFEVWTATTPTYCYECEGLLWGIARQGMRCSECGVKCHEKCQDLLNADCLQRAAEKSCKHGAEDRTQNIIMAMKDRMKIRERNKPEIFEVIRDVFTVNKAAHVQQMKTVKQSVLDGTSKWSAKITITVVCAQGLQAKDKTGSSDPYVTVQVSKTKKRTKTIFGNLNPVWEEKFHFECHNSSDRIKVRVWDEDDDIKSRVKQRLKRESDDFLGQTIIEVRTLSGEMDVWYNLEKRTDKSAVSGAIRLQISVEIKGEEKVAPYHVQYTCLHENLFHYLTDIQGSGGVRIPEARGDDAWKVYFDETAQEIVDEFAMRYGIESIYQAMTHFACLSSKYMCPGVPAVMSTLLANINAYYAHTTASTNVSASDRFAASNFGKERFVKLLDQLHNSLRIDLSTYRNNFPAGSPERLQDLKSTVDLLTSITFFRMKVQELQSPPRASQVVKDCVKACLNSTYEYIFNNCHDLYSRQYQLKQELPPEEQGPSIRNLDFWPKLITLIVSIIEEDKNSYTPVLNQFPQELNVGKVSAEVMWHLFAQDMKYALEEHEKDHLCKSADYMNLHFKVKWLHNEYVRDLPVLQGQVPEYPAWFEQFVLQWLDENEDVSLEFLRGALERDKKDGFQQTSEHALFSCSVVDVFTQLNQSFEIIRKLECPDPSILAHYMRRFAKTIGKVLMQYADILSKDFPAYCTKEKLPCILMNNVQQLRVQLEKMFEAMGGKELDLEAADSLKELQVKLNTVLDELSMVFGNSFQVRIDECVRQMADILGQVRGTGNASPDARASAAQDADSVLRPLMDFLDGNLTLFATVCEKTVLKRVLKELWRVVMNTMERMIVLPPLTDQTGTQLIFTAAKELSHLSKLKDHMVREETRNLTPKQCAVLDLALDTIKQYFHAGGNGLKKTFLEKSPDLQSLRYALSLYTQTTDTLIKTFVRSQTTQGSGVDDPVGEVSIQVDLFTHPGTGEHKVTVKVVAANDLKWQTAGMFRPFVEVTMVGPHQSDKKRKFTTKSKSNNWAPKYNETFHFLLGNEEGPESYELQICVKDYCFAREDRVLGLAVMPLRDVTAKGSCACWCPLGRKIHMDETGLTILRILSQRSNDEVAREFVKLKSESRSTEEGS

SEQ ID NO: 95678 - protein, 1197 aa, Homo sapiens [sequence omitted]

SEQ ID NO: 95679 - protein, 1622 aa, Homo sapiens
  Payload ID: 19086
  Gene Name: unc-13 homolog B (C. elegans)
  ENSP ID: ENSP00000380006
MSLLCVRVKRAKFQGSPDKFNTYVTLKVQNVKSTTVAVRGDQPSWEQDFMFEISRLDLGLSVEVWNKGLIWDTMVGTVWIALKTIRQSDEEGPGEWSTLEAETLMKDDEICGTRNPTPHKILLDTRFELPFDIPEEEARYWTYKWEQINALGADNEYSSQEESQRKPLPTAAAQCCHWTYLGWGEQQTFEDPDSAVDDRDSDYRSETSNSFPPPYHTASQPNASVHQFPVPVRSPQQLLLQGSSRDSCNDSMQSYDLDYPERRAISPTSSSRYGSSCNVSQGSSQLSELDQYHEQDDDHRETDSIHSCHSSHSLSRDGQAGFGEQEKPLEVTGQAEKEAACEPKEMKEDATTHPPPDLVLQKDHFLGPQESFPEENASSPFTQARAHWIRAVTKVRLQLQEIPDDGDPSLPQWLPEGPAGGLYGIDSMPDLRRKKPLPLVSDLSLVQSRKAGITSAMATRTSLKDEELKSHVYKKTLQALIYPISCTTPHNFEVWTATTPTYCYECEGLLWGIARQGMRCSECGVKCHEKCQDLLNADCLQRAAEKSCKHGAEDRTQNIIMAMKDRMKIRERNKPEIFEVIRDVFTVNKAAHVQQMKTVKQSVLDGTSKWSAKITITVVCAQGLQAKDKTGSSDPYVTVQVSKTKKRTKTIFGNLNPVWEEKFHFECHNSSDRIKVRVWDEDDDIKSRVKQRLKRESDDFLGQTIIEVRTLSGEMDVWYNLEKRTDKSAVSGAIRLQISVEIKGEEKVAPYHVQYTCLHENLFHYLTDIQGSGGVRIPEARGDDAWKVYFDETAQEIVDEFAMRYGIESIYQAMTHFACLSSKYMCPGVPAVMSTLLANINAYYAHTTASTNVSASDRFAASNFGKERFVKLLDQLHNSLRIDLSTYRNNFPAGSPERLQDLKSTVDLLTSITFFRMKVQELQSPPRASQVVKDCVKACLNSTYEYIFNNCHDLYSRQYQLKQELPPEEQGPSIRNLDFWPKLITLIVSIIEEDKNSYTPVLNQFPQELNVGKVSAEVMWHLFAQDMKYALEEHEKDHLCKSADYMNLHFKVKWLHNEYVRDLPVLQGQVPEYPAWFEQFVLQWLDENEDVSLEFLRGALERDKKDGFQQTSEHALFSCSVVDVFTQLNQSFEIIRKLECPDPSILAHYMRRFAKTIGKVLMQYADILSKDFPAYCTKEKLPCILMNNVQQLRVQLEKMFEAMGGKELDLEAADSLKELQVKLNTVLDELSMVFGNSFQVRIDECVRQMADILGQVRGTGNASPDARASAAQDADSVLRPLMDFLDGNLTLFATVCEKTVLKRVLKELWRVVMNTMERMIVLPPLTDQTGTQLIFTAAKELSHLSKLKDHMVREETRNLTPKQCAVLDLALDTIKQYFHAGGNGLKKTFLEKSPDLQSLRYALSLYTQTTDTLIKTFVRSQTTQVHDGKGIRFTANEDIRPEKGSGVDDPVGEVSIQVDLFTHPGTGEHKVTVKVVAANDLKWQTAGMFRPFVEVTMVGPHQSDKKRKFTTKSKSNNWAPKYNETFHFLLGNEEGPESYELQICVKDYCFAREDRVLGLAVMPLRDVTAKGSCACWCPLGRKIHMDETGLTILRILSQRSNDEVAREFVKLKSESRSTEEGS

SEQ ID NO: 95680 - protein, 1610 aa, Homo sapiens
  Payload ID: 19086
  Gene Name: unc-13 homolog B (C. elegans)
  Uniprot ID: O14795
  ENSP ID: ENSP00000479261
MSLLCVRVKRAKFQGSPDKFNTYVTLKVQNVKSTTVAVRGDQPSWEQDFMFEISRLDLGLSVEVWNKGLIWDTMVGTVWIALKTIRQSDEEGPGEWSTLEAETLMKDDEICGTRNPTPHKILLDTRFELPFDIPEEEARYWTYKWEQINALGADNEYSSQEESQRKPLPTAAAQCSFEDPDSAVDDRDSDYRSETSNSFPPPYHTASQPNASVHQFPVPVRSPQQLLLQGSSRDSCNDSMQSYDLDYPERRAISPTSSSRYGSSCNVSQGSSQLSELDQYHEQDDDHRETDSIHSCHSSHSLSRDGQAGFGEQEKPLEVTGQAEKEAACEPKEMKEDATTHPPPDLVLQKDHFLGPQESFPEENASSPFTQARAHWIRAVTKVRLQLQEIPDDGDPSLPQWLPEGPAGGLYGIDSMPDLRRKKPLPLVSDLSLVQSRKAGITSAMATRTSLKDEELKSHVYKKTLQALIYPISCTTPHNFEVWTATTPTYCYECEGLLWGIARQGMRCSECGVKCHEKCQDLLNADCLQRAAEKSCKHGAEDRTQNIIMAMKDRMKIRERNKPEIFEVIRDVFTVNKAAHVQQMKTVKQSVLDGTSKWSAKITITVVCAQGLQAKDKTGSSDPYVTVQVSKTKKRTKTIFGNLNPVWEEKFHFECHNSSDRIKVRVWDEDDDIKSRVKQRLKRESDDFLGQTIIEVRTLSGEMDVWYNLEKRTDKSAVSGAIRLQISVEIKGEEKVAPYHVQYTCLHENLFHYLTDIQGSGGVRIPEARGDDAWKVYFDETAQEIVDEFAMRYGIESIYQAMTHFACLSSKYMCPGVPAVMSTLLANINAYYAHTTASTNVSASDRFAASNFGKERFVKLLDQLHNSLRIDLSTYRNNFPAGSPERLQDLKSTVDLLTSITFFRMKVQELQSPPRASQVVKDCVKACLNSTYEYIFNNCHDLYSRQYQLKQELPPEEQGPSIRNLDFWPKLITLIVSIIEEDKNSYTPVLNQFPQELNVGKVSAEVMWHLFAQDMKYALEEHEKDHLCKSADYMNLHFKVKWLHNEYVRDLPVLQGQVPEYPAWFEQFVLQWLDENEDVSLEFLRGALERDKKDGFQQTSEHALFSCSVVDVFTQLNQSFEIIRKLECPDPSILAHYMRRFAKTIGKVLMQYADILSKDFPAYCTKEKLPCILMNNVQQLRVQLEKMFEAMGGKELDLEAADSLKELQVKLNTVLDELSMVFGNSFQVRIDECVRQMADILGQVRGTGNASPDARASAAQDADSVLRPLMDFLDGNLTLFATVCEKTVLKRVLKELWRVVMNTMERMIVLPPLTDQTGTQLIFTAAKELSHLSKLKDHMVREETRNLTPKQCAVLDLALDTIKQYFHAGGNGLKKTFLEKSPDLQSLRYALSLYTQTTDTLIKTFVRSQTTQVHDGKGIRFTANEDIRPEKGSGVDDPVGEVSIQVDLFTHPGTGEHKVTVKVVAANDLKWQTAGMFRPFVEVTMVGPHQSDKKRKFTTKSKSNNWAPKYNETFHFLLGNEEGPESYELQICVKDYCFAREDRVLGLAVMPLRDVTAKGSCACWCPLGRKIHMDETGLTILRILSQRSNDEVAREFVKLKSESRSTEEGS

SEQ ID NO: 95681 - protein, 1197 aa, Homo sapiens
  Payload ID: 19086
  Gene Name: unc-13 homolog B (C. elegans)
  ENSP ID: ENSP00000484432
MPDLRRKKPLPLVSDLAMSLVQSRKAGITSAMATRTSLKDEELKSHVYKKTLQALIYPISCTTPHNFEVWTATTPTYCYECEGLLWGIARQGMRCSECGVKCHEKCQDLLNADCLQRAAEKSCKHGAEDRTQNIIMAMKDRMKIRERNKPEIFEVIRDVFTVNKAAHVQQMKTVKQSVLDGTSKWSAKITITVVCAQGLQAKDKTGSSDPYVTVQVSKTKKRTKTIFGNLNPVWEEKFHFECHNSSDRIKVRVWDEDDDIKSRVKQRLKRESDDFLGQTIIEVRTLSGEMDVWYNLEKRTDKSAVSGAIRLQISVEIKGEEKVAPYHVQYTCLHENLFHYLTDIQGSGGVRIPEARGDDAWKVYFDETAQEIVDEFAMRYGIESIYQAMTHFACLSSKYMCPGVPAVMSTLLANINAYYAHTTASTNVSASDRFAASNFGKERFVKLLDQLHNSLRIDLSTYRNNFPAGSPERLQDLKSTVDLLTSITFFRMKVQELQSPPRASQVVKDCVKACLNSTYEYIFNNCHDLYSRQYQLKQELPPEEQGPSIRNLDFWPKLITLIVSIIEEDKNSYTPVLNQFPQELNVGKVSAEVMWHLFAQDMKYALEEHEKDHLCKSADYMNLHFKVKWLHNEYVRDLPVLQGQVPEYPAWFEQFVLQWLDENEDVSLEFLRGALERDKKDGFQQTSEHALFSCSVVDVFTQLNQSFEIIRKLECPDPSILAHYMRRFAKTIGKVLMQYADILSKDFPAYCTKEKLPCILMNNVQQLRVQLEKMFEAMGGKELDLEAADSLKELQVKLNTVLDELSMVFGNSFQVRIDECVRQMADILGQVRGTGNASPDARASAAQDADSVLRPLMDFLDGNLTLFATVCEKTVLKRVLKELWRVVMNTMERMIVLPPLTDQTGTQLIFTAAKELSHLSKLKDHMVREETRNLTPKQCAVLDLALDTIKQYFHAGGNGLKKTFLEKSPDLQSLRYALSLYTQTTDTLIKTFVRSQTTQVHDGKGIRFTANEDIRPEKGSGVDDPVGEVSIQVDLFTHPGTGEHKVTVKVVAANDLKWQTAGMFRPFVEVTMVGPHQSDKKRKFTTKSKSNNWAPKYNETFHFLLGNEEGPESYELQICVKDYCFAREDRVLGLAVMPLRDVTAKGSCACWCPLGRKIHMDETGLTILRILSQRSNDEVAREFVKLKSESRSTEEGS

SEQ ID NO: 95682 - protein, 189 aa, Homo sapiens
  Payload ID: 19086
  Gene Name: unc-13 homolog B (C. elegans)
  ENSP ID: ENSP00000489441
WLHNEYVRDLPVLQGQVPEYPAWFEQFVLQWLDENEDVSLEFLRGALERDKKDGTIGKVLMQYADILSKDFPAYCTKEKLPCILMNNVQQLRVQLEKMFEAMGGKELDLEAADSLKELQVKLNTVLDELSMVFGNSFQVRIDECVRQMADILGQVRGTGNASPDARASAAQDADSVLRPLMDFLDGNLT

SEQ ID NO: 95683 - protein, 465 aa, Homo sapiens
  Payload ID: 19086
  Gene Name: unc-13 homolog B (C. elegans)
  ENSP ID: ENSP00000489581
MSLLCVRVKRAKFQGSPDKFNTYVTLKVQNVKSTTVAVRGDQPSWEQDFMFEISRLDLGLSVEVWNKGLIWDTMVGTVWIALKTIRQSDEEGPGEWSTLEAETLMKDDEICGTRNPTPHKILLDTRFELPFDIPEEEARYWTYKWEQINALGADNEYSSQEESQRKPLPTAAAQCSFEDPDSAVDDRDSDYRSETSNSFPPPYHTASQPNASVHQFPVPVRSPQQLLLQGSSRDSCNDSMQSYDLDYPERRAISPTSSSRYGSSCNVSQGSSQLSELDQYHEQDDDHRETDSIHSCHSSHSLSRDGQAGFGEQEKPLEVTGQAEKEAACEPKEMKEDATTHPPPDLVLQKDHFLGPQESFPEENASSPFTQARAHWIRAVTKVRLQLQEKKSEEPFRFQMMVTPLCLSGSRKGQPEGSMALTACQIYAERSHCHLSVIWLCHWSSLGRQESLLQWLHALLLRTKS

SEQ ID NO: 95684 - protein, 2214 aa, Homo sapiens
  Payload ID: 19087
  Gene Name: unc-13 homolog C (C. elegans)
  Uniprot ID: Q8NB66
  ENSP ID: ENSP00000260323
MVANFFKSLILPYIHKLCKGMFTKKLGNTNKNKEYRQQKKDQDFPTAGQTKSPKFSYTFKSTVKKIAKCSSTHNLSTEEDEASKEFSLSPTFSYRVAIANGLQKNAKVTNSDNEDLLQELSSIESSYSESLNELRSSTENQAQSTHTMPVRRNRKSSSSLAPSEGSSDGERTLHGLKLGALRKLRKWKKSQECVSSDSELSTMKKSWGIRSKSLDRTVRNPKTNALEPGFSSSGCISQTHDVMEMIFKELQGISQIETELSELRGHVNALKHSIDEISSSVEVVQSEIEQLRTGFVQSRRETRDIHDYIKHLGHMGSKASLRFLNVTEERFEYVESVVYQILIDKMGFSDAPNAIKIEFAQRIGHQRDCPNAKPRPILVYFETPQQRDSVLKKSYKLKGTGIGISTDILTHDIRERKEKGIPSSQTYESMAIKLSTPEPKIKKNNWQSPDDSDEDLESDLNRNSYAVLSKSELLTKGSTSKPSSKSHSARSKNKTANSSRISNKSDYDKISSQLPESDILEKQTTTHYADATPLWHSQSDFFTAKLSRSESDFSKLCQSYSEDFSENQFFTRTNGSSLLSSSDRELWQRKQEGTATLYDSPKDQHLNGGVQGIQGQTETENTETVDSGMSNGMVCASGDRSHYSDSQLSLHEDLSPWKEWNQGADLGLDSSTQEGFDYETNSLFDQQLDVYNKDLEYLGKCHSDLQDDSESYDLTQDDNSSPCPGLDNEPQGQWVGQYDSYQGANSNELYQNQNQLSMMYRSQSELQSDDSEDAPPKSWHSRLSIDLSDKTFSFPKFGSTLQRAKSALEVVWNKSTQSLSGYEDSGSSLMGRFRTLSQSTANESSTTLDSDVYTEPYYYKAEDEEDYTEPVADNETDYVEVMEQVLAKLENRTSITETDEQMQAYDHLSYETPYETPQDEGYDGPADDMVSEEGLEPLNETSAEMEIREDENQNIPEQPVEITKPKRIRPSFKEAALRAYKKQMAELEEKILAGDSSSVDEKARIVSGNDLDASKFSALQVCGGAGGGLYGIDSMPDLRRKKTLPIVRDVAMTLAARKSGLSLAMVIRTSLNNEELKMHVFKKTLQALIYPMSSTIPHNFEVWTATTPTYCYECEGLLWGIARQGMKCLECGVKCHEKCQDLLNADCLQRAAEKSSKHGAEDKTQTIITAMKERMKIREKNRPEVFEVIQEMFQISKEDFVQFTKAAKQSVLDGTSKWSAKITITVVSAQGLQAKDKTGSSDPYVTVQVGKNKRRTKTIFGNLNPVWDEKFYFECHNSTDRIKVRVWDEDDDIKSRVKQHFKKESDDFLGQTIVEVRTLSGEMDVWYNLEKRTDKSAVSGAIRLKINVEIKGEEKVAPYHIQYTCLHENLFHYLTEVKSNGGVKIPEVKGDEAWKVFFDDASQEIVDEFAMRYGIESIYQAMTHFSCLSSKYMCPGVPAVMSTLLANINAFYAHTTVSTNIQVSASDRFAATNFGREKFIKLLDQLHNSLRIDLSKYRENFPASNTERLQDLKSTVDLLTSITFFRMKVLELQSPPKASMVVKDCVRACLDSTYKYIFDNCHELYSQLTDPSKKQDIPREDQGPTTKNLDFWPQLITLMVTIIDEDKTAYTPVLNQFPQELNMGKISAEIMWTLFALDMKYALEEHENQRLCKSTDYMNLHFKVKWFYNEYVRELPAFKDAVPEYSLWFEPFVMQWLDENEDVSMEFLHGALGRDKKDGFQQTSEHALFSCSVVDVFAQLNQSFEIIKKLECPNPEALSHLMRRFAKTINKVLLQYAAIVSSDFSSHCDKENVPCILMNNIQQLRVQLEKMFESMGGKELDSEASTILKELQVKLSGVLDELSVTYGESFQVIIEECIKQMSFELNQMRANGNTTSNKNSAAMDAEIVLRSLMDFLDKTLSLSAKICEKTVLKRVLKELWKLVLNKIEKQIVLPPLTDQTGPQMIFIAAKDLGQLSKLKEHMIREDARGLTPRQCAIMEVVLATIKQYFHAGGNGLKKNFLEKSPDLQSLRYALSLYTQTTDALIKKFIDTQTSQSRSSKDAVGQISVHVDITATPGTGDHKVTVKVIAINDLNWQTTAMFRPFVEVCILGPNLGDKKRKQGTKTKSNTWSPKYNETFQFILGKENRPGAYELHLSVKDYCFAREDRIIGMTVIQLQNIAEKGSYGAWYPLLKNISMDETGLTILRILSQRTSDDVAKEFVRLKSETRSTEESA

SEQ ID NO: 95685 - protein, 135 aa, Homo sapiens
  Payload ID: 19087
  Gene Name: unc-13 homolog C (C. elegans)
  ENSP ID: ENSP00000443886
MFRPFVEVCILGPNLGDKKRKQGTKTKSNTWSPKYNETFQFILGKENRPGAYELHLSVKDYCFAREDRIIGMTVIQLQNIAEKGSYGAWYPLLKNISMDETGLTILRILSQRTSDDVAKEFVRLKSETRSTEESA

SEQ ID NO: 95686 - protein, 178 aa, Homo sapiens
  Payload ID: 19087
  Gene Name: unc-13 homolog C (C. elegans)
  ENSP ID: ENSP00000453018
  MOD_RES (1)..(1): Any amino acid
XAKTINKVLLQYAAIVSSDFSSHCDKENVPCILMNNIQQLRVQLEKMFESMGGKEKKEGERFFYELDSEASTILKELQVKLSGVLDELSVTYGESFQVIIEECIKQMSFELNQMRANGNTTSNKNSAAMDAEIVLRSLMDFLDKTLSLSAKICEKTVLKRVLKELWKLVLNKIEKQIV

SEQ ID NO: 95687 - protein, 20 aa, Homo sapiens
  Payload ID: 19087
  Gene Name: unc-13 homolog C (C. elegans)
  ENSP ID: ENSP00000456350
MFRPFVEVCILGPNLGDKKR

SEQ ID NO: 95688 - protein, 1090 aa, Homo sapiens
  Payload ID: 19088
  Gene Name: unc-13 homolog D (C. elegans)
  Uniprot ID: Q70J99
  ENSP ID: ENSP00000207549
MATLLSHPQQRPPFLRQAIKIRRRRVRDLQDPPPQMAPEIQPPSHHFSPEQRALLYEDALYTVLHRLGHPEPNHVTEASELLRYLQEAFHVEPEEHQQTLQRVRELEKPIFCLKATVKQAKGILGKDVSGFSDPYCLLGIEQGVGVPGGSPGSRHRQKAVVRHTIPEEETHRTQVITQTLNPVWDETFILEFEDITNASFHLDMWDLDTVESVRQKLGELTDLHGLRRIFKEARKDKGQDDFLGNVVLRLQDLRCREDQWYPLEPRTETYPDRGQCHLQFQLIHKRRATSASRSQPSYTVHLHLLQQLVSHEVTQHEAGSTSWDGSLSPQAATVLFLHATQKDLSDFHQSMAQWLAYSRLYQSLEFPSSCLLHPITSIEYQWIQGRLKAEQQEELAASFSSLLTYGLSLIRRFRSVFPLSVSDSPARLQSLLRVLVQMCKMKAFGELCPNTAPLPQLVTEALQTGTTEWFHLKQQHHQPMVQGIPEAGKALLGLVQDVIGDLHQCQRTWDKIFHNTLKIHLFSMAFRELQWLVAKRVQDHTTVVGDVVSPEMGESLFQLYISLKELCQLRMSSSERDGVLALDNFHRWFQPAIPSWLQKTYNEALARVQRAVQMDELVPLGELTKHSTSAVDLSTCFAQISHTARQLDWPDPEEAFMITVKFVEDTCRLALVYCSLIKARARELSSGQKDQGQAANMLCVVVNDMEQLRLVIGKLPAQLAWEALEQRVGAVLEQGQLQNTLHAQLQSALAGLGHEIRTGVRTLAEQLEVGIAKHIQKLVGVRESVLPEDAILPLMKFLEVELCYMNTNLVQENFSSLLTLLWTHTLTVLVEAAASQRSSSLASNRLKIALQNLEICFHAEGCGLPPKALHTATFQALQRDLELQAASSRELIRKYFCSRIQQQAETTSEELGAVTVKASYRASEQKLRVELLSASSLLPLDSNGSSDPFVQLTLEPRHEFPELAARETQKHKKDLHPLFDETFEFLVPAEPCRKAGACLLLTVLDYDTLGADDLEGEAFLPLREVPGLSGSEEPGEVPQTRLPLTYPAPNGDPILQLLEGRKGDREAQVFVRLRRHRAKQASQHALRPAP

SEQ ID NO: 95689 - protein, 1142 aa, Homo sapiens
  Payload ID: 19088
  Gene Name: unc-13 homolog D (C. elegans)
  Uniprot ID: Q70J99
  ENSP ID: ENSP00000388093
MATLLSHPQQRPPFLRQAIKIRRRRVRDLQDPPPQMAPEIQPPSHHFSPEQRALLYEDALYTVLHRLGHPEPNHVTEASELLRYLQEAFHVEPEEHQQTLQRVRELEKPIFCLKATVKQAKGILGKDVSGFSDPYCLLGIEQGVGVPGGSPGSRHRQKAVVRHTIPEEETHRTQVITQTLNPVWDETFILEFEDITNASFHLDMWDLDTVESVRQKLGELTDLHGLRRIFKEARKDKGQDDFLGNVVLRLQDLRCREDQWYPLEPRTETYPDRGQCHLQFQLIHKRRATSASRSQPSYTVHLHLLQQLVSHEVTQHEAGSTSWDGSLSPQAATVLFLHATQKDLSDFHQSMAQWLAYSRLYQSLEFPSSCLLHPITSIEYQWIQGRLKAEQQEELAASFSSLLTYGLSLIRRFRSVFPLSVSDSPARLQSLLRVLVQMCKMKAFGELCPNTAPLPQLVTEALQTGTTEWFHLKQQHHQPMVQGIPEAGKALLGLVQDVIGDLHQCQRTWDKIFHNTLKIHLFSMAFRELQWLVAKRVQDHTTVVGDVVSPEMGESLFQLYISLKELCQLRMSSSERDGVLALDNFHRWFQPAIPSWLQKTYNEALARVQRAVQMDELVPLGELTKHSTSAVDLSTCFAQISHTARQLDWPDPEEAFMITVKFVEDTCRLALVYCSLIKARARELSSGQKDQGQAANMLCVVVNDMEQLRLVIGKLPAQLAWEALEQRVGAVLEQGQLQNTLHAQLQSALAGLGHEIRTGVRTLAEQLEVGIAKHIQKLVGVRESVLPEDAILPLMKFLEVELCYMNTNLVQENFSSLLTLLWTHTLTVLVEAAASQRSSSLASNRLKIALQNLEICFHAEGCGLPPKALHTATFQALQRDLELQAASSRELIRKYFCSRIQQQAETTSEELGAVTVKASYRASEQKLRVELLSASSLLPLDSNGSSDPFVQLTLEPRHEFPELAARETQKHKKDLHPLFDETFEFLVPAEPCRKAGACLLLTVLDYDTLGADDLEGEAFLPLREVPGLSGSEEPGEVPQTRLPLTYPAPNGDPILQLLEGRKGDREAQVFVRLRRHRAKQGIGPSVSWPWPICLLAFLFQPLGWGPGSLGPGLQAQSLLEKGEGTLPKMRLQLPWGEGGGHY

SEQ ID NO: 95690 - protein, 169 aa, Homo sapiens
  Payload ID: 19088
  Gene Name: unc-13 homolog D (C. elegans)
  ENSP ID: ENSP00000464749
MATLLSHPQQRPPFLRQAIKIRRRRVRDLQDPPPQMAPEIQPPSHHFSPEQRALLYEDALYTVLHRLGHPEPNHVTEASELLRYLQEAFHVEPEEHQQTLQRVRELEKPIFCLKATVKQAKGILGKDVSGFSDPYCLLGIEQGVGVPGGSPGSRHRQKAVVRHTIPEEE

SEQ ID NO: 95691 - protein, 68 aa, Homo sapiens
  Payload ID: 19088
  Gene Name: unc-13 homolog D (C. elegans)
  ENSP ID: ENSP00000466149
SYRASEQKLRVELLSASSLLPLDSNAWCLLSRAARLGHASCSPCWTTTRWGPTTWKARPSCRCVRCPG

SEQ ID NO: 95692 - protein, 147 aa, Homo sapiens
  Payload ID: 19088
  Gene Name: unc-13 homolog D (C. elegans)
  ENSP ID: ENSP00000466377
  MOD_RES (1)..(1): Any amino acid
XYPLEPRTETYPDRGQCHLQFQLIHKRRATSASRSQPSYTVHLHLLQQLVSHEVTQHEAGSTSWDGSLSPQAATVLFLHATQKDLSDFHQSMAQWLAYSRLYQSLEFPSSCLLHPITSIEYQWIQGRLKAEQPGCSLFSGSWYRCAR

SEQ ID NO: 95693 - protein, 188 aa, Homo sapiens
  Payload ID: 19088
  Gene Name: unc-13 homolog D (C. elegans)
  ENSP ID: ENSP00000466543
MATLLSHPQQRPPFLRQAIKIRRRRVRDLQDPPPQMAPETGTTEWFHLKQQHHQPMVQGIPEAGKALLGLVQDVIGDLHQCQRTWDKIFHNTLKIHLFSMAFRELQWLVAKRVQDHTTVVGDVVSPEMGESLFQLYISLKELCQLRMSSSERDGVLALDNFHRWFQPAIPSWLQKTYNEALARVQRAV

SEQ ID NO: 95694 - protein, 146 aa, Homo sapiens
  Payload ID: 19088
  Gene Name: unc-13 homolog D (C. elegans)
  ENSP ID: ENSP00000466758
  MOD_RES (1)..(1): Any amino acid
XSDPFVQLTLEPRHEFPELAARETQKHKKDLHPLFDETFEFLVPAEPCRKAGACLLLTVLDYDTLGADDLEGEAFLPLREVPGLSGSEEPGEVPQTRLPLTYPAPNGDPILQLLEGRKGDREAQVFVRLRRHRAKQASQHALRPAP

SEQ ID NO: 95695 - protein, 310 aa, Homo sapiens
  Payload ID: 19088
  Gene Name: unc-13 homolog D (C. elegans)
  ENSP ID: ENSP00000466826
ATLLSHPQQRPPFLRQAIKIRRRRVRDLQDPPPQMAPEIQPPSHHFSPEQDALYTVLHRLGHPEPNHVTEASELLRYLQEAFHVEPEEHQQTLQRVRELEKPIFCLKATVKQAKGILGKDVSGFSDPYCLLGIEQGVGVPGGSPGSRHRQKAVVRHTIPEEETHRTQVITQTLNPVWDETFILEFEDITNASFHLDMWDLDTVESVRQKLGELTDLHGLRRIFKEARKDKGQDDFLGNVVLRLQDLRCREDQWYPLEPRTETYPDRGQCHLQFQLIHKRRATSASRSQPSYTVHLHLLQQLVSHEVTQHE

SEQ ID NO: 95696 - protein, 267 aa, Homo sapiens
  Payload ID: 19088
  Gene Name: unc-13 homolog D (C. elegans)
  ENSP ID: ENSP00000467653
MDLSHGGPRDGPPGGLLGEQIQPPSHHFSPEQRALLYEDALYTVLHRLGHPEPNHVTEASELLRYLQEAFHVEPEEHQQTLQRVRELEKPIFCLKATVKQAKGILGKDVSGFSDPYCLLGIEQGVGVPGGSPGSRHRQKAVVRHTIPEEETHRTQVITQTLNPVWDETFILEFEDITNASFHLDMWDLDTVESVRQKLGELTDLHGLRRIFKEARKDKGQDDFLGNVVLRLQDLRCREDQWYPLEPRTETYPDRGQCHLQFQLIHKR

SEQ ID NO: 95697 - protein, 929 aa, Homo sapiens
  Payload ID: 19089
  Gene Name: unc-45 myosin chaperone A
  Uniprot ID: Q9H3U1
  ENSP ID: ENSP00000377816
MTASSVEQLRKEGNELFKCGDYGGALAAYTQALGLDATPQDQAVLHRNRAACHLKLEDYDKAETEASKAIEKDGGDVKALYRRSQALEKLGRLDQAVLDLQRCVSLEPKNKVFQEALRNIGGQIQEKVRYMSSTDAKVEQMFQILLDPEEKGTEKKQKASQNLVVLAREDAGAEKIFRSNGVQLLQRLLDMGETDLMLAALRTLVGICSEHQSRTVATLSILGTRRVVSILGVESQAVSLAACHLLQVMFDALKEGVKKGFRGKEGAIIVDPARELKVLISNLLDLLTEVGVSGQGRDNALTLLIKAVPRKSLKDPNNSLTLWVIDQGLKKILEVGGSLQDPPGELAVTANSRMSASILLSKLFDDLKCDAERENFHRLCENYIKSWFEGQGLAGKLRAIQTVSCLLQGPCDAGNRALELSGVMESVIALCASEQEEEQLVAVEALIHAAGKAKRASFITANGVSLLKDLYKCSEKDSIRIRALVGLCKLGSAGGTDFSMKQFAEGSTLKLAKQCRKWLCNDQIDAGTRRWAVEGLAYLTFDADVKEEFVEDAAALKALFQLSRLEERSVLFAVASALVNCTNSYDYEEPDPKMVELAKYAKQHVPEQHPKDKPSFVRARVKKLLAAGVVSAMVCMVKTESPVLTSSCRELLSRVFLALVEEVEDRGTVVAQGGGRALIPLALEGTDVGQTKAAQALAKLTITSNPEMTFPGERIYEVVRPLVSLLHLNCSGLQNFEALMALTNLAGISERLRQKILKEKAVPMIEGYMFEEHEMIRRAATECMCNLAMSKEVQDLFEAQGNDRLKLLVLYSGEDDELLQRAAAGGLAMLTSMRPTLCSRIPQVTTHWLEILQALLLSSNQELQHRGAVVVLNMVEASREIASTLMESEMMEILSVLAKGDHSPVTRAAAACLDKAVEYGLIQPNQDGE

SEQ ID NO: 95698 - protein, 944 aa, Homo sapiens
  Payload ID: 19089
  Gene Name: unc-45 myosin chaperone A
  Uniprot ID: Q9H3U1
  ENSP ID: ENSP00000407487
MTVSGPGTPEPRPATPGASSVEQLRKEGNELFKCGDYGGALAAYTQALGLDATPQDQAVLHRNRAACHLKLEDYDKAETEASKAIEKDGGDVKALYRRSQALEKLGRLDQAVLDLQRCVSLEPKNKVFQEALRNIGGQIQEKVRYMSSTDAKVEQMFQILLDPEEKGTEKKQKASQNLVVLAREDAGAEKIFRSNGVQLLQRLLDMGETDLMLAALRTLVGICSEHQSRTVATLSILGTRRVVSILGVESQAVSLAACHLLQVMFDALKEGVKKGFRGKEGAIIVDPARELKVLISNLLDLLTEVGVSGQGRDNALTLLIKAVPRKSLKDPNNSLTLWVIDQGLKKILEVGGSLQDPPGELAVTANSRMSASILLSKLFDDLKCDAERENFHRLCENYIKSWFEGQGLAGKLRAIQTVSCLLQGPCDAGNRALELSGVMESVIALCASEQEEEQLVAVEALIHAAGKAKRASFITANGVSLLKDLYKCSEKDSIRIRALVGLCKLGSAGGTDFSMKQFAEGSTLKLAKQCRKWLCNDQIDAGTRRWAVEGLAYLTFDADVKEEFVEDAAALKALFQLSRLEERSVLFAVASALVNCTNSYDYEEPDPKMVELAKYAKQHVPEQHPKDKPSFVRARVKKLLAAGVVSAMVCMVKTESPVLTSSCRELLSRVFLALVEEVEDRGTVVAQGGGRALIPLALEGTDVGQTKAAQALAKLTITSNPEMTFPGERIYEVVRPLVSLLHLNCSGLQNFEALMALTNLAGISERLRQKILKEKAVPMIEGYMFEEHEMIRRAATECMCNLAMSKEVQDLFEAQGNDRLKLLVLYSGEDDELLQRAAAGGLAMLTSMRPTLCSRIPQVTTHWLEILQALLLSSNQELQHRGAVVVLNMVEASREIASTLMESEMMEILSVLAKGDHSPVTRAAAACLDKAVEYGLIQPNQDGE

SEQ ID NO: 95699 - protein, 931 aa, Homo sapiens
  Payload ID: 19090
  Gene Name: unc-45 myosin chaperone B
  Uniprot ID: Q8IWX7
  ENSP ID: ENSP00000268876
MAEVEAVQLKEEGNRHFQLQDYKAATNSYSQALKLTKDKALLATLYRNRAACGLKTESYVQAASDASRAIDINSSDIKALYRRCQALEHLGKLDQAFKDVQRCATLEPRNQNFQEMLRRLNTSIQEKLRVQFSTDSRVQKMFEILLDENSEADKREKAANNLIVLGREEAGAEKIFQNNGVALLLQLLDTKKPELVLAAVRTLSGMCSGHQARATVILHAVRIDRICSLMAVENEEMSLAVCNLLQAIIDSLSGEDKREHRGKEEALVLDTKKDLKQITSHLLDMLVSKKVSGQGRDQALNLLNKNVPRKDLAIHDNSRTIYVVDNGLRKILKVVGQVPDLPSCLPLTDNTRMLASILINKLYDDLRCDPERDHFRKICEEYITGKFDPQDMDKNLNAIQTVSGILQGPFDLGNQLLGLKGVMEMMVALCGSERETDQLVAVEALIHASTKLSRATFIITNGVSLLKQIYKTTKNEKIKIRTLVGLCKLGSAGGTDYGLRQFAEGSTEKLAKQCRKWLCNMSIDTRTRRWAVEGLAYLTLDADVKDDFVQDVPALQAMFELAKAGTSDKTILYSVATTLVNCTNSYDVKEVIPELVQLAKFSKQHVPEEHPKDKKDFIDMRVKRLLKAGVISALACMVKADSAILTDQTKELLARVFLALCDNPKDRGTIVAQGGGKALIPLALEGTDVGKVKAAHALAKIAAVSNPDIAFPGERVYEVVRPLVRLLDTQRDGLQNYEALLGLTNLSGRSDKLRQKIFKERALPDIENYMFENHDQLRQAATECMCNMVLHKEVQERFLADGNDRLKLVVLLCGEDDDKVQNAAAGALAMLTAAHKKLCLKMTQVTTQWLEILQRLCLHDQLSVQHRGLVIAYNLLAADAELAKKLVESELLEILTVVGKQEPDEKKAEVVQTARECLIKCMDYGFIKPVS

SEQ ID NO: 95700 - protein, 929 aa, Homo sapiens
  Payload ID: 19090
  Gene Name: unc-45 myosin chaperone B
  Uniprot ID: Q8IWX7
  ENSP ID: ENSP00000378071
MAEVEAVQLKEEGNRHFQLQDYKAATNSYSQALKLTKDKALLATLYRNRAACGLKTESYVQAASDASRAIDINSSDIKALYRRCQALEHLGKLDQAFKDVQRCATLEPRNQNFQEMLRRLNTSIQEKLRVQFSTDSRVQKMFEILLDENSEADKREKAANNLIVLGREEAGAEKIFQNNGVALLLQLLDTKKPELVLAAVRTLSGMCSGHQARATVILHAVRIDRICSLMAVENEEMSLAVCNLLQAIIDSLSGEDKREHRGKEEALVLDTKKDLKQITSHLLDMLVSKKVSGQGRDQALNLLNKNVPRKDLAIHDNSRTIYVVDNGLRKILKVVGQVPDLPSCLPLTDNTRMLASILINKLYDDLRCDPERDHFRKICEEYITGKFDPQDMDKNLNAIQTVSGILQGPFDLGNQLLGLKGVMEMMVALCGSERETDQLVAVEALIHASTKLSRATFIITNGVSLLKQIYKTTKNEKIKIRTLVGLCKLGSAGGTDYGLRQFAEGSTEKLAKQCRKWLCNMSIDTRTRRWAVEGLAYLTLDADVKDDFVQDVPALQAMFELAKTSDKTILYSVATTLVNCTNSYDVKEVIPELVQLAKFSKQHVPEEHPKDKKDFIDMRVKRLLKAGVISALACMVKADSAILTDQTKELLARVFLALCDNPKDRGTIVAQGGGKALIPLALEGTDVGKVKAAHALAKIAAVSNPDIAFPGERVYEVVRPLVRLLDTQRDGLQNYEALLGLTNLSGRSDKLRQKIFKERALPDIENYMFENHDQLRQAATECMCNMVLHKEVQERFLADGNDRLKLVVLLCGEDDDKVQNAAAGALAMLTAAHKKLCLKMTQVTTQWLEILQRLCLHDQLSVQHRGLVIAYNLLAADAELAKKLVESELLEILTVVGKQEPDEKKAEVVQTARECLIKCMDYGFIKPVS

SEQ ID NO: 95701 - protein, 850 aa, Homo sapiens
  Payload ID: 19090
  Gene Name: unc-45 myosin chaperone B
  Uniprot ID: Q8IWX7
  ENSP ID: ENSP00000468335
MAEVEAVQLKEEGNRHFQLQDYKAATNSYSQALKLTKDKALLATLYRNRAACGLKTESYVQAASDASRAIDINSSDIKALYRRCQALEHLGKLDQAFKDVQRCATLEPRNQNFQEMLRRLNTSIQEKLRVQFSTDSRVQKMFEILLDENSEADKREKAANNLIVLGREEAGAEKIFQNNGVALLLQLLDTKKPELVLAAVRTLSGMCSGHQARATVILHAVRIDRICSLMAVENEEMSLAVCNLLQAIIDSLSGEDKREHRGKEEALVLDTKKDLKQITSHLLDMLVSKKVSGQGRDQALNLLNKNVPRKDLAIHDNSRTIYVVDNGLRKILKVVGQVPDLPSCLPLTDNTRMLASILINKLYDDLRCDPERDHFRKICEEYITGKFDPQDMDKNLNAIQTVSGILQGPFDLGNQLLGLKGVMEMMVALCGSERETDQLVAVEALIHASTKLSRATFIITNGVSLLKQIYKTTKNEKIKIRTLVTSDKTILYSVATTLVNCTNSYDVKEVIPELVQLAKFSKQHVPEEHPKDKKDFIDMRVKRLLKAGVISALACMVKADSAILTDQTKELLARVFLALCDNPKDRGTIVAQGGGKALIPLALEGTDVGKVKAAHALAKIAAVSNPDIAFPGERVYEVVRPLVRLLDTQRDGLQNYEALLGLTNLSGRSDKLRQKIFKERALPDIENYMFENHDQLRQAATECMCNMVLHKEVQERFLADGNDRLKLVVLLCGEDDDKVQNAAAGALAMLTAAHKKLCLKMTQVTTQWLEILQRLCLHDQLSVQHRGLVIAYNLLAADAELAKKLVESELLEILTVVGKQEPDEKKAEVVQTARECLIKCMDYGFIKPVS

SEQ ID NO: 95702 - protein, 518 aa, Homo sapiens
  Payload ID: 19091
  Gene Name: unc-5 family C-terminal like
  Uniprot ID: Q8IV45
  ENSP ID: ENSP00000244565
MCPQESSFQPSQFLLLVGVPVASVLLLAQCLRWHCPRRLLGACWTLNGQEEPVSQPTPQLENEVSRQHLPATLPEMVAFYQELHTPTQGQTMVRQLMHKLLVFSAREVDHRGGCLMLQDTGISLLIPPGAVAVGRQERVSLILVWDLSDAPSLSQAQGLVSPVVACGPHGASFLKPCTLTFKHCAEQPSHARTYSSNTTLLDAKVWRPLGRPGAHASRDECRIHLSHFSLYTCVLEAPVGREARKWLQLAVFCSPLVPGQSHLQLRIYFLNNTPCALQWALTNEQPHGGRLRGPCQLFDFNGARGDQCLKLTYISEGWENVDDSSCQLVPHLHIWHGKCPFRSFCFRRKAADENEDCSALTNEIIVTMHTFQDGLETKYMEILRFQASEEESWAAPPPVSQPPPCNRLPPELFEQLRMLLEPNSITGNDWRRLASHLGLCGMKIRFLSCQRSPAAAILELFEEQNGSLQELHYLMTVMERLDCASAIQNYLSGTHGGSPGPERGGARDNQGLELDEKL

SEQ ID NO: 95703 - protein, 518 aa, Homo sapiens; identical to SEQ ID NO: 95702
  Payload ID: 19091
  Gene Name: unc-5 family C-terminal like
  Uniprot ID: Q8IV45
  ENSP ID: ENSP00000362258

SEQ ID NO: 95704 - protein, 842 aa, Homo sapiens
  Payload ID: 19092
  Gene Name: unc-5 netrin receptor A
  Uniprot ID: Q6ZN44
  ENSP ID: ENSP00000332737
MAVRPGLWPALLGIVLAAWLRGSGAQQSATVANPVPGANPDLLPHFLVEPEDVYIVKNKPVLLVCKAVPATQIFFKCNGEWVRQVDHVIERSTDGSSGLPTMEVRINVSRQQVEKVFGLEEYWCQCVAWSSSGTTKSQKAYIRIAYLRKNFEQEPLAKEVSLEQGIVLPCRPPEGIPPAEVEWLRNEDLVDPSLDPNVYITREHSLVVRQARLADTANYTCVAKNIVARRRSASAAVIVYVDGSWSPWSKWSACGLDCTHWRSRECSDPAPRNGGEECQGTDLDTRNCTSDLCVHTASGPEDVALYVGLIAVAVCLVLLLLVLILVYCRKKEGLDSDVADSSILTSGFQPVSIKPSKADNPHLLTIQPDLSTTTTTYQGSLCPRQDGPSPKFQLTNGHLLSPLGGGRHTLHHSSPTSEAEEFVSRLSTQNYFRSLPRGTSNMTYGTFNFLGGRLMIPNTGISLLIPPDAIPRGKIYEIYLTLHKPEDVRLPLAGCQTLLSPIVSCGPPGVLLTRPVILAMDHCGEPSPDSWSLRLKKQSCEGSWEDVLHLGEEAPSHLYYCQLEASACYVFTEQLGRFALVGEALSVAAAKRLKLLLFAPVACTSLEYNIRVYCLHDTHDALKEVVQLEKQLGGQLIQEPRVLHFKDSYHNLRLSIHDVPSSLWKSKLLVSYQEIPFYHIWNGTQRYLHCTFTLERVSPSTSDLACKLWVWQVEGDGQSFSINFNITKDTRFAELLALESEAGVPALVGPSAFKIPFLIRQKIISSLDPPCRRGADWRTLAQKLHLDSHLSFFASKPSPTAMILNLWEARHFPNGNLSQLAAAVAGLGQPDAGLFTVSEAEC

SEQ ID NO: 95705 - protein, 344 aa, Homo sapiens
  Payload ID: 19092
  Gene Name: unc-5 netrin receptor A
  ENSP ID: ENSP00000421795
  MOD_RES (1)..(1): Any amino acid
XPGANPDLLPHFLVEPEDVYIVKNKPVLLVCKAVPATQIFFKCNGEWVRQVDHVIERSTDGSSGLPTMEVRINVSRQQVEKVFGLEEYWCQCVAWSSSGTTKSQKAYIRIAYLRKNFEQEPLAKEVSLEQGIVLPCRPPEGIPPAEVEWLRNEDLVDPSLDPNVYITREHSLVVRQARLADTANYTCVAKNIVARRRSASAAVIVYVNGGWSTWTEWSVCSASCGRGWQKRSRSCTNPAPLNGGAFCEGQNVQKTACATLCPVDGSWSPWSKWSACGLDCTHWRSRECSDPAPRNGGEECQGTDLDTRNCTSDLCVHTASGPEDVALYVGLIAVAVCLVLLLLV

SEQ ID NO: 95706 - protein, 84 aa, Homo sapiens
  Payload ID: 19092
  Gene Name: unc-5 netrin receptor A
  ENSP ID: ENSP00000424067
  MOD_RES (1)..(1): Any amino acid
XAQQSATVANPVPGANPDLLPHFLVEPEDVYIVKNKPVLLVCKAVPATQIFFKCNGEWVRQVDHVIERSTDGSSEGDREGWRPM

SEQ ID NO: 95707 - protein, 945 aa, Homo sapiens
  Payload ID: 19093
  Gene Name: unc-5 netrin receptor B
  Uniprot ID: Q8IZJ1
  ENSP ID: ENSP00000334329
MGARSGARGALLLALLLCWDPRLSQAGTDSGSEVLPDSFPSAPAEPLPYFLQEPQDAYIVKNKPVELRCRAFPATQIYFKCNGEWVSQNDHVTQEGLDEATGLRVREVQIEVSRQQVEELFGLEDYWCQCVAWSSAGTTKSRRAYVRIAYLRKNFDQEPLGKEVPLDHEVLLQCRPPEGVPVAEVEWLKNEDVIDPTQDTNFLLTIDHNLIIRQARLSDTANYTCVAKNIVAKRRSTTATVIVYVNGGWSSWAEWSPCSNRCGRGWQKRTRTCTNPAPLNGGAFCEGQAFQKTACTTICPVDGAWTEWSKWSACSTECAHWRSRECMAPPPQNGGRDCSGTLLDSKNCTDGLCMQNKKTLSDPNSHLLEASGDAALYAGLVVAIFVVVAILMAVGVVVYRRNCRDFDTDITDSSAALTGGFHPVNFKTARPSNPQLLHPSVPPDLTASAGIYRGPVYALQDSTDKIPMTNSPLLDPLPSLKVKVYSSSTTGSGPGLADGADLLGVLPPGTYPSDFARDTHFLHLRSASLGSQQLLGLPRDPGSSVSGTFGCLGGRLSIPGTGVSLLVPNGAIPQGKFYEMYLLINKAESTLPLSEGTQTVLSPSVTCGPTGLLLCRPVILTMPHCAEVSARDWIFQLKTQAHQGHWEEVVTLDEETLNTPCYCQLEPRACHILLDQLGTYVFTGESYSRSAVKRLQLAVFAPALCTSLEYSLRVYCLEDTPVALKEVLELERTLGGYLVEEPKPLMFKDSYHNLRLSLHDLPHAHWRSKLLAKYQEIPFYHIWSGSQKALHCTFTLERHSLASTELTCKICVRQVEGEGQIFQLHTTLAETPAGSLDTLCSAPGSTVTTQLGPYAFKIPLSIRQKICNSLDAPNSRGNDWRMLAQKLSMDRYLNYFATKASPTGVILDLWEALQQDDGDLNSLASALEEMGKSEMLVAVATDGDC

SEQ ID NO: 95708 - protein, 934 aa, Homo sapiens
  Payload ID: 19093
  Gene Name: unc-5 netrin receptor B
  Uniprot ID: Q8IZJ1
  ENSP ID: ENSP00000362288
MGARSGARGALLLALLLCWDPRLSQAGTDSGSEVLPDSFPSAPAEPLPYFLQEPQDAYIVKNKPVELRCRAFPATQIYFKCNGEWVSQNDHVTQEGLDEATGLRVREVQIEVSRQQVEELFGLEDYWCQCVAWSSAGTTKSRRAYVRIAYLRKNFDQEPLGKEVPLDHEVLLQCRPPEGVPVAEVEWLKNEDVIDPTQDTNFLLTIDHNLIIRQARLSDTANYTCVAKNIVAKRRSTTATVIVYVNGGWSSWAEWSPCSNRCGRGWQKRTRTCTNPAPLNGGAFCEGQAFQKTACTTICPVDGAWTEWSKWSACSTECAHWRSRECMAPPPQNGGRDCSGTLLDSKNCTDGLCMQMLEASGDAALYAGLVVAIFVVVAILMAVGVVVYRRNCRDFDTDITDSSAALTGGFHPVNFKTARPSNPQLLHPSVPPDLTASAGIYRGPVYALQDSTDKIPMTNSPLLDPLPSLKVKVYSSSTTGSGPGLADGADLLGVLPPGTYPSDFARDTHFLHLRSASLGSQQLLGLPRDPGSSVSGTFGCLGGRLSIPGTGVSLLVPNGAIPQGKFYEMYLLINKAESTLPLSEGTQTVLSPSVTCGPTGLLLCRPVILTMPHCAEVSARDWIFQLKTQAHQGHWEEVVTLDEETLNTPCYCQLEPRACHILLDQLGTYVFTGESYSRSAVKRLQLAVFAPALCTSLEYSLRVYCLEDTPVALKEVLELERTLGGYLVEEPKPLMFKDSYHNLRLSLHDLPHAHWRSKLLAKYQEIPFYHIWSGSQKALHCTFTLERHSLASTELTCKICVRQVEGEGQIFQLHTTLAETPAGSLDTLCSAPGSTVTTQLGPYAFKIPLSIRQKICNSLDAPNSRGNDWRMLAQKLSMDRYLNYFATKASPTGVILDLWEALQQDDGDLNSLASALEEMGKSEMLVAVATDGDC

SEQ ID NO: 95709 - protein, 931 aa, Homo sapiens
  Payload ID: 19094
  Gene Name: unc-5 netrin receptor C
  Uniprot ID: O95185
  ENSP ID: ENSP00000406022
MRKGLRATAARCGLGLGYLLQMLVLPALALLSASGTGSAAQDDDFFHELPETFPSDPPEPLPHFLIEPEEAYIVKNKPVNLYCKASPATQIYFKCNSEWVHQKDHIVDERVDETSGLIVREVSIEISRQQVEELFGPEDYWCQCVAWSSAGTTKSRKAYVRIAYLRKTFEQEPLGKEVSLEQEVLLQCRPPEGIPVAEVEWLKNEDIIDPVEDRNFYITIDHNLIIKQARLSDTANYTCVAKNIVAKRKSTTATVIVYVNGGWSTWTEWSVCNSRCGRGYQKRTRTCTNPAPLNGGAFCEGQSVQKIACTTLCPVDGRWTPWSKWSTCGTECTHWRRRECTAPAPKNGGKDCDGLVLQSKNCTDGLCMQTAPDSDDVALYVGIVIAVIVCLAISVVVALFVYRKNHRDFESDIIDSSALNGGFQPVNIKAARQDLLAVPPDLTSAAAMYRGPVYALHDVSDKIPMTNSPILDPLPNLKIKVYNTSGAVTPQDDLSEFTSKLSPQMTQSLLENEALSLKNQSLARQTDPSCTAFGSFNSLGGHLIVPNSGVSLLIPAGAIPQGRVYEMYVTVHRKETMRPPMDDSQTLLTPVVSCGPPGALLTRPVVLTMHHCADPNTEDWKILLKNQAAQGQWEDVVVVGEENFTTPCYIQLDAEACHILTENLSTYALVGHSTTKAAAKRLKLAIFGPLCCSSLEYSIRVYCLDDTQDALKEILHLERQMGGQLLEEPKALHFKGSTHNLRLSIHDIAHSLWKSKLLAKYQEIPFYHVWSGSQRNLHCTFTLERFSLNTVELVCKLCVRQVEGEGQIFQLNCTVSEEPTGIDLPLLDPANTITTVTGPSAFSIPLPIRQKLCSSLDAPQTRGHDWRMLAHKLNLDRYLNYFATKSSPTGVILDLWEAQNFPDGNLSMLAAVLEEMGRHETVVSLAAEGQY

SEQ ID NO: 95710 - protein, 260 aa, Homo sapiens
  Payload ID: 19094
  Gene Name: unc-5 netrin receptor C
  ENSP ID: ENSP00000425117
MRKGLRATAARCGLGLGYLLQMLVLPALALLSASGTGSAAQDDDFFHELPETFPSDPPEPLPHFLIEPEEAYIVKNKPVNLYCKASPATQIYFKCNSEWVHQKDHIVDERVDETSGLIVREVSIEISRQQVEELFGPEDYWCQCVAWSSAGTTKSRKAYVRIAYLRKTFEQEPLGKEVSLEQEVLLQCRPPEGIPVAEVEWLKNEDIIDPVEDRNFYITIDHNLIIKQARLSDTANYTCVAKNIVAKRKSTTATVIVYGP

SEQ ID NO: 95711 - protein, 597 aa, Homo sapiens
  Payload ID: 19094
  Gene Name: unc-5 netrin receptor C
  Uniprot ID: O95185
  ENSP ID: ENSP00000426153
MRKGLRATAARCGLGLGYLLQMLVLPALALLSASGTGSAAQDDDFFHELPETFPSDPPEPLPHFLIEPEEAYIVKNKPVNLYCKASPATQIYFKCNSEWVHQKDHIVDERVDETSGLIVREVSIEISRQQVEELFGPEDYWCQCVAWSSAGTTKSRKAYVRIAYLRKTFEQEPLGKEVSLEQEVLLQCRPPEGIPVAEVEWLKNEDIIDPVEDRNFYITIDHNLIIKQARLSDTANYTCVAKNIVAKRKSTTATVIVYVNGGWSTWTEWSVCNSRCGRGYQKRTRTCTNPAPLNGGAFCEGQSVQKIACTTLCPVDGRWTPWSKWSTCGTECTHWRRRECTAPAPKNGGKDCDGLVLQSKNCTDGLCMQSFIYPISTEQRTQNEYGFSSAPDSDDVALYVGIVIAVIVCLAISVVVALFVYRKNHRDFESDIIDSSALNGGFQPVNIKAARQDLLAVPPDLTSAAAMYRGPVYALHDVSDKIPMTNSPILDPLPNLKIKVYNTSGAVTPQDDLSEFTSKLSPQMTQSLLENEALSLKNQSLARQTDPSCTAFGSFNSLGGHLIVPNSGVSLLIPAGAIPQGRVYEMYVTVHRKETMR

SEQ ID NO: 95712 - protein, 745 aa, Homo sapiens
  Payload ID: 19094
  Gene Name: unc-5 netrin receptor C
  ENSP ID: ENSP00000426924
MRKGLRATAARCGLGLGYLLQMLVLPALALLSASGTGSAAQDDDFFHELPETFPSDPPEPLPHFLIEPEEAYIVKNKPVNLYCKASPATQIYFKCNSEWVHQKDHIVDERVDETSGLIVREVSIEISRQQVEELFGPEDYWCQCVAWSSAGTTKSRKAYVRIAYLRKTFEQEPLGKEVSLEQEVLLQCRPPEGIPVAEVEWLKNEDIIDPVEDRNFYITIDHNLIIKQARLSDTANYTCVAKNIVAKRKSTTATVIVYVNGGWSTWTEWSVCNSRCGRGYQKRTRTCTNPAPLNGGAFCEGQSVQKIACTTLCPVDGRWTPWSKWSTCGTECTHWRRRECTAPAPKNGGKDCDGLVLQSKNCTDGLCMQSFIYPISTEQRTQNEYGFSSAPDSDDVALYVGIVIAVIVCLAISVVVALFVYRKNHRDFESDIIDSSALNGGFQPVNIKAARQDLLAVPPDLTSAAAMYRGPVYALHDVSDKIPMTNSPILDPLPNLKIKVYNTSGAVTPQDDLSEFTSKLSPQMTQSLLENEALSLKNQSLARQTDPSCTAFGSFNSLGGHLIVPNSGVSLLIPAGAIPQGRVYEMYVTVHRKETMRPPMDDSQTLLTPVVSCGPPGALLTRPVVLTMHHCADPNTEDWKILLKNQAAQGQWEDVVVVGEENFTTPCYIQLDAEACHILTENLSTYALVGHSTTKAAAKRLKLAIFGPLCCSSLEYSIRVYCLDDTQDALKEILHLERQMGGQLL

SEQ ID NO: 95713 - protein, 890 aa, Homo sapiens
  Payload ID: 19094
  Gene Name: unc-5 netrin receptor C
  ENSP ID: ENSP00000483905
DDDFFHELPETFPSDPPEPLPHFLIEPEEAYIVKNKPVNLYCKASPATQIYFKCNSEWVHQKDHIVDERVDETSGLIVREVSIEISRQQVEELFGPEDYWCQCVAWSSAGTTKSRKAYVRIAYLRKTFEQEPLGKEVSLEQEVLLQCRPPEGIPVAEVEWLKNEDIIDPVEDRNFYITIDHNLIIKQARLSDTANYTCVAKNIVAKRKSTTATVIVYVNGGWSTWTEWSVCNSRCGRGYQKRTRTCTNPAPLNGGAFCEGQSVQKIACTTLCPVDGRWTPWSKWSTCGTECTHWRRRECTAPAPKNGGKDCDGLVLQSKNCTDGLCMQTAPDSDDVALYVGIVIAVIVCLAISVVVALFVYRKNHRDFESDIIDSSALNGGFQPVNIKAARQDLLAVPPDLTSAAAMYRGPVYALHDVSDKIPMTNSPILDPLPNLKIKVYNTSGAVTPQDDLSEFTSKLSPQMTQSLLENEALSLKNQSLARQTDPSCTAFGSFNSLGGHLIVPNSGVSLLIPAGAIPQGRVYEMYVTVHRKETMRPPMDDSQTLLTPVVSCGPPGALLTRPVVLTMHHCADPNTEDWKILLKNQAAQGQWEDVVVVGEENFTTPCYIQLDAEACHILTENLSTYALVGHSTTKAAAKRLKLAIFGPLCCSSLEYSIRVYCLDDTQDALKEILHLERQMGGQLLEEPKALHFKGSTHNLRLSIHDIAHSLWKSKLLAKYQEIPFYHVWSGSQRNLHCTFTLERFSLNTVELVCKLCVRQVEGEGQIFQLNCTVSEEPTGIDLPLLDPANTITTVTGPSAFSIPLPIRQKLCSSLDAPQTRGHDWRMLAHKLNLDRYLNYFATKSSPTGVILDLWEAQNFPDGNLSMLAAVLEEMGRHETVVSLAAEGQY

SEQ ID NO: 95714 - protein, 884 aa, Homo sapiens
  Payload ID: 19095
  Gene Name: unc-5 netrin receptor D
  ENSP ID: ENSP00000287272
MGRAAATAGGGGGARRWLPWLGLCFWAAGTAAARGTDNGEALPESIPSAPGTLPHFIEEPDDAYIIKSNPIALRCKARPAMQIFFKCNGEWVHQNEHVSEETLDESSGLKVREVFINVTRQQVEDFHGPEDYWCQCVAWSHLGTSKSRKASVRIAYLRKNFEQDPQGREVPIEGMIVLHCRPPEGVPAAEVEWLKNEEPIDSEQDENIDTRADHNLIIRQARLSDSGNYTCMAANIVAKRRSLSATVVVYVDGSWEVWSEWSVCSPECEHLRIRECTAPPPRNGGKFCEGLSQESENCTDGLCILDKKPLHEIKPQSIENASDIALYSGLGAAVVAVAVLVIGVTLYRRSQSDYGVDVIDSSALTGNSLLLNSAMQPDLTVSRTYSGPICLQDPLDKELMTESSLFNPLSDIKVKVQSSFMVSLGVSERAEYHGKNHSRTFPHGNNHSFSTMHPRNKMPYIQNLSSLPTRTELRTTGVFGHLGGRLVMPNTGVSLLIPHGAIPEENSWEIYMSINQGEPSLQSDGSEVLLSPEVTCGPPDMIVTTPFALTIPHCADVSSEHWNIHLKKRTQQGKWEEVMSVEDESTSCYCLLDPFACHVLLDSFGTYALTGEPITDCAVKQLKVAVFGCMSCNSLDYNLRVYCVDNTPCAFQEVVSDERHQGGQLLEEPKLLHFKGNTFSLQISVLDIPPFLWRIKPFTACQEVPFSRVWCSNRQPLHCAFSLERYTPTTTQLSCKICIRQLKGHEQILQVQTSILESERETITFFAQEDSTFPAQTGPKAFKIPYSIRQRICATFDTPNAKGKDWQMLAQKNSINRNLSYFATQSSPSAVILNLWEARHQHDGDLDSLACALEEIGRTHTKLSNISESQLDEADFNYSRQNGL

SEQ ID NO: 95715 - protein, 953 aa, Homo sapiens
  Payload ID: 19095
  Gene Name: unc-5 netrin receptor D
  Uniprot ID: Q6UXZ4
  ENSP ID: ENSP00000385143
MGRAAATAGGGGGARRWLPWLGLCFWAAGTAAARGTDNGEALPESIPSAPGTLPHFIEEPDDAYIIKSNPIALRCKARPAMQIFFKCNGEWVHQNEHVSEETLDESSGLKVREVFINVTRQQVEDFHGPEDYWCQCVAWSHLGTSKSRKASVRIAYLRKNFEQDPQGREVPIEGMIVLHCRPPEGVPAAEVEWLKNEEPIDSEQDENIDTRADHNLIIRQARLSDSGNYTCMAANIVAKRRSLSATVVVYVNGGWSSWTEWSACNVRCGRGWQKRSRTCTNPAPLNGGAFCEGMSVQKITCTSLCPVDGSWEVWSEWSVCSPECEHLRIRECTAPPPRNGGKFCEGLSQESENCTDGLCILDKKPLHEIKPQSIENASDIALYSGLGAAVVAVAVLVIGVTLYRRSQSDYGVDVIDSSALTGGFQTFNFKTVRQGNSLLLNSAMQPDLTVSRTYSGPICLQDPLDKELMTESSLFNPLSDIKVKVQSSFMVSLGVSERAEYHGKNHSRTFPHGNNHSFSTMHPRNKMPYIQNLSSLPTRTELRTTGVFGHLGGRLVMPNTGVSLLIPHGAIPEENSWEIYMSINQGEPSLQSDGSEVLLSPEVTCGPPDMIVTTPFALTIPHCADVSSEHWNIHLKKRTQQGKWEEVMSVEDESTSCYCLLDPFACHVLLDSFGTYALTGEPITDCAVKQLKVAVFGCMSCNSLDYNLRVYCVDNTPCAFQEVVSDERHQGGQLLEEPKLLHFKGNTFSLQISVLDIPPFLWRIKPFTACQEVPFSRVWCSNRQPLHCAFSLERYTPTTTQLSCKICIRQLKGHEQILQVQTSILESERETITFFAQEDSTFPAQTGPKAFKIPYSIRQRICATFDTPNAKGKDWQMLAQKNSINRNLSYFATQSSPSAVILNLWEARHQHDGDLDSLACALEEIGRTHTKLSNISESQLDEADFNYSRQNGL

SEQ ID NO: 95716 - protein, 886 aa, Homo sapiens
  Payload ID: 19095
  Gene Name: unc-5 netrin receptor D
  ENSP ID: ENSP00000392739
MGRAAATAGGGGGARRWLPWLGLCFWAAGTAAARGTDNGEALPESIPSAPGTLPHFIEEPDDAYIIKSNPIALRCKARPAMQIFFKCNGEWVHQNEHVSEETLDESSGLKVREVFINVTRQQVEDFHGPEDYWCQCVAWSHLGTSKSRKASVRIAYLRKNFEQDPQGREVPIEGMIVLHCRPPEGVPAAEVEWLKNEEPIDSEQDENIDTRADHNLIIRQARLSDSGNYTCMAANIVAKRRSLSATVVVYVDGSWEVWSEWSVCSPECEHLRIRECTAPPPRNGGKFCEGLSQESENCTDGLCILGIENASDIALYSGLGAAVVAVAVLVIGVTLYRRSQSDYGVDVIDSSALTGGFQTFNFKTVRQGNSLLLNSAMQPDLTVSRTYSGPICLQDPLDKELMTESSLFNPLSDIKVKVQSSFMVSLGVSERAEYHGKNHSRTFPHGNNHSFSTMHPRNKMPYIQNLSSLPTRTELRTTGVFGHLGGRLVMPNTGVSLLIPHGAIPEENSWEIYMSINQGEPSLQSDGSEVLLSPEVTCGPPDMIVTTPFALTIPHCADVSSEHWNIHLKKRTQQGKWEEVMSVEDESTSCYCLLDPFACHVLLDSFGTYALTGEPITDCAVKQLKVAVFGCMSCNSLDYNLRVYCVDNTPCAFQEVVSDERHQGGQLLEEPKLLHFKGNTFSLQISVLDIPPFLWRIKPFTACQEVPFSRVWCSNRQPLHCAFSLERYTPTTTQLSCKICIRQLKGHEQILQVQTSILESERETITFFAQEDSTFPAQTGPKAFKIPYSIRQRICATFDTPNAKGKDWQMLAQKNSINRNLSYFATQSSPSAVILNLWEARHQHDGDLDSLACALEEIGRTHTKLSNISESQLDEADFNYSRQNGL

SEQ ID NO: 95717 - protein, 948 aa, Homo sapiens
  Payload ID: 19095
  Gene Name: unc-5 netrin receptor D
  Uniprot ID: Q6UXZ4
  ENSP ID: ENSP00000394303
MILVLVKALSDVCAGTSGFLLDFSSQTSPGTDNGEALPESIPSAPGTLPHFIEEPDDAYIIKSNPIALRCKARPAMQIFFKCNGEWVHQNEHVSEETLDESSGLKVREVFINVTRQQVEDFHGPEDYWCQCVAWSHLGTSKSRKASVRIAYLRKNFEQDPQGREVPIEGMIVLHCRPPEGVPAAEVEWLKNEEPIDSEQDENIDTRADHNLIIRQARLSDSGNYTCMAANIVAKRRSLSATVVVYVNGGWSSWTEWSACNVRCGRGWQKRSRTCTNPAPLNGGAFCEGMSVQKITCTSLCPVDGSWEVWSEWSVCSPECEHLRIRECTAPPPRNGGKFCEGLSQESENCTDGLCILDKKPLHEIKPQSIENASDIALYSGLGAAVVAVAVLVIGVTLYRRSQSDYGVDVIDSSALTGGFQTFNFKTVRQGNSLLLNSAMQPDLTVSRTYSGPICLQDPLDKELMTESSLFNPLSDIKVKVQSSFMVSLGVSERAEYHGKNHSRTFPHGNNHSFSTMHPRNKMPYIQNLSSLPTRTELRTTGVFGHLGGRLVMPNTGVSLLIPHGAIPEENSWEIYMSINQGEPSLQSDGSEVLLSPEVTCGPPDMIVTTPFALTIPHCADVSSEHWNIHLKKRTQQGKWEEVMSVEDESTSCYCLLDPFACHVLLDSFGTYALTGEPITDCAVKQLKVAVFGCMSCNSLDYNLRVYCVDNTPCAFQEVVSDERHQGGQLLEEPKLLHFKGNTFSLQISVLDIPPFLWRIKPFTACQEVPFSRVWCSNRQPLHCAFSLERYTPTTTQLSCKICIRQLKGHEQILQVQTSILESERETITFFAQEDSTFPAQTGPKAFKIPYSIRQRICATFDTPNAKGKDWQMLAQKNSINRNLSYFATQSSPSAVILNLWEARHQHDGDLDSLACALEEIGRTHTKLSNISESQLDEADFNYSRQNGL

SEQ ID NO: 95718 - protein, 529 aa, Homo sapiens
  Payload ID: 19095
  Gene Name: unc-5 netrin receptor D
  ENSP ID: ENSP00000397211
MELMIQEKSFGNSLLLNSAMQPDLTVSRTYSGPICLQDPLDKELMTESSLFNPLSDIKVKVQSSFMVSLGVSERAEYHGKNHSRTFPHGNNHSFSTMHPRNKMPYIQNLSSLPTRTELRTTGVFGHLGGRLVMPNTGVSLLIPHGAIPEENSWEIYMSINQGEPSLQSDGSEVLLSPEVTCGPPDMIVTTPFALTIPHCADVSSEHWNIHLKKRTQQGKWEEVMSVEDESTSCYCLLDPFACHVLLDSFGTYALTGEPITDCAVKQLKVAVFGCMSCNSLDYNLRVYCVDNTPCAFQEVVSDERHQGGQLLEEPKLLHFKGNTFSLQISVLDIPPFLWRIKPFTACQEVPFSRVWCSNRQPLHCAFSLERYTPTTTQLSCKICIRQLKGHEQILQVQTSILESERETITFFAQEDSTFPAQTGPKAFKIPYSIRQRICATFDTPNAKGKDWQMLAQKNSINRNLSYFATQSSPSAVILNLWEARHQHDGDLDSLACALEEIGRTHTKLSNISESQLDEADFNYSRQNGL

SEQ ID NO: 95719 - protein, 958 aa, Homo sapiens
  Payload ID: 19095
  Gene Name: unc-5 netrin receptor D
  ENSP ID: ENSP00000412652
MGRAAATAGGGGGARRWLPWLGLCFWAAGTAAARGTDNGEALPESIPSAPGTLPHFIEEPDDAYIIKSNPIALRCKARPAMQIFFKCNGEWVHQNEHVSEETLDESSGLKVREVFINVTRQQVEDFHGPEDYWCQCVAWSHLGTSKSRKASVRIAYLRKNFEQDPQGREVPIEGMIVLHCRPPEGVPAAEVEWLKNEEPIDSEQDENIDTRADHNLIIRQARLSDSGNYTCMAANIVAKRRSLSATVVVYVNGGWSSWTEWSACNVRCGRGWQKRSRTCTNPAPLNGGAFCEGMSVQKITCTSLCPVDGSWEVWSEWSVCSPECEHLRIRECTAPPPRNGGKFCEGLSQESENCTDGLCILDKKPLHEIKPQRWSRRGIENASDIALYSGLGAAVVAVAVLVIGVTLYRRSQSDYGVDVIDSSALTGGFQTFNFKTVRQGNSLLLNSAMQPDLTVSRTYSGPICLQDPLDKELMTESSLFNPLSDIKVKVQSSFMVSLGVSERAEYHGKNHSRTFPHGNNHSFSTMHPRNKMPYIQNLSSLPTRTELRTTGVFGHLGGRLVMPNTGVSLLIPHGAIPEENSWEIYMSINQGEPSLQSDGSEVLLSPEVTCGPPDMIVTTPFALTIPHCADVSSEHWNIHLKKRTQQGKWEEVMSVEDESTSCYCLLDPFACHVLLDSFGTYALTGEPITDCAVKQLKVAVFGCMSCNSLDYNLRVYCVDNTPCAFQEVVSDERHQGGQLLEEPKLLHFKGNTFSLQISVLDIPPFLWRIKPFTACQEVPFSRVWCSNRQPLHCAFSLERYTPTTTQLSCKICIRQLKGHEQILQVQTSILESERETITFFAQEDSTFPAQTGPKAFKIPYSIRQRICATFDTPNAKGKDWQMLAQKNSINRNLSYFATQSSPSAVILNLWEARHQHDGDLDSLACALEEIGRTHTKLSNISESQLDEADFNYSRQNGL

SEQ ID NO: 95720 - protein, 259 aa, Homo sapiens
  Payload ID: 19096
  Gene Name: unc-50 homolog (C. elegans)
  Uniprot ID: Q53HI1
  ENSP ID: ENSP00000350409
MLPSTSVNSLVQGNGVLNSRDAARHTAGAKRYKYLRRLFRFRQMDFEFAAWQMLYLFTSPQRVYRNFHYRKQTKDQWARDDPAFLVLLSIWLCVSTIGFGFVLDMGFFETIKLLLWVVLIDCVGVGLLIATLMWFISNKYLVKRQSRDYDVEWGYAFDVHLNAFYPLLVILHFIQLFFINHVILTDTFIGYLVGNTLWLVAVGYYIYVTFLGYSALPFLKNTVILLYPFAPLILLYGLSLALGWNFTHTLCSFYKYRVK

SEQ ID NO: 95721 - protein, 128 aa, Homo sapiens
  Payload ID: 19096
  Gene Name: unc-50 homolog (C. elegans)
  ENSP ID: ENSP00000377131
  MOD_RES (1)..(1): Any amino acid
XFISNKYLVKRQSRDYDVEWGYAFDVHLNAFYPLLVILHFIQLFFINHVILTDTFIGYLVGNTLWLVAVGYYIYVTFLGYSVWIPFFSSIAIFEKYSNSSVSICTSDSALRAFPGTGMELHPYSLFFL

SEQ ID NO: 95722 - protein, 276 aa, Homo sapiens
  Payload ID: 19096
  Gene Name: unc-50 homolog (C. elegans)
  ENSP ID: ENSP00000386466
MFLQNTCKRNVFLPSRKMLPSTSVNSLVQGNGVLNSRDAARHTAGAKRYKYLRRLFRFRQMDFEFAAWQMLYLFTSPQRVYRNFHYRKQTKDQWARDDPAFLVLLSIWLCVSTIGFGFVLDMGFFETIKLLLWVVLIDCVGVGLLIATLMWFISNKYLVKRQSRDYDVEWGYAFDVHLNAFYPLLVILHFIQLFFINHVILTDTFIGYLVGNTLWLVAVGYYIYVTFLGYSALPFLKNTVILLYPFAPLILLYGLSLALGWNFTHTLCSFYKYRVK

SEQ ID NO: 95723 - protein, 276 aa, Homo sapiens; identical to SEQ ID NO: 95722
  Payload ID: 19096
  Gene Name: unc-50 homolog (C. elegans)
  ENSP ID: ENSP00000387146

SEQ ID NO: 95724 - protein, 92 aa, Homo sapiens
  Payload ID: 19096
  Gene Name: unc-50 homolog (C. elegans)
  ENSP ID: ENSP00000412224
  MOD_RES (1)..(1): Any amino acid
XFISNKYLVKRQSRDYDVEWGYAFDVHLNAFYPLLVILHFIQLFFINPLPFLKNTVILLYPFAPLILLYGLSLALGWNFTHTLCSFYKYRVK

SEQ ID NO: 95725 - protein, 1050 aa, Homo sapiens
  Payload ID: 19097
  Gene Name: unc-51 like autophagy activating kinase 1
  Uniprot ID: O75385
  ENSP ID: ENSP00000324560
MEPGRGGTETVGKFEFSRKDLIGHGAFAVVFKGRHREKHDLEVAVKCINKKNLAKSQTLLGKEIKILKELKHENIVALYDFQEMANSVYLVMEYCNGGDLADYLHAMRTLSEDTIRLFLQQIAGAMRLLHSKGIIHRDLKPQNILLSNPAGRRANPNSIRVKIADFGFARYLQSNMMAATLCGSPMYMAPEVIMSQHYDGKADLWSIGTIVYQCLTGKAPFQASSPQDLRLFYEKNKTLVPTIPRETSAPLRQLLLALLQRNHKDRMDFDEFFHHPFLDASPSVRKSPPVPVPSYPSSGSGSSSSSSSTSHLASPPSLGEMQQLQKTLASPADTAGFLHSSRDSGGSKDSSCDTDDFVMVPAQFPGDLVAEAPSAKPPPDSLMCSGSSLVASAGLESHGRTPSPSPPCSSSPSPSGRAGPFSSSRCGASVPIPVPTQVQNYQRIERNLQSPTQFQTPRSSAIRRSGSTSPLGFARASPSPPAHAEHGGVLARKMSLGGGRPYTPSPQVGTIPERPGWSGTPSPQGAEMRGGRSPRPGSSAPEHSPRTSGLGCRLHSAPNLSDLHVVRPKLPKPPTDPLGAVFSPPQASPPQPSHGLQSCRNLRGSPKLPDFLQRNPLPPILGSPTKAVPSFDFPKTPSSQNLLALLARQGVVMTPPRNRTLPDLSEVGPFHGQPLGPGLRPGEDPKGPFGRSFSTSRLTDLLLKAAFGTQAPDPGSTESLQEKPMEIAPSAGFGGSLHPGARAGGTSSPSPVVFTVGSPPSGSTPPQGPRTRMFSAGPTGSASSSARHLVPGPCSEAPAPELPAPGHGCSFADPITANLEGAVTFEAPDLPEETLMEQEHTEILRGLRFTLLFVQHVLEIAALKGSASEAAGGPEYQLQESVVADQISLLSREWGFAEQLVLYLKVAELLSSGLQSAIDQIRAGKLCLSSTVKQVVRRLNELYKASVVSCQGLSLRLQRFFLDKQRLLDRIHSITAERLIFSHAVQMVQSAALDEMFQHREGCVPRYHKALLLLEGLQHMLSDQADIENVTKCKLCIERRLSALLTGICA

SEQ ID NO: 95726 - protein, 1036 aa, Homo sapiens
  Payload ID: 19098
  Gene Name: unc-51 like autophagy activating kinase 2
  Uniprot ID: Q8IYT8
  ENSP ID: ENSP00000354877
MEVVGDFEYSKRDLVGHGAFAVVFRGRHRQKTDWEVAIKSINKKNLSKSQILLGKEIKILKELQHENIVALYDVQELPNSVFLVMEYCNGGDLADYLQAKGTLSEDTIRVFLHQIAAAMRILHSKGIIHRDLKPQNILLSYANRRKSSVSGIRIKIADFGFARYLHSNMMAATLCGSPMYMAPEVIMSQHYDAKADLWSIGTVIYQCLVGKPPFQANSPQDLRMFYEKNRSLMPSIPRETSPYLANLLLGLLQRNQKDRMDFEAFFSHPFLEQGPVKKSCPVPVPMYSGSVSGSSCGSSPSCRFASPPSLPDMQHIQEENLSSPPLGPPNYLQVSKDSASTSSKNSSCDTDDFVLVPHNISSDHSCDMPVGTAGRRASNEFLVCGGQCQPTVSPHSETAPIPVPTQIRNYQRIEQNLTSTASSGTNVHGSPRSAVVRRSNTSPMGFLRPGSCSPVPADTAQTVGRRLSTGSSRPYSPSPLVGTIPEQFSQCCCGHPQGHDSRSRNSSGSPVPQAQSPQSLLSGARLQSAPTLTDIYQNKQKLRKQHSDPVCPSHTGAGYSYSPQPSRPGSLGTSPTKHLGSSPRSSDWFFKTPLPTIIGSPTKTTAPFKIPKTQASSNLLALVTRHGPAEEQSKDGNEPRECAHCLLVQGSERQRAEQQSKAVFGRSVSTGKLSDQQGKTPICRHQGSTDSLNTERPMDIAPAGACGGVLAPPAGTAASSKAVLFTVGSPPHSAAAPTCTHMFLRTRTTSVGPSNSGGSLCAMSGRVCVGSPPGPGFGSSPPGAEAAPSLRYVPYGASPPSLEGLITFEAPELPEETLMEREHTDTLRHLNVMLMFTECVLDLTAMRGGNPELCTSAVSLYQIQESVVVDQISQLSKDWGRVEQLVLYMKAAQLLAASLHLAKAQIKSGKLSPSTAVKQVVKNLNERYKFCITMCKKLTEKLNRFFSDKQRFIDEINSVTAEKLIYNCAVEMVQSAALDEMFQQTEDIVYRYHKAALLLEGLSRILQDPADIENVHKYKCSIERRLSALCHSTATV

SEQ ID NO: 95727 - protein, 1036 aa, Homo sapiens; identical to SEQ ID NO: 95726
  Payload ID: 19098
  Gene Name: unc-51 like autophagy activating kinase 2
  Uniprot ID: Q8IYT8
  ENSP ID: ENSP00000378914

SEQ ID NO: 95728 - protein, 198 aa, Homo sapiens
  Payload ID: 19098
  Gene Name: unc-51 like autophagy activating kinase 2
  ENSP ID: ENSP00000464892
  MOD_RES (1)..(1): Any amino acid
XAEQQSKAVFGRSVSTGKLSDQQGKTPICRHQGSTDSLNTERPMDIGSPPHSAAAPTCTHMFLRTRTTSVGPSNSGGSLCAMSGRVCVGSPPGPGFGSSPPGAEAAPSLRYVPYGASPPSLEGLITFEAPELPEETLMEREHTDTLRHLNVMLMFTECVLDLTAMRGGNPELCTSAVSLYQIQESVVVDQISQLSKDW

SEQ ID NO: 95729 - protein, 21 aa, Homo sapiens
  Payload ID: 19098
  Gene Name: unc-51 like autophagy activating kinase 2
  ENSP ID: ENSP00000465666
  MOD_RES (1)..(1): Any amino acid
XYLQGYIEHILRIIWTDMHHE

SEQ ID NO: 95730 - protein, 49 aa, Homo sapiens
  Payload ID: 19098
  Gene Name: unc-51 like autophagy activating kinase 2
  ENSP ID: ENSP00000467277
  MOD_RES (1)..(1): Any amino acid
XHENIVALYDVQSCSCRPGWSAMAQSQLIAPLPPEFKGFSCLSLLNSWD

SEQ ID NO: 95731 - protein, 472 aa, Homo sapiens
  Payload ID: 19099
  Gene Name: unc-51 like kinase 3
  Uniprot ID: Q6PHR2
  ENSP ID: ENSP00000400312
MAGPGWGPPRLDGFILTERLGSGTYATVYKAYAKKDTREVVAIKCVAKKSLNKASVENLLTEIEILKGIRHPHIVQLKDFQWDSDNIYLIMEFCAGGDLSRFIHTRRILPEKVARVFMQQLASALQFLHERNISHLDLKPQNILLSSLEKPHLKLADFGFAQHMSPWDEKHVLRGSPLYMAPEMVCQRQYDARVDLWSMGVILYEALFGQPPFASRSFSELEEKIRSNRVIELPLRPLLSRDCRDLLQRLLERDPSRRISFQDFFAHPWVDLEHMPSGESLGRATALVVQAVKKDQEGDSAAALSLYCKALDFFVPALHYEVDAQRKEAIKAKVGQYVSRAEELKAIVSSSNQALLRQGTSARDLLREMARDKPRLLAALEVASAAMAKEEAAGGEQDALDLYQHSLGELLLLLAAEPPGRRRELLHTEVQNLMARAEYLKEQVKMRESRWEADTLDKEGLSESVRSSCTLQ

SEQ ID NO: 95732 - protein, 50 aa, Homo sapiens
  Payload ID: 19099
  Gene Name: unc-51 like kinase 3
  ENSP ID: ENSP00000454583
MQRNGSASRGLEKTRLRLCREARIPESAFLTGLTRESWEARCWCAVEGHS

SEQ ID NO: 95733 - protein, 41 aa, Homo sapiens
  Payload ID: 19099
  Gene Name: unc-51 like kinase 3
  ENSP ID: ENSP00000455199
MAGPGWGPPRLDGFILTERLGSGTYATVYKAYAKNAKKWIS

SEQ ID NO: 95734 - protein, 84 aa, Homo sapiens
  Payload ID: 19099
  Gene Name: unc-51 like kinase 3
  ENSP ID: ENSP00000455395
MAGPGWGPPRLDGFILTERLGSGTYATVYKAYAKKDTREVVAIKCVAKKSLNKASVENLLTEIEILKGIRHPHIVQLKDFQDSA

SEQ ID NO: 95735 - protein, 470 aa, Homo sapiens
  Payload ID: 19099
  Gene Name: unc-51 like kinase 3
  Uniprot ID: Q6PHR2
  ENSP ID: ENSP00000456051
MAGPGWGPPRLDGFILTERLGSGTYATVYKAYAKKDTREVVAIKCVAKKSLNKASVENLLTEIEILKGIRHPHIVQLKDFQWDSDNIYLIMEFCAGGDLSRFIHTRRILPEKVARVFMQQLASALQFLHERNISHLDLKPQNILLSSLEKPHLKLADFGFAQHMSPWDEKHVLRGSPLYMAPEMVCQRQYDARVDLWSMGVILYEALFGQPPFASRSFSELEEKIRSNRVIELPLRPLLSRDCRDLLQRLLERDPSRRISFQDFFAHPWVDLEHMPSGESLGRATALVVQAVKKDQEGDSAAALSLYCKALDFFVPALHYEVDAQRKEAIKAKVGQYVSRAEELKAIVSSSNQALLRQGTSARDLLREMARDKPRLLAALEVASAAMAKEEAAGGEQDALDLYQHSLGELLLLLAAEPPGRRRELLHTEVQNLMARAEYLKEQMRESRWEADTLDKEGLSESVRSSCTLQ

SEQ ID NO: 95736 - protein, 50 aa, Homo sapiens; identical to SEQ ID NO: 95732
  Payload ID: 19099
  Gene Name: unc-51 like kinase 3
  ENSP ID: ENSP00000456296

SEQ ID NO: 95737 - protein, 61 aa, Homo sapiens
  Payload ID: 19099
  Gene Name: unc-51 like kinase 3
  ENSP ID: ENSP00000456510
MQRNGSASRGLEKTRLRLCREARIPESAFLTGLTRESWEARCWCAAESPNLLSRRRTLVKW

SEQ ID NO: 95738 - protein, 136 aa, Homo sapiens
  Payload ID: 19099
  Gene Name: unc-51 like kinase 3
  ENSP ID: ENSP00000457061
MAGPGWGPPRLDGFILTERLGSGTYATVYKAYAKKDTREVVAIKCVAKKSLNKASVENLLTEIEILKGIRHPHIVQLKDFQWDSDNIYLIMEFCAGGDLSRFIHTRRILPEKVARVFMQQLAPCNSCMNGISLTWI

SEQ ID NO: 95739 - protein, 42 aa, Homo sapiens
  Payload ID: 19099
  Gene Name: unc-51 like kinase 3
  ENSP ID: ENSP00000457305
MQRNGSASRGLEKTRLRLCREARIPESAFLTGLTRESWEARC

SEQ ID NO: 95740 - protein, 483 aa, Homo sapiens
  Payload ID: 19099
  Gene Name: unc-51 like kinase 3
  Uniprot ID: Q6PHR2
  ENSP ID: ENSP00000457853
MQRNGSASRGLEKTRLRLCREARIPESAFLTGLTRESWEARCWCAKDTREVVAIKCVAKKSLNKASVENLLTEIEILKGIRHPHIVQLKDFQWDSDNIYLIMEFCAGGDLSRFIHTRRILPEKVARVFMQQLASALQFLHERNISHLDLKPQNILLSSLEKPHLKLADFGFAQHMSPWDEKHVLRGSPLYMAPEMVCQRQYDARVDLWSMGVILYEALFGQPPFASRSFSELEEKIRSNRVIELPLRPLLSRDCRDLLQRLLERDPSRRISFQDFFAHPWVDLEHMPSGESLGRATALVVQAVKKDQEGDSAAALSLYCKALDFFVPALHYEVDAQRKEAIKAKVGQYVSRAEELKAIVSSSNQALLRQGTSARDLLREMARDKPRLLAALEVASAAMAKEEAAGGEQDALDLYQHSLGELLLLLAAEPPGRRRELLHTEVQNLMARAEYLKEQVKMRESRWEADTLDKEGLSESVRSSCTLQ

SEQ ID NO: 95741 - protein, 49 aa, Homo sapiens
  Payload ID: 19099
  Gene Name: unc-51 like kinase 3
  ENSP ID: ENSP00000457983
MQRNGSASRGLEKTRLRLCREARIPESAFLTGLTRESWEARCWCAVGHS

SEQ ID NO: 95742 - protein, 41 aa, Homo sapiens; identical to SEQ ID NO: 95733
  Payload ID: 19099
  Gene Name: unc-51 like kinase 3
  ENSP ID: ENSP00000486917

SEQ ID NO: 95743 - protein, 1275 aa, Homo sapiens
  Payload ID: 19100
  Gene Name: unc-51 like kinase 4
  Uniprot ID: Q96C45
  ENSP ID: ENSP00000301831
MENFILYEEIGRGSKTVVYKGRRKGTINFVAILCTDKCKRPEITNWVRLTREIKHKNIVTFHEWYETSNHLWLVVELCTGGSLKTVIAQDENLPEDVVREFGIDLISGLHHLHKLGILFCDISPRKILLEGPGTLKFSNFCLAKVEGENLEEFFALVAAEEGGGDNGENVLKKSMKSRVKGSPVYTAPEVVRGADFSISSDLWSLGCLLYEMFSGKPPFFSESISELTEKILCEDPLPPIPKDSSRPKASSDFINLLDGLLQRDPQKRLTWTRLLQHSFWKKAFAGADQESSVEDLSLSRNTMECSGPQDSKELLQNSQSRQAKGHKSGQPLGHSFRLENPTEFRPKSTLEGQLNESMFLLSSRPTPRTSTAVEVSPGEDMTHCSPQKTSPLTKITSGHLSQQDLESQMRELIYTDSDLVVTPIIDNPKIMKQPPVKFDAKILHLPTYSVDKLLFLKDQDWNDFLQQVCSQIDSTEKSMGASRAKLNLLCYLCVVAGHQEVATRLLHSPLFQLLIQHLRIAPNWDIRAKVAHVIGLLASHTAELQENTPVVEAIVLLTELIRENFRNSKLKQCLLPTLGELIYLVATQEEKKKNPRECWAVPLAAYTVLMRCLREGEERVVNHMAAKIIENVCTTFSAQSQGFITGEIGPILWYLFRHSTADSLRITAVSALCRITRHSPTAFQNVIEKVGLNSVINSLASAICKVQQYMLTLFAAMLSCGIHLQRLIQEKGFVSTIIRLLDSPSTCIRAKAFLVLLYILIYNREMLLLSCQARLVMYIERDSRKTTPGKEQQSGNEYLSKCLDLLICHIVQELPRILGDILNSLANVSGRKHPSTVQVKQLKLCLPLMPVVLHLVTSQVFRPQVVTEEFLFSYGTILSHIKSVDSGETNIDGAIGLTASEEFIKITLSAFEAIIQYPILLKDYRSTVVDYILPPLVSLVQSQNVEWRLFSLRLLSETTSLLVNQEFGDGKEKASVDSDSNLLALIRDVLLPQYEHILLEPDPVPAYALKLLVAMTEHNPTFTRLVEESKLIPLIFEVTLEHQESILGNTMQSVIALLSNLVACKDSNMELLYEQGLVSHICNLLTETATLCLDVDNKNNNEMAAPLLFSLLDILHSMLTYTSGIVRLALQAQKSGSGEDPQAAEDLLLLNRPLTDLISLLIPLLPNEDPEIFDVSSKCLSILVQLYGGENPDSLSPENVEIFAHLLTSKEDPKEQKLLLRILRRMITSNEKHLESLKNAGSLLRALERLAPGSGSFADSAVAPLALEILQAVGH

SEQ ID NO: 95744 - protein, 84 aa, Homo sapiens
  Payload ID: 19100
  Gene Name: unc-51 like kinase 4
  ENSP ID: ENSP00000391849
MENFILYEEIGRGSKTVVYKGRRKGTINFVAILCTDKCKRPEITNWVRLTREIKHKNIVTFHEWYETSNHLWLVVELCTGQDYG

SEQ ID NO: 95745 - protein, 84 aa, Homo sapiens; identical to SEQ ID NO: 95744
  Payload ID: 19100
  Gene Name: unc-51 like kinase 4
  ENSP ID: ENSP00000399382

SEQ ID NO: 95746 - protein, 84 aa, Homo sapiens; identical to SEQ ID NO: 95744
  Payload ID: 19100
  Gene Name: unc-51 like kinase 4
  ENSP ID: ENSP00000401414

SEQ ID NO: 95747 - protein, 580 aa, Homo sapiens
  Payload ID: 19100
  Gene Name: unc-51 like kinase 4
  ENSP ID: ENSP00000412187
MENFILYEEIGRGSKTVVYKGRRKGTINFVAILCTDKCKRPEITNWVRLTREIKHKNIVTFHEWYETSNHLWLVVELCTGGSLKTVIAQDENLPEDVVREFGIDLISGLHHLHKLGILFCDISPRKILLEGPGTLKFSNFCLAKVEGENLEEFFALVAAEEGGGDNGENVLKKSMKSRVKGSPVYTAPEVVRGADFSISSDLWSLGCLLYEMFSGKPPFFSESISELTEKILCEDPLPPIPKDSSRPKASSDFINLLDGLLQRDPQKRLTWTRLLQHSFWKKAFAGADQESSVEDLSLSRNTMECSGPQDSKELLQNSQSRQAKGHKSGQPLGHSFRLENPTEFRPKSTLEGQLNESMFLLSSRPTPRTSTAVEVSPGEDMTHCSPQKTSPLTKITSGHLSQQDLESQMRELIYTDSDLVVTPIIDNPKIMKQPPVKFDAKILHLPTYSVDKLLFLKDQDWNDFLQQVCSQIDSTEKSMGASRAKLNLLCYLCVVAGHQEVATRLLHSPLFQLLIQHLRIAPNWDIRAKVAHVIGLLASHTAELQENTPVVETTSSIGIGILNCLVQHSTPVPRQCLVYV

SEQ ID NO: 95748 - protein, 2458 aa, Homo sapiens
  Payload ID: 19101
  Gene Name: unc-79 homolog (C. elegans)
  Uniprot ID: Q9P2D8
  ENSP ID: ENSP00000256339
MISTLATFPPFLHKDIIEYLSTSFLPMAILGSSRREGVPAHVNLSASSMLMIAMQYTSNPVYHCQLLECLMKYKQEVWKDLLYVIAYGPSQVKPPAVQMLFHYWPNLKPPGAISEYRGLQYTAWNPIHCQHIECHNAINKPAVKMCIDPSLSVALGDKPPPLYLCEECSERIAGDHSEWLIDVLLPQAEISAICQKKNCSSHVRRAVVTCFSAGCCGRHGNRPVRYCKRCHSNHHSNEVGAAAETHLYQTSPPPINTRECGAEELVCAVEAVISLLKEAEFHAEQREHELNRRRQLGLSSSHHSLDNADFDNKDDDKHDQRLLSQFGIWFLVSLCTPSENTPTESLARLVAMVFQWFHSTAYMMDDEVGSLVEKLKPQFVTKWLKTVCDVRFDVMVMCLLPKPMEFARVGGYWDKSCSTVTQLKEGLNRILCLIPYNVINQSVWECIMPEWLEAIRTEVPDNQLKEFREVLSKMFDIELCPLPFSMEEMFGFISCRFTGYPSSVQEQALLWLHVLSELDIMVPLQLLISMFSDGVNSVKELANQRKSRVSELAGNLASRRVSVASDPGRRVQHNMLSPFHSPFQSPFRSPLRSPFRSPFKNFGHPGGRTIDFDCEDDEMNLNCFILMFDLLLKQMELQDDGITMGLEHSLSKDIISIINNVFQAPWGGSHTCQKDEKAIECNLCQSSILCYQLACELLERLAPKEESRLVEPTDSLEDSLLSSRPEFIIGPEGEEEENPASKHGENPGNCTEPVEHAAVKNDTERKFCYQQLPVTLRLIYTIFQEMAKFEEPDILFNMLNCLKILCLHGECLYIARKDHPQFLAYIQDHMLIASLWRVVKSEFSQLSSLAVPLLLHALSLPHGADIFWTIINGNFNSKDWKMRFEAVEKVAVICRFLDIHSVTKNHLLKYSLAHAFCCFLTAVEDVNPAVATRAGLLLDTIKRPALQGLCLCLDFQFDTVVKDRPTILSKLLLLHFLKQDIPALSWEFFVNRFETLSLEAQLHLDCNKEFPFPTTITAVRTNVANLSDAALWKIKRARFARNRQKSVRSLRDSVKGPVESKRALSLPETLTSKIRQQSPENDNTIKDLLPEDAGIDHQTVHQLITVLMKFMAKDESSAESDISSAKAFNTVKRHLYVLLGYDQQEGCFMIAPQKMRLSTCFNAFIAGIAQVMDYNINLGKHLLPLVVQVLKYCSCPQLRHYFQQPPRCSLWSLKPHIRQMWLKALLVILYKYPYRDCDISKILLHLIHITVNTLNAQYHSCKPHATAGPLYSDNSNISRYSEKEKGEIELAEYRETGALQDSLLHCVREESIPKKKLRSFKQKSLDIGNADSLLFTLDEHRRKSCIDRCDIEKPPTQAAYIAQRPNDPGRSRQNSATRPDNSEIPENPAMEGFPDARRPVIPEVRLNCMETFEVKVDSPVKPAPKEDLDLIDLSSDSTSGPEKHSILSTSDSDSLVFEPLPPLRIVESDEEEETMNQGDDGPSGKNAASSPSVPSHPSVLSLSTAPLVQVSVEDCSKDFSSKDSGNNQSAGNTDSALITLEDPMDAEGSSKPEELPEFSCGSPLTLKQKRDLLQKSFALPEMSLDDHPDPGTEGEKPGELMPSSGAKTVLLKVPEDAENPTESEKPDTSAESDTEQNPERKVEEDGAEESEFKIQIVPRQRKQRKIAVSAIQREYLDISFNILDKLGEQKDPDPSTKGLSTLEMPRESSSAPTLDAGVPETSSHSSISTQYRQMKRGSLGVLTMSQLMKRQLEHQSSAPHNISNWDTEQIQPGKRQCNVPTCLNPDLEGQPLRMRGATKSSLLSAPSIVSMFVPAPEEFTDEQPTVMTDKCHDCGAILEEYDEETLGLAIVVLSTFIHLSPDLAAPLLLDIMQSVGRLASSTTFSNQAESMMVPGNAAGVAKQFLRCIFHQLAPNGIFPQLFQSTIKDGTFLRTLASSLMDFNELSSIAALSQLLEGLNNKKNLPAGGAMIRCLENIATFMEALPMDSPSSLWTTISNQFQTFFAKLPCVLPLKCSLDSSLRIMICLLKIPSTNATRSLLEPFSKLLSFVIQNAVFTLAYLVELCGLCYRAFTKERDKFYLSRSVVLELLQALKLKSPLPDTNLLLLVQFICADAGTKLAESTILSKQMIASVPGCGTAAMECVRQYINEVLDFMADMHTLTKLKSHMKTCSQPLHEDTFGGHLKVGLAQIAAMDISRGNHRDNKAVIRYLPWLYHPPSAMQQGPKEFIECVSHIRLLSWLLLGSLTHNAVCPNASSPCLPIPLDAGSHVADHLIVILIGFPEQSKTSVLHMCSLFHAFIFAQLWTVYCEQSAVATNLQNQNEFSFTAILTALEFWSRVTPSILQLMAHNKVMVEMVCLHVISLMEALQECNSTIFVKLIPMWLPMIQSNIKHLSAGLQLRLQAIQNHVNHHSLRTLPGSGQSSAGLAALRKWLQCTQFKMAQVEIQSSEAASQFYPL

SEQ ID NO: 95749 - protein, 2635 aa, Homo sapiens
  Payload ID: 19101
  Gene Name: unc-79 homolog (C. elegans)
  Uniprot ID: Q9P2D8
  ENSP ID: ENSP00000376858
MSTKAEQFASKIRYLQEYHNRVLHNIYPVPSGTDIANTLKYFSQTLLSILSRTGKKENQDASNLTVPMTMCLFPVPFPLTPSLRPQVSSINPTVTRSLLYSVLRDAPSERGPQSRDAQLSDYPSLDYQGLYVTLVTLLDLVPLLQHGQHDLGQSIFYTTTCLLPFLNDDILSTLPYTMISTLATFPPFLHKDIIEYLSTSFLPMAILGSSRREGVPAHVNLSASSMLMIAMQYTSNPVYHCQLLECLMKYKQEVWKDLLYVIAYGPSQVKPPAVQMLFHYWPNLKPPGAISEYRGLQYTAWNPIHCQHIECHNAINKPAVKMCIDPSLSVALGDKPPPLYLCEECSERIAGDHSEWLIDVLLPQAEISAICQKKNCSSHVRRAVVTCFSAGCCGRHGNRPVRYCKRCHSNHHSNEVGAAAETHLYQTSPPPINTRECGAEELVCAVEAVISLLKEAEFHAEQREHELNRRRQLGLSSSHHSLDNADFDNKDDDKHDQRLLSQFGIWFLVSLCTPSENTPTESLARLVAMVFQWFHSTAYMMDDEVGSLVEKLKPQFVTKWLKTVCDVRFDVMVMCLLPKPMEFARVGGYWDKSCSTVTQLKEGLNRILCLIPYNVINQSVWECIMPEWLEAIRTEVPDNQLKEFREVLSKMFDIELCPLPFSMEEMFGFISCRFTGYPSSVQEQALLWLHVLSELDIMVPLQLLISMFSDGVNSVKELANQRKSRVSELAGNLASRRVSVASDPGRRVQHNMLSPFHSPFQSPFRSPLRSPFRSPFKNFGHPGGRTIDFDCEDDEMNLNCFILMFDLLLKQMELQDDGITMGLEHSLSKDIISIINNVFQAPWGGSHTCQKDEKAIECNLCQSSILCYQLACELLERLAPKEESRLVEPTDSLEDSLLSSRPEFIIGPEGEEEENPASKHGENPGNCTEPVEHAAVKNDTERKFCYQQLPVTLRLIYTIFQEMAKFEEPDILFNMLNCLKILCLHGECLYIARKDHPQFLAYIQDHMLIASLWRVVKSEFSQLSSLAVPLLLHALSLPHGADIFWTIINGNFNSKDWKMRFEAVEKVAVICRFLDIHSVTKNHLLKYSLAHAFCCFLTAVEDVNPAVATRAGLLLDTIKRPALQGLCLCLDFQFDTVVKDRPTILSKLLLLHFLKQDIPALSWEFFVNRFETLSLEAQLHLDCNKEFPFPTTITAVRTNVANLSDAALWKIKRARFARNRQKSVRSLRDSVKGPVESKRALSLPETLTSKIRQQSPENDNTIKDLLPEDAGIDHQTVHQLITVLMKFMAKDESSAESDISSAKAFNTVKRHLYVLLGYDQQEGCFMIAPQKMRLSTCFNAFIAGIAQVMDYNINLGKHLLPLVVQVLKYCSCPQLRHYFQQPPRCSLWSLKPHIRQMWLKALLVILYKYPYRDCDISKILLHLIHITVNTLNAQYHSCKPHATAGPLYSDNSNISRYSEKEKGEIELAEYRETGALQDSLLHCVREESIPKKKLRSFKQKSLDIGNADSLLFTLDEHRRKSCIDRCDIEKPPTQAAYIAQRPNDPGRSRQNSATRPDNSEIPENPAMEGFPDARRPVIPEVRLNCMETFEVKVDSPVKPAPKEDLDLIDLSSDSTSGPEKHSILSTSDSDSLVFEPLPPLRIVESDEEEETMNQGDDGPSGKNAASSPSVPSHPSVLSLSTAPLVQVSVEDCSKDFSSKDSGNNQSAGNTDSALITLEDPMDAEGSSKPEELPEFSCGSPLTLKQKRDLLQKSFALPEMSLDDHPDPGTEGEKPGELMPSSGAKTVLLKVPEDAENPTESEKPDTSAESDTEQNPERKVEEDGAEESEFKIQIVPRQRKQRKIAVSAIQREYLDISFNILDKLGEQKDPDPSTKGLSTLEMPRESSSAPTLDAGVPETSSHSSISTQYRQMKRGSLGVLTMSQLMKRQLEHQSSAPHNISNWDTEQIQPGKRQCNVPTCLNPDLEGQPLRMRGATKSSLLSAPSIVSMFVPAPEEFTDEQPTVMTDKCHDCGAILEEYDEETLGLAIVVLSTFIHLSPDLAAPLLLDIMQSVGRLASSTTFSNQAESMMVPGNAAGVAKQFLRCIFHQLAPNGIFPQLFQSTIKDGTFLRTLASSLMDFNELSSIAALSQLLEGLNNKKNLPAGGAMIRCLENIATFMEALPMDSPSSLWTTISNQFQTFFAKLPCVLPLKCSLDSSLRIMICLLKIPSTNATRSLLEPFSKLLSFVIQNAVFTLAYLVELCGLCYRAFTKERDKFYLSRSVVLELLQALKLKSPLPDTNLLLLVQFICADAGTKLAESTILSKQMIASVPGCGTAAMECVRQYINEVLDFMADMHTLTKLKSHMKTCSQPLHEDTFGGHLKVGLAQIAAMDISRGNHRDNKAVIRYLPWLYHPPSAMQQGPKEFIECVSHIRLLSWLLLGSLTHNAVCPNASSPCLPIPLDAGSHVADHLIVILIGFPEQSKTSVLHMCSLFHAFIFAQLWTVYCEQSAVATNLQNQNEFSFTAILTALEFWSRVTPSILQLMAHNKVMVEMVCLHVISLMEALQECNSTIFVKLIPMWLPMIQSNIKHLSAGLQLRLQAIQNHVNHHSLRTLPGSGQSSAGLAALRKWLQCTQFKMAQVEIQSSEAASQFYPL

SEQ ID NO: 95750 - protein, 2596 aa, Homo sapiens
  Payload ID: 19101
  Gene Name: unc-79 homolog (C. elegans)
  ENSP ID: ENSP00000450868
MSTKAEQFASKIRYLQEYHNRVLHNIYPVPSGTDIANTLKYFSQTLLSILSRTGKKENQDASNLTVPMTMCLFPVPFPLTPSLRPQVSSINPTVTRSLLYSVLRDAPSERGPQSRDAQLSDYPSLDYQGLYVTLVTLLDLVPLLQHGQHDLGQSIFYTTTCLLPFLNDDILSTLPYTMISTLATFPPFLHKDIIEYLSTSFLPMAILGSSRREGVPAHVNLSASSMLMIAMQYTSNPVYHCQLLECLMKYKQEVWKDLLYVIAYGPSQVKPPAVQMLFHYWPNLKPPGAISEYRGLQYTAWNPIHCQHIECHNAINKPAVKMCIDPSLSVALGDKPPPLYLCEECSERIAGDHSEWLIDVLLPQAEISAICQKKNCSSHVRRAVVTCFSAGCCGRHGNRPVRYCKRCHSNHHSNEVGAAAETHLYQTSPPPINTRECGAEELVCAVEAVISLLKEAEFHAEQREHELNRRRQLGLSSSHHSLDNADFDNKDDDKHDQRLLSQFGIWFLVSLCTPSENTPTESLARLVAMVFQWFHSTAYMMDDEVGSLVEKLKPQFVTKWLKTVCDVRFDVMVMCLLPKPMEFARVGGYWDKSCSTVTQLKEGLNRILCLIPYNVINQSVWECIMPEWLEAIRTEVPDNQLKEFREVLSKMFDIELCPLPFSMEEMFGFISCRFTGYPSSVQEQALLWLHVLSELDIMVPLQLLISMFSDGVNSVKELANQRKSRVSELAGNLASRRVSVASDPGRRVQHNMLSPFHSPFQSPFRSPLRSPFRSPFKNFGHPGGRTIDFDCEDDEMNLNCFILMFDLLLKQMELQDDGITMGLEHSLSKDIISIINNVFQAPWGGSHTCQKDEKAIECNLCQSSILCYQLACELLERLAPKEESRLVEPTDSLEDSLLSSRPEFIIGPEGEEEENPASKHGENPGNCTEPVEHAAVKNDTERKFCYQQLPVTLRLIYTIFQEMAKFEEPDILFNMLNCLKILCLHGECLYIARKDHPQFLAYIQDHMLIASLWRVVKSEFSQLSSLAVPLLLHALSLPHGADIFWTIINGNFNSKDWKMRFEAVEKVAVICRFLDIHSVTKNHLLKYSLAHAFCCFLTAVEDVNPAVATRAGLLLDTIKRPALQGLCLCLDFQFDTVVKDRPTILSKLLLLHFLKQDIPALSWEFFVNRFETLSLEAQLHLDCNKEFPFPTTITAVRTNVANLSDAALWKIKRARFARNRQKSVRSLRDSVKGPVESKRALSLPETLTSKIRQQSPENDNTIKDLLPEDAGIDHQTVHQLITVLMKFMAKDESSAESDISSAKAFNTVKRHLYVLLGYDQQEGCFMIAPQKMRLSTCFNAFIAGIAQVMDYNINLGKHLLPLVVQVLKYCSCPQLRHYFQQPPRCSLWSLKPHIRQMWLKALLVILYKYPYRDCDISKILLHLIHITVNTLNAQYHSCKPHATAGPLYSDNSNISRYSEKEKGEIELAEYRETGALQDSLLHCVREESIPKKKLRSFKQKSLDIGNADSLLFTLDEHRRKSCIDRCDIEKPPTQAAYIAQRPNDPGRSRQNSATRPDNSEIPENPAMEGFPDARRPVIPEVRLNCMETFEVKVDSPVKPAPKEDLDLIDLSSDSTSGPEKHSILSTSDSDSLVFEPLPPLRIVESDEEEETMNQGDDGPSGKNAASSPSVPSHPSVLSLSTAPLVQVSVEDCSKDFSSKDSGNNQSAGNTDSALITLEDPMDAEGSSKPEELPEFSCGSPLTLKQKRDLLQKSFALPEMSLDDHPDPGTEGEKPGELMPSSGAKTVLLKVPEDAENPTESEKPDTSAESDTEQNPERKVEEDGAEESEFKIQIVPRQRKQRKIAVSAIQREYLDISFNILDKLGEQKDPDPSTKGLSTLEMPRESSSAPTLDAGVPETSSHSSISKQIQPGKRQCNVPTCLNPDLEGQPLRMRGATKSSLLSAPSIVSMFVPAPEEFTDEQPTVMTDKCHDCGAILEEYDEETLGLAIVVLSTFIHLSPDLAAPLLLDIMQSVGRLASSTTFSNQAESMMVPGNAAGVAKQFLRCIFHQLAPNGIFPQLFQSTIKDGTFLRTLASSLMDFNELSSIAALSQLLEGLNNKKNLPAGGAMIRCLENIATFMEALPMDSPSSLWTTISNQFQTFFAKLPCVLPLKCSLDSSLRIMICLLKIPSTNATRSLLEPFSKLLSFVIQNAVFTLAYLVELCGLCYRAFTKERDKFYLSRSVVLELLQALKLKSPLPDTNLLLLVQFICADAGTKLAESTILSKQMIASVPGCGTAAMECVRQYINEVLDFMADMHTLTKLKSHMKTCSQPLHEDTFGGHLKVGLAQIAAMDISRGNHRDNKAVIRYLPWLYHPPSAMQQGPKEFIECVSHIRLLSWLLLGSLTHNAVCPNASSPCLPIPLDAGSHVADHLIVILIGFPEQSKTSVLHMCSLFHAFIFAQLWTVYCEQSAVATNLQNQNEFSFTAILTALEFWSRVTPSILQLMAHNKVMVEMVCLHVISLMEALQECNSTIFVKLIPMWLPMIQSNIKHLSAGLQLRLQAIQNHVNHHSLRTLPGSGQSSAGLAALRKWLQCTQFKMAQVEIQSSEAASQFYPL

SEQ ID NO: 95751 - protein, 2657 aa, Homo sapiens
  Payload ID: 19101
  Gene Name: unc-79 homolog (C. elegans)
  Uniprot ID: Q9P2D8
  ENSP ID: ENSP00000451360
MSTKAEQFASKIRYLQEYHNRVLHNIYPVPSGTDIANTLKYFSQTLLSILSRTGKKENQDASNLTVPMTMCLFPVPFPLTPSLRPQVSSINPTVTRSLLYSVLRDAPSERGPQSRDAQLSDYPSLDYQGLYVTLVTLLDLVPLLQHGQHDLGQSIFYTTTCLLPFLNDDILSTLPYTMISTLATFPPFLHKDIIEYLSTSFLPMAILGSSRREGVPAHVNLSASSMLMIAMQYTSNPVYHCQLLECLMKYKQEVWKDLLYVIAYGPSQVKPPAVQMLFHYWPNLKPPGAISEYRGLQYTAWNPIHCQHIECHNAINKPAVKMCIDPSLSVALGDKPPPLYLCEECSERIAGDHSEWLIDVLLPQAEISAICQKKNCSSHVRRAVVTCFSAGCCGRHGNRPVRYCKRCHSNHHSNEVGAAAETHLYQTSPPPINTRECGAEELVCAVEAVISLLKEAEFHAEQREHELNRRRQLGLSSSHHSLDNADFDNKDDDKHDQRLLSQFGIWFLVSLCTPSENTPTESLARLVAMVFQWFHSTAYMMDDEVGSLVEKLKPQFVTKWLKTVCDVRFDVMVMCLLPKPMEFARVGGYWDKSCSTVTQLKEGLNRILCLIPYNVINQSVWECIMPEWLEAIRTEVPDNQLKEFREVLSKMFDIELCPLPFSMEEMFGFISCRFTGYPSSVQEQALLWLHVLSELDIMVPLQLLISMFSDGVNSVKELANQRKSRVSELAGNLASRRVSVASDPGRRVQHNMLSPFHSPFQSPFRSPLRSPFRSPFKNFGHPGGRTIDFDCEDDEMNLNCFILMFDLLLKQMELQDDGITMGLEHSLSKDIISIINNVFQAPWGGSHTCQKDEKAIECNLCQSSILCYQLACELLERLAPKEESRLVEPTDSLEDSLLSSRPEFIIGPEGEEEENPASKHGENPGNCTEPVEHAAVKNDTERKFCYQQLPVTLRLIYTIFQEMAKFEEPDILFNMLNCLKILCLHGECLYIARKDHPQFLAYIQDHMLIASLWRVVKSEFSQLSSLAVPLLLHALSLPHGADIFWTIINGNFNSKDWKMRFEAVEKVAVICRFLDIHSVTKNHLLKYSLAHAFCCFLTAVEDVNPAVATRAGLLLDTIKRPALQGLCLCLDFQFDTVVKDRPTILSKLLLLHFLKQDIPALSWEFFVNRFETLSLEAQLHLDCNKEFPFPTTITAVRTNVANLSDAALWKIKRARFARNRQKSVRSLRDSVKGPVESKRALSLPETLTSKIPMRLTRHEQSAPALGGTPEQTPGQQSPENDNTIKDLLPEDAGIDHQTVHQLITVLMKFMAKDESSAESDISSAKAFNTVKRHLYVLLGYDQQEGCFMIAPQKMRLSTCFNAFIAGIAQVMDYNINLGKHLLPLVVQVLKYCSCPQLRHYFQQPPRCSLWSLKPHIRQMWLKALLVILYKYPYRDCDISKILLHLIHITVNTLNAQYHSCKPHATAGPLYSDNSNISRYSEKEKGEIELAEYRETGALQDSLLHCVREESIPKKKLRSFKQKSLDIGNADSLLFTLDEHRRKSCIDRCDIEKPPTQAAYIAQRPNDPGRSRQNSATRPDNSEIPENPAMEGFPDARRPVIPEVRLNCMETFEVKVDSPVKPAPKEDLDLIDLSSDSTSGPEKHSILSTSDSDSLVFEPLPPLRIVESDEEEETMNQGDDGPSGKNAASSPSVPSHPSVLSLSTAPLVQVSVEDCSKDFSSKDSGNNQSAGNTDSALITLEDPMDAEGSSKPEELPEFSCGSPLTLKQKRDLLQKSFALPEMSLDDHPDPGTEGEKPGELMPSSGAKTVLLKVPEDAENPTESEKPDTSAESDTEQNPERKVEEDGAEESEFKIQIVPRQRKQRKIAVSAIQREYLDISFNILDKLGEQKDPDPSTKGLSTLEMPRESSSAPTLDAGVPETSSHSSISTQYRQMKRGSLGVLTMSQLMKRQLEHQSSAPHNISNWDTEQIQPGKRQCNVPTCLNPDLEGQPLRMRGATKSSLLSAPSIVSMFVPAPEEFTDEQPTVMTDKCHDCGAILEEYDEETLGLAIVVLSTFIHLSPDLAAPLLLDIMQSVGRLASSTTFSNQAESMMVPGNAAGVAKQFLRCIFHQLAPNGIFPQLFQSTIKDGTFLRTLASSLMDFNELSSIAALSQLLEGLNNKKNLPAGGAMIRCLENIATFMEALPMDSPSSLWTTISNQFQTFFAKLPCVLPLKCSLDSSLRIMICLLKIPSTNATRSLLEPFSKLLSFVIQNAVFTLAYLVELCGLCYRAFTKERDKFYLSRSVVLELLQALKLKSPLPDTNLLLLVQFICADAGTKLAESTILSKQMIASVPGCGTAAMECVRQYINEVLDFMADMHTLTKLKSHMKTCSQPLHEDTFGGHLKVGLAQIAAMDISRGNHRDNKAVIRYLPWLYHPPSAMQQGPKEFIECVSHIRLLSWLLLGSLTHNAVCPNASSPCLPIPLDAGSHVADHLIVILIGFPEQSKTSVLHMCSLFHAFIFAQLWTVYCEQSAVATNLQNQNEFSFTAILTALEFWSRVTPSILQLMAHNKVMVEMVCLHVISLMEALQECNSTIFVKLIPMWLPMIQSNIKHLSAGLQLRLQAIQNHVNHHSLRTLPGSGQSSAGLAALRKWLQCTQFKMAQVEIQSSEAASQFYPL

SEQ ID NO: 95752 - protein, 2458 aa, Homo sapiens; identical to SEQ ID NO: 95748
  Payload ID: 19101
  Gene Name: unc-79 homolog (C. elegans)
  Uniprot ID: Q9P2D8
  ENSP ID: ENSP00000479521

SEQ ID NO: 95753 - protein, 2458 aa, Homo sapiens; identical to SEQ ID NO: 95748
  Payload ID: 19101
  Gene Name: unc-79 homolog (C. elegans)
  Uniprot ID: Q9P2D8
  ENSP ID: ENSP00000480937

SEQ ID NO: 95754 - protein, 2458 aa, Homo sapiens; identical to SEQ ID NO: 95748
  Payload ID: 19101
  Gene Name: unc-79 homolog (C. elegans)
  Uniprot ID: Q9P2D8
  ENSP ID: ENSP00000485969

SEQ ID NO: 95755 - protein, 2657 aa, Homo sapiens; identical to SEQ ID NO: 95751
  Payload ID: 19101
  Gene Name: unc-79 homolog (C. elegans)
  Uniprot ID: Q9P2D8
  ENSP ID: ENSP00000486167

SEQ ID NO: 95756 - protein, 2635 aa, Homo sapiens; identical to SEQ ID NO: 95749
  Payload ID: 19101
  Gene Name: unc-79 homolog (C. elegans)
  Uniprot ID: Q9P2D8
  ENSP ID: ENSP00000487436

SEQ ID NO: 95757 - protein, 2596 aa, Homo sapiens; identical to SEQ ID NO: 95750
  Payload ID: 19101
  Gene Name: unc-79 homolog (C. elegans)
  ENSP ID: ENSP00000487503

SEQ ID NO: 95758 - protein, 3234 aa, Homo sapiens
  Payload ID: 19102
  Gene Name: unc-80 homolog (C. elegans)
  Uniprot ID: Q8N2C7
  ENSP ID: ENSP00000272845
MVKRKSSEGQEQDGGRGIPLPIQTFLWRQTSAFLRPKLGKQYEASCVSFERVLVENKLHGLSPALSEAIQSISRWELVQAALPHVLHCTATLLSNRNKLGHQDKLGVAETKLLHTLHWMLLEAPQDCNNERFGGTDRGSSWGGSSSAFIHQVENQGSPGQPCQSSSNDEEENNRRKIFQNSMATVELFVFLFAPLVHRIKESDLTFRLASGLVIWQPMWEHRQPGVSGFTALVKPIRNIITAKRSSPINSQSRTCESPNQDARHLEGLQVVCETFQSDSISPKATISGCHRGNSFDGSLSSQTSQERGPSHSRASLVIPPCQRSRYATYFDVAVLRCLLQPHWSEEGTQWSLMYYLQRLRHMLEEKPEKPPEPDIPLLPRPRSSSMVAAAPSLVNTHKTQDLTMKCNEEEKSLSSEAFSKVSLTNLRRSAVPDLSSDLGMNIFKKFKSRKEDRERKGSIPFHHTGKRRPRRMGVPFLLHEDHLDVSPTRSTFSFGSFSGLGEDRRGIEKGGWQTTILGKLTRRGSSDAATEMESLSARHSHSHHTLVSDLPDPSNSHGENTVKEVRSQISTITVATFNTTLASFNVGYADFFNEHMRKLCNQVPIPEMPHEPLACANLPRSLTDSCINYSYLEDTEHIDGTNNFVHKNGMLDLSVVLKAVYLVLNHDISSRICDVALNIVECLLQLGVVPCVEKNRKKSENKENETLEKRPSEGAFQFKGVSGSSTCGFGGPAVSGAGDGGGEEGGGGDGGGGGGDGGGGGGGGGGPYEKNDKNQEKDESTPVSNHRLALTMLIKIVKSLGCAYGCGEGHRGLSGDRLRHQAQNCLTKLYKLDKMQFRQTMRDYVNKDSLNNVVDFLHALLGFCMEPVTDNKAGFGNNFTTVDNKSTAQNVEGIIVSAMFKSLITRCASTTHELHSPENLGLYCDIRQLVQFIKEAHGNVFRRVALSALLDSAEKLAPGKKVEENEQESKPAGSKRSEAGSIVDKGQVSSAPEECRSFMSGRPSQTPEHDEQMQGANLGRKDFWRKMFKSQSAASDTSSQSEQDTSECTTAHSGTTSDRRARSRSRRISLRKKLKLPIGKRNWLKRSSLSGLADGVEDLLDISSVDRLSFIRQSSKVKFTSAVKLSEGGPGSGMENGRDEEENFFKRLGCHSFDDHLSPNQDGGKSKNVVNLGAIRQGMKRFQFLLNCCEPGTIPDASILAAALDLEAPVVARAALFLECARFVHRCNRGNWPEWMKGHHVNITKKGLSRGRSPIVGNKRNQKLQWNAAKLFYQWGDAIGVRLNELCHGESESPANLLGLIYDEETKRRLRKEDEEEDFLDDSTVNPSKCGCPFALKMAACQLLLEITTFLRETFSCLPRPRTEPLVDLESCRLRLDPELDRHRYERKISFAGVLDENEDSKDSLHSSSHTLKSDAGVEEKKEGSPWSASEPSIEPEGMSNAGAEENYHRNMSWLHVMILLCNQQSFICTHVDYCHPHCYLHHSRSCARLVRAIKLLYGDSVDSLRESSNISSVALRGKKQKECSDKSCLRTPSLKKRVSDANLEGKKDSGMLKYIRLQVMSLSPAPLSLLIKAAPILTEEMYGDIQPAAWELLLSMDEHMAGAAAAMFLLCAVKVPEAVSDMLMSEFHHPETVQRLNAVLKFHTLWRFRYQVWPRMEEGAQQIFKIPPPSINFTLPSPVLGMPSVPMFDPPWVPQCSGSVQDPINEDQSKSFSARAVSRSHQRAEHILKNLQQEEEKKRLGREASLITAIPITQEACYEPTCTPNSEPEEEVEEVTNLASRRLSVSPSCTSSTSHRNYSFRRGSVWSVRSAVSAEDEEHTTEHTPNHHVPQPPQAVFPACICAAVLPIVHLMEDGEVREDGVAVSAVAQQVLWNCLIEDPSTVLRHFLEKLTISNRQDELMYMLRKLLLNIGDFPAQTSHILFNYLVGLIMYFVRTPCEWGMDAISATLTFLWEVVGYVEGLFFKDLKQTMKKEQCEVKLLVTASMPGTKTLVVHGQNECDIPTQLPVHEDTQFEALLKECLEFFNIPESQSTHYFLMDKRWNLIHYNKTYVRDIYPFRRSVSPQLNLVHMHPEKGQELIQKQVFTRKLEEVGRVLFLISLTQKIPTAHKQSHVSMLQEDLLRLPSFPRSAIDAEFSLFSDPQAGKELFGLDTLQKSLWIQLLEEMFLGMPSEFPWGDEIMLFLNVFNGALILHPEDSALLRQYAATVINTAVHFNHLFSLSGYQWILPTMLQVYSDYESNPQLRQAIEFACHQFYILHRKPFVLQLFASVAPLLEFPDAANNGPSKGVSAQCLFDLLQSLEGETTDILDILELVKAEKPLKSLDFCYGNEDLTFSISEAIKLCVTVVAYAPESFRSLQMLMVLEALVPCYLQKLKRQTSQVETVPAAREEIAATAALATSLQALLYSVEVLTRPMTAPQMSRCDQGHKGTTTANHTMSSGVNTRYQEQGAKLHFIRENLHLLEEGQGIPREELDERIAREEFRRPRESLLNICTEFYKHCGPRLKILQNLAGEPRVIALELLDVKSHMRLAEIAHSLLKLAPYDTQTMESRGLRRYIMEMLPITDWTAEAVRPALILILKRLDRMFNKIHKMPTLRRQVEWEPASNLIEGVCLTLQRQPIISFLPHLRSLINVCVNLVMGVVGPSSVADGLPLLHLSPYLSPPLPFSTAVVRLVALQIQALKEDFPLSHVISPFTNQERREGMLLNLLIPFVLTVGSGSKDSPWLEQPEVQLLLQTVINVLLPPRIISTSRSKNFMLESSPAHCSTPGDAGKDLRREGLAESTSQAAYLALKVILVCFERQLGSQWYWLSLQVKEMALRKVGGLALWDFLDFIVRTRIPIFVLLRPFIQCKLLAQPAENHEELSARQHIADQLERRFIPRPLCKSSLIAEFNSELKILKEAVHSGSAYQGKTSISTVGTSTSAYRLSLATMSRSNTGTGTVWEQDSEPSQQASQDTLSRTDEEDEENDSISMPSVVSEQEAYLLSAIGRRRFSSHVSSMSVPQAEVGMLPSQRVASIQSEPGQQNLLVQQPLGRKRGLRQLRRPLLSRQKTQTEPRNRQGARLSTTRRSIQPKTKPSADQKRSVTFIEAQPEPAAAPTDALPATGQLQGCSPAPSRKPEAMDEPVLTSSPAIVVADLHSVSPKQSENFPTEEGEKEEDTEAQGATAHSPLSAQLSDPDDFTGLETSSLLQHGDTVLHISEENGMENPLLSSQFTFTPTELGKTDAVLDESHV

SEQ ID NO: 95759 - protein, 546 aa, Homo sapiens
  Payload ID: 19102
  Gene Name: unc-80 homolog (C. elegans)
  ENSP ID: ENSP00000335576
IPREELDERIAREEFRRPRESLLNICTEFYKHCGPRLKILQNLAGEPRVIALELLDVKSHMRLAEIAHSLLKLAPYDTQTMESRGLRRYIMEMLPITDWTAEAVRPALILILKRLDRMFNKIHKMPTLRRQVEWEPASNLIEGVCLTLQRQPIISFLPHLRSLINVCVNLVMGVVGPSSVADGLPLLHLSPYLSPPLPFSTAVVRLVALQIQALKEDFPLSHVISPFTNQERREGMLLNLLIPFVLTVGSGSKDSPWLEQPEVQLLLQTVINVLLPPRIISTSRSKNFMLESSPAHCSTPGDAGKDLRREGLAESTSQAAYLALKVILVCFERQLGSQWYWLSLQVKEMALRKVGGLALWDFLDFIVRTRIPIFVLLRPFIQCKLLAQPAENHEELSARQHIADQLERRFIPRPLCKSSLIAEFNSELKILKEAVHSGSAYQGKTSISTVGTSTSAYRLSLATMSRSNTGTGTVWEQDSEPSQQASQDTLSRTDEEDEENDSISMPSVVSEQEAYLLSAIGRRRFSSHVSSMSVPQAEVGMLPSQR

SEQ ID NO: 95760 - protein, 3258 aa, Homo sapiens
  Payload ID: 19102
  Gene Name: unc-80 homolog (C. elegans)
  Uniprot ID: Q8N2C7
  ENSP ID: ENSP00000391088
MVKRKSSEGQEQDGGRGIPLPIQTFLWRQTSAFLRPKLGKQYEASCVSFERVLVENKLHGLSPALSEAIQSISRWELVQAALPHVLHCTATLLSNRNKLGHQDKLGVAETKLLHTLHWMLLEAPQDCNNERFGGTDRGSSWGGSSSAFIHQVENQGSPGQPCQSSSNDEEENNRRKIFQNSMATVELFVFLFAPLVHRIKESDLTFRLASGLVIWQPMWEHRQPGVSGFTALVKPIRNIITAKRSSPINSQSRTCESPNQDARHLEGLQVVCETFQSDSISPKATISGCHRGNSFDGSLSSQTSQERGPSHSRASLVIPPCQRSRYATYFDVAVLRCLLQPHWSEEGTQWSLMYYLQRLRHMLEEKPEKPPEPDIPLLPRPRSSSMVAAAPSLVNTHKTQDLTMKCNEEEKSLSSEAFSKVSLTNLRRSAVPDLSSDLGMNIFKKFKSRKEDRERKGSIPFHHTGKRRPRRMGVPFLLHEDHLDVSPTRSTFSFGSFSGLGEDRRGIEKGGWQTTILGKLTRRGSSDAATEMESLSARHSHSHHTLVSDLPDPSNSHGENTVKEVRSQISTITVATFNTTLASFNVGYADFFNEHMRKLCNQVPIPEMPHEPLACANLPRSLTDSCINYSYLEDTEHIDGTNNFVHKNGMLDLSVVLKAVYLVLNHDISSRICDVALNIVECLLQLGVVPCVEKNRKKSENKENETLEKRPSEGAFQFKGVSGSSTCGFGGPAVSGAGDGGGEEGGGGDGGGGGGDGGGGGGGGGGPYEKNDKNQEKDESTPVSNHRLALTMLIKIVKSLGCAYGCGEGHRGLSGDRLRHQVFRENAQNCLTKLYKLDKMQFRQTMRDYVNKDSLNNVVDFLHALLGFCMEPVTDNKAGFGNNFTTVDNKSTAQNVEGIIVSAMFKSLITRCASTTHELHSPENLGLYCDIRQLVQFIKEAHGNVFRRVALSALLDSAEKLAPGKKVEENEQESKPAGSKRSEAGSIVDKGQVSSAPEECRSFMSGRPSQTPEHDEQMQGANLGRKDFWRKMFKSQSAASDTSSQSEQDTSECTTAHSGTTSDRRARSRSRRISLRKKLKLPIGKRNWLKRSSLSGLADGVEDLLDISSVDRLSFIRQSSKVKFTSAVKLSEGGPGSGMENGRDEEENFFKRLGCHSFDDHLSPNQDGGKSKNVVNLGAIRQGMKRFQFLLNCCEPGTIPDASILAAALDLEAPVVARAALFLECARFVHRCNRGNWPEWMKGHHVNITKKGLSRGRSPIVGNKRNQKLQWNAAKLFYQWGDAIGVRLNELCHGESESPANLLGLIYDEETKRRLRKEDEEEDFLDDSTVNPSKCGCPFALKMAACQLLLEITTFLRETFSCLPRPRTEPLVDLESCRLRLDPELDRHRYERKISFAGVLDENEDSKDSLHSSSHTLKSDAGVEEKKEGSPWSASEPSIEPEGMSNAGAEENYHRNMSWLHVMILLCNQQSFICTHVDYCHPHCYLHHSRSCARLVRAIKLLYGDSVDSLRESSNISSVALRGKKQKECSDKSCLRTPSLKKRVSDANLEGKKDSGMLKYIRLQVMSLSPAPLSLLIKAAPILTEEMYGDIQPAAWELLLSMDEHMAGAAAAMFLLCAVKVPEAVSDMLMSEFHHPETVQRLNAVLKFHTLWRFRYQVWPRMEEGAQQIFKIPPPSINFTLPSPVLGMPSVPMFDPPWVPQCSGSVQDPINEDQSKSFSARAVSRSHQRAEHILKNLQQEEEKKRLGREASLITAIPITQEACYEPTCTPNSEPEEEVEEVTNLASRRLSVSPSCTSSTSHRNYSFRRGSVWSVRSAVSAEDEEHTTEHTPNHHVPQPPQAVFPACICAAVLPIVHLMEDGEVREDGVAVSAVAQQVLWNCLIEDPSTVLRHFLEKLTISNRQDELMYMLRKLLLNIGDFPAQTSHILFNYLVGLIMYFVRTPCEWGMDAISATLTFLWEVVGYVEGLFFKDLKQTMKKEQCEVKLLVTASMPGTKTLVVHGQNECDIPTQLPVHEDTQFEALLKECLEFFNIPESQSTHYFLMDKRWNLIHYNKTYVRDIYPFRRSVSPQLNLVHMHPEKGQELIQKQVFTRKLEEVGRVLFLISLTQKIPTAHKQSHVSMLQEDLLRLPSFPRSAIDAEFSLFSDPQAGKELFGLDTLQKSLWIQLLEEMFLGMPSEFPWGDEIMLFLNVFNGALILHPEDSALLRQYAATVINTAVHFNHLFSLSGYQWILPTMLQVYSDYESNPQLRQAIEFACHQFYILHRKPFVLQLFASVAPLLEFPDAANNGPSKGVSAQCLFDLLQSLEGETTDILDILELVKAEKPLKSLDFCYGNEDLTFSISEAIKLCVTVVAYAPESFRSLQMLMVLEALVPCYLQKLKRQTSQVETVPAAREEIAATAALATSLQALLYSVEVLTRPMTAPQMSRCDQGHKGTTTANHTMSSGVNTRYQEQGAKLHFIRENLHLLEEGQGIPREELDERIAREEFRRPRESLLNICTEFYKHCGPRLKILQNLAGEPRVIALELLDVKSHMRLAEIAHSLLKLAPYDTQTMESRGLRRYIMEMLPITDWTAEAVRPALILILKRLDRMFNKIHKMPTLRRQVEWEPASNLIEGVCLTLQRQPIISFLPHLRSLINVCVNLVMGVVGPSSVADGLPLLHLSPYLSPPLPFSTAVVRLVALQIQALKEDFPLSHVISPFTNQERREGMLLNLLIPFVLTVGSGSKDSPWLEQPEVQLLLQTVINVLLPPRIISTSRSKNFMLESSPAHCSTPGDAGKDLRREGLAESTSQAAYLALKVILVCFERQLGSQWYWLSLQVKEMALRKVGGLALWDFLDFIVRTRIPIFVLLRPFIQCKLLAQPAENHEELSARQHIADQLERRFIPRPLCKSSLIAEFNSELKILKEAVHSGSAYQGKTSISTVGTSTSAYRLSLATMSRSNTGTGTVWEQDSEPSQQASQDTLSRTDEEDEENDSISMPSVVSEQEAYLLSAIGRRRFSSHVSSMSVPQAEVGMLPSQSEPNVLDDSQGLAAEGSLSRVASIQSEPGQQNLLVQQPLGRKRGLRQLRRPLLSRQKTQTEPRNRQGARLSTTRRSIQPKTKPSADQKRSVTFIEAQPEPAAAPTDALPATGQLQGCSPAPSRKPEAMDEPVLTSSPAIVVADLHSVSPKQSENFPTEEGEKEEDTEAQGATAHSPLSAQLSDPDDFTGLETSSLLQHGDTVLHISEENGMENPLLSSQFTFTPTELGKTDAVLDESHV

SEQ ID NO: 95761 - protein, 457 aa, Homo sapiens
  Payload ID: 19103
  Gene Name: unc-93 homolog A (C. elegans)
  Uniprot ID: Q86WB7
  ENSP ID: ENSP00000230256
MDRSLRNVLVVSFGFLLLFTAYGGLQSLQSSLYSEEGLGVTALSTLYGGMLLSSMFLPPLLIERLGCKGTIILSMCGYVAFSVGNFFASWYTLIPTSILLGLGAAPLWSAQCTYLTITGNTHAEKAGKRGKDMVNQYFGIFFLIFQSSGVWGNLISSLVFGQTPSQETLPEEQLTSCGASDCLMATTTTNSTQRPSQQLVYTLLGIYTGSGVLAVLMIAAFLQPIRDVQRESEGEKKSVPFWSTLLSTFKLYRDKRLCLLILLPLYSGLQQGFLSSEYTRSYVTCTLGIQFVGYVMICFSATDALCSVLYGKVSQYTGRAVLYVLGAVTHVSCMIALLLWRPRADHLAVFFVFSGLWGVADAVWQTQNNALYGVLFEKSKEAAFANYRLWEALGFVIAFGYSMFLCVHVKLYILLGVLSLTMVAYGLVECVESKNPIRPHAPGQVNQAEDEEIQTKM

SEQ ID NO: 95762 - protein, 415 aa, Homo sapiens
  Payload ID: 19103
  Gene Name: unc-93 homolog A (C. elegans)
  Uniprot ID: Q86WB7
  ENSP ID: ENSP00000355794
MDRSLRNVLVVSFGFLLLFTAYGGLQSLQSSLYSEEGLGVTALSTLYGGMLLSSMFLPPLLIERLGCKGTIILSMCGYVAFSVGNFFASWYTLIPTSILLGLGAAPLWSAQCTYLTITGNTHAEKAGKRGKDMVNQYFGIFFLIFQSSGVWGNLISSLVFGQTPSQGSGVLAVLMIAAFLQPIRDVQRESEGEKKSVPFWSTLLSTFKLYRDKRLCLLILLPLYSGLQQGFLSSEYTRSYVTCTLGIQFVGYVMICFSATDALCSVLYGKVSQYTGRAVLYVLGAVTHVSCMIALLLWRPRADHLAVFFVFSGLWGVADAVWQTQNNALYGVLFEKSKEAAFANYRLWEALGFVIAFGYSMFLCVHVKLYILLGVLSLTMVAYGLVECVESKNPIRPHAPGQVNQAEDEEIQTKM

SEQ ID NO: 95763 - protein, 144 aa, Homo sapiens
  Payload ID: 19103
  Gene Name: unc-93 homolog A (C. elegans)
  ENSP ID: ENSP00000421484
MDRSLRNVLVVSFGFLLLFTAYGGLQSLQSSLYSEEGLGVTALSTLYGGMLLSSMFLPPLLIERLGCKGTIILSMCGYVAFSVGNFFASWYTLIPTSILLGLGAAPLWSAQCTYLTITGNTHAEKAGKRGKDMVNQYFGIFFLI

SEQ ID NO: 95764 - protein, 597 aa, Homo sapiens
  Payload ID: 19104
  Gene Name: unc-93 homolog B1 (C. elegans)
  Uniprot ID: Q9H1C4
  ENSP ID: ENSP00000227471
MEAEPPLYPMAGAAGPQGDEDLLGVPDGPEAPLDELVGAYPNYNEEEEERRYYRRKRLGVLKNVLAASAGGMLTYGVYLGLLQMQLILHYDETYREVKYGNMGLPDIDSKMLMGINVTPIAALLYTPVLIRFFGTKWMMFLAVGIYALFVSTNYWERYYTLVPSAVALGMAIVPLWASMGNYITRMAQKYHEYSHYKEQDGQGMKQRPPRGSHAPYLLVFQAIFYSFFHLSFACAQLPMIYFLNHYLYDLNHTLYNVQSCGTNSHGILSGFNKTVLRTLPRSGNLIVVESVLMAVAFLAMLLVLGLCGAAYRPTEEIDLRSVGWGNIFQLPFKHVRDYRLRHLVPFFIYSGFEVLFACTGIALGYGVCSVGLERLAYLLVAYSLGASAASLLGLLGLWLPRPVPLVAGAGVHLLLTFILFFWAPVPRVLQHSWILYVAAALWGVGSALNKTGLSTLLGILYEDKERQDFIFTIYHWWQAVAIFTVYLGSSLHMKAKLAVLLVTLVAAAVSYLRMEQKLRRGVAPRQPRIPRPQHKVRGYRYLEEDNSDESDAEGEHGDGAEEEAPPAGPRPGPEPAGLGRRPCPYEQAQGGDGPEEQ

SEQ ID NO: 95765 - protein, 214 aa, Homo sapiens
  Payload ID: 19104
  Gene Name: unc-93 homolog B1 (C. elegans)
  ENSP ID: ENSP00000434294
MEAEPPLYPMAGAAGPQGDEDLLGVPDGPEAPLDELVGAYPNYNEEEEERRYYRRKRLGVLKNVLAASAGGMLTYGVYLGLLQMQLILHYDETYREVKYGNMGLPDIDSKMLMGINVTPIAALLYTPVLIRFFGTKWMMFLAVGIYALFVSTNYWERYYTLVPSAVALGMAIVPLWASMGNYITSSGCRTHRSGTGRAGESLLSFVVQDGAEVP

SEQ ID NO: 95766 - protein, 180 aa, Homo sapiens
  Payload ID: 19104
  Gene Name: unc-93 homolog B1 (C. elegans)
  ENSP ID: ENSP00000437195
MLTYGVYLGLLQMQLILHYDETYREVKYGNMGLPDIDSKMLMGINVTPIAALLYTPVLIRFFGTKWMMFLAVGIYALFVSTNYWERYYTLVPSAVALGMAIVPLWASMGNYITRMAQKYHEYSHYKEQDGQGMKQRPPRGSHAPYLLVFQAIFYSFFHLSFACAQLPMIYFLNHYLYDLN

SEQ ID NO: 95767 - protein, 99 aa, Homo sapiens
  Payload ID: 19105
  Gene Name: uncharacterized LOC150527 [Source:EntrezGene
  Acc:150527]
  ENSP ID: ENSP00000386678
MTVNKIMVHADYNELHRMGSDITLLQLHRHVEFSSHILPACLPEPTTWLAPDSSCWISGWGMVTEDAGMFLREAWSYAMACLSMKFLWPPPILWLQIHT

SEQ ID NO: 95768 - protein, 160 aa, Homo sapiens
  Payload ID: 19105
  Gene Name: uncharacterized LOC150527 [Source:EntrezGene
  Acc:150527]
  ENSP ID: ENSP00000387081
MTVNKIMVHADYNELHRMGSDITLLQLHRHVEFSSHILPACLPEPTTWLAPDSSCWISGWGMVTEDVFLPEPFQLQEAEVGVMDNTVCGSFFQPQYPGQPSSSDYTIHEDMLCAGDLITGKAICRVSGLTLSPLCCPGPLPQGLLWTLPQPRLLPEPSQA

SEQ ID NO: 95769 - protein, 141 aa, Homo sapiens
  Payload ID: 19105
  Gene Name: uncharacterized LOC150527 [Source:EntrezGene
  Acc:150527]
  ENSP ID: ENSP00000409747
MTVNKIMVHADYNELHRMGSDITLLQLHRHVEFSSHILPACLPEPTTWLAPDSSCWISGWGMVTEDVFLPEPFQLQEAEVGVMDNTVCGSFFQPQYPGQPSSSDYTIHEDMLCAGDLITGKAICRACSYVKHGVTQWPACP

SEQ ID NO: 95770 - protein, 149 aa, Homo sapiens
  Payload ID: 19105
  Gene Name: uncharacterized LOC150527 [Source:EntrezGene
  Acc:150527]
  ENSP ID: ENSP00000485065
MTVNKIMVHADYNELHRMGSDITLLQLHRHVEFSSHILPACLPEPTTWLAPDSSCWISGWGMVTEDVFLPEPFQLQEAEVGVMDNTVCGSFFQPQYPGQPSSSDYTIHEDMLCAGDLITGKAICRCGELRPREEVYHPSETPGVPSSAH

SEQ ID NO: 95771 - protein, 115 aa, Homo sapiens
  Payload ID: 19106
  Gene Name: Uncharacterized protein C12orf79  [Source:UniProtKB/Swiss-Prot
  Acc:G3V211]
  Uniprot ID: G3V211
  ENSP ID: ENSP00000477724
MNVCCSSHPVNEKVWKPSSRKWSSKVWSMDEFDLQTACYWFMTRCQKEAGKFGTHRGKPMCFVRSLLRVQLLPRTFPANSFVISFFPSLIYPLQVYQLHFESSDKQRAMQFVTEG

SEQ ID NO: 95772 - protein, 129 aa, Homo sapiens
  Payload ID: 19107
  Gene Name: Uncharacterized protein FLJ43738  [Source:UniProtKB/Swiss-Prot
  Acc:Q6ZUG5]
  ENSP ID: ENSP00000422463
MPVYCKYQFHKTPVHKTKGEPHGTHVYFQDINVIFLGALHPSDLREYLEGPPMVVEVHDRDRKSEECSQKPVLFGEDPLDSYLNFQALISPRETENNPFESQNKMWYPYGIAQVSFADLLLGHKYLNLA

SEQ ID NO: 95773 - protein, 572 aa, Homo sapiens
  Payload ID: 19107
  Gene Name: Uncharacterized protein FLJ43738  [Source:UniProtKB/Swiss-Prot
  Acc:Q6ZUG5]
  Uniprot ID: Q6ZUG5
  ENSP ID: ENSP00000424951
MPVYCKYQFHKTPVHKTKGEPHGTHVYFQDINVIFLGALHPSDLREYLEGPPMVVEVHDRDRKSEECSQKPVLFGEDPLDSYLNFQALISPRETENNPFESQNKMWYPYGIAQVSFADLLLGHKYLNLAVPIHSCEVQPTHCGQDSRRRKVVGLGVPRDGHQHGPMPRGNYLEADSQLKLRVDIAVPLRAGARAADPDLGGSQFGRIIFVFDFKKVSLLHSLLQDITMINAKALGLDSYPVRTLQQILSAFKVRVRVQEQQHLDVLTGFHLLDGKTHLFILEGLADQGLRQLWENHQSWIPRSEHRKYKVLYNSQLLFRSRLYGDLEAILYHVHLFQPTELLLQQAVFFLRDTERRRVFQALARIHDICYNSTTLWDVTVRDLLPSSAMIKDLSQEFGMPLSQEELTDEKLFALPPQPAPNLEDYHSRNSTLTLEIHAHQEPRKRFTYSQDYLSAMVEPLDLKEEEKKAQKKSRQAWLTARGFQVTGLQSDTESSFQDLKLPPIKELNEEWKENSLFANVLEPVLDRDRWSWDRHHVDFDLYKKPPPFLELLPSPAPKPVTVRKKKGNSPIS

SEQ ID NO: 95774 - protein, 381 aa, Homo sapiens
  Payload ID: 19108
  Gene Name: uncharacterized protein LOC100288966  [Source:RefSeq peptide
  Acc:NP_001244291]
  ENSP ID: ENSP00000477677
MVAEVCSMPTASTVKKPFDLRSKMGKWCHHRFPCCRGSGKSNMGTSGDHDDSFMKMLRSKMGKCCRHCFPCCRGSGTSNVGTSGDHENSFMKMLRSKMGKWCCHCFPCCRGSSKSNVGAWGDYDHSAFMEPRYHVRREDLDKLHRAAWWGKVPRKDLIVMLRDTDMNKRDKEKRTALHLASANGNSEVVQLLLDRRCQLNVLDNKKRTALIKAIQCQEDECVLMLLEHGADRNIPDEYGNTALHYAIYNEDKLMAKALLLYGADIESKNKCGLTPLLLGVHEQKQQVVKFLIKKKANLNVLDRYGRTALILAVCCGSASIVNLLLEQNVDVSSQDLSGQTAREYAVSSHHHVICELLSDYKEKQMLKISSENSNPGKEAEE

SEQ ID NO: 95775 - protein, 584 aa, Homo sapiens
  Payload ID: 19108
  Gene Name: uncharacterized protein LOC100288966  [Source:RefSeq peptide
  Acc:NP_001244291]
  ENSP ID: ENSP00000479139
MVAEVCSMPTASTVKKPFDLRSKMGKWCHHRFPCCRGSGKSNMGTSGDHDDSFMKMLRSKMGKCCRHCFPCCRGSGTSNVGTSGDHENSFMKMLRSKMGKWCCHCFPCCRGSSKSNVGAWGDYDHSAFMEPRYHVRREDLDKLHRAAWWGKVPRKDLIVMLRDTDMNKRDKEKRTALHLASANGNSEVVQLLLDRRCQLNVLDNKKRTALIKAIQCQEDECVLMLLEHGADRNIPDEYGNTALHYAIYNEDKLMAKALLLYGADIESKNKCGLTPLLLGVHEQKQQVVKFLIKKKANLNVLDRYGRTALILAVCCGSASIVNLLLEQNVDVSSQDLSGQTAREYAVSSHHHVICELLSDYKEKQMLKISSENSNPEQDLKLTSEEESQRLKVSENSQPEKMSQEPEINKDCDREVEEEIKKHGSNPVGLPENLTNGASAGNGDDGLIPQRRSRKPENQQFPDTENEEYHSDEQNDTRKQLSEEQNTGISQDEILTNKQKQIEVAEQKMNSELSLSHKKEEDLLRENSVLQEEIAVLRLELDETKHQNQLRENKILEEIESVKEKTDKLLRAMQLNEEALTKTNI

SEQ ID NO: 95776 - protein, 361 aa, Homo sapiens
  Payload ID: 19109
  Gene Name: Uncharacterized protein LOC113230  [Source:UniProtKB/Swiss-Prot
  Acc:Q96FF7]
  ENSP ID: ENSP00000269720
MAPQRAGPGLGKPSSKKSRALRGGPGVPRARQRSPRAAAELNTEVPKPSAKDVEILEQESEVLEPSVEQDAESPGLSTAAGFESPEPGRDDPGPSEAQRAEVQGQHPPPGPKTSSSRSGSEAPHLRFPPCPEAPQRPPEERFMETPIEREIRRSCEREESLRRSRGLSPGRAGRELVELRVRPVLNLPGPGPALPRALERARAGAQMQRDIEREAHRQAALARPAVPEPRARSPPQPLGELKRFFEAAAGSGSSAGAGDGAGPQRLPEPGGRPRSAVQGGCRVLGSAPPPFTPSLLEQEVRAVREREQELQRQRRSVYGTAEFKEPTPSLTASRGDGKLVVIWPPRRKVSENGLEQEERKP

SEQ ID NO: 95777 - protein, 219 aa, Homo sapiens
  Payload ID: 19109
  Gene Name: Uncharacterized protein LOC113230  [Source:UniProtKB/Swiss-Prot
  Acc:Q96FF7]
  Uniprot ID: Q96FF7
  ENSP ID: ENSP00000465157
METPIEREIRRSCEREESLRRSRGLSPGRAGRELVELRVRPVLNLPGPGPALPRALERARAGAQMQRDIEREAHRQAALARPAVPEPRARSPPQPLGELKRFFEAAAGSGSSAGAGDGAGPQRLPEPGGRPRSAVQGGCRVLGSAPPPFTPSLLEQEVRAVREREQELQRQRRSVYGTAEFKEPTPSLTASRGDGKLVVIWPPRRKVSENGLEQEERKP

SEQ ID NO: 95778 - protein, 150 aa, Homo sapiens
  Payload ID: 19109
  Gene Name: Uncharacterized protein LOC113230  [Source:UniProtKB/Swiss-Prot
  Acc:Q96FF7]
  ENSP ID: ENSP00000466176
AAAAAGRTQALLRGRGGERLLGGGGGRRGPAEAARAWGTAALGRAGRVPGAGQRPAAFHSVTAGAGGARRARARAGTAAPAAQRLWHRGVQGAYAEPHRGAAGLSSWLPPAGELSAPSPAASRGDGKLVVIWPPRRKVSENGLEQEERKP

SEQ ID NO: 95779 - protein, 120 aa, Homo sapiens
  Payload ID: 19110
  Gene Name: uncharacterized protein LOC389831  [Source:RefSeq peptide
  Acc:NP_001229409]
  ENSP ID: ENSP00000484596
MYSFPTTVVEEILSLSLQLIAFPTVSCEILLEITSQTNKKQTWETCYAHSAEEIGIIAGKRIHKTQAVPYICFLLRHQFISQSSHVRVEALYSLLFLGTLLQVGKGQEVLLKDALRARAP

SEQ ID NO: 95780 - protein, 157 aa, Homo sapiens
  Payload ID: 19111
  Gene Name: Uncharacterized protein UNQ6126/PRO20091  [Source:UniProtKB/Swiss-Prot
  Acc:Q6UXV3]
  Uniprot ID: Q6UXV3
  ENSP ID: ENSP00000485227
MLPEQGPQPSTMPLWCLLAACTSLPRQAATMLEEAASPNEAVHASTSGSGALTDQTFTDLSAAEASSEEVPDFMEVPHSVHHKINCFFYLEKQLCQLPSPLCLSSLLTLKLKTTVPAPGRWWSFQPHKAFPLLVGTPGSWQSTIDPAWAAPSQPSPG

SEQ ID NO: 95781 - protein, 410 aa, Homo sapiens
  Payload ID: 19112
  Gene Name: uncharacterized serine/threonine-protein kinase SgK494 [Source:EntrezGene
  Acc:124923]
  ENSP ID: ENSP00000301037
MGAVSCRQGQHTQQGEHTRVAVPHKQGGNIRGPWARGWKSLWTGLGTIRSDLEELWELRGHHYLHQESLKPAPVLVEKPLPEWPVPQFINLFLPEFPIRPIRGQQQLKILGLVAKGSFGTVLKVLDCTQKAVFAVKVVPKVKVLQRDTVRQCKEEVSIQRQINHPFVHSLGDSWQGKRHLFIMCSYCSTDLYSLWSAVGCFPEASIRLFAAELVLVLCYLHDLGIMHRDVKMENILLDERGHLKLTDFGLSRHVPQGAQAYTICGTLQYMAPEVLSGGPYNHAADWWSLGVLLFSLATGKFPVAAERDHVAMLASVTHSDSEIPASLNQGLSLLLHELLCQNPLHRLRYLHHFQVHPFFRGVAFDPELLQKQPVNFVTETQATQPSSAETMPFDDFDCDLESFLLYPIPA

SEQ ID NO: 95782 - protein, 186 aa, Homo sapiens
  Payload ID: 19112
  Gene Name: uncharacterized serine/threonine-protein kinase SgK494 [Source:EntrezGene
  Acc:124923]
  ENSP ID: ENSP00000434603
MGAVSCRQGQHTQQGEHTRVAVPHKQGGNIRGPWARGWKSLWTGLGTIRSDLEELWELRGHHYLHQESLKPAPVLVEKPLPEWPVPQFINLFLPEFPIRPIRGQQQLKILGLVAKGSFGTVLKVLDCTQKAVFAVKVVPKVKVLQRDTVRQCKEERQINHPFVHSLGDSWQGKRHLFIMCSYCSTD

SEQ ID NO: 95783 - protein, 146 aa, Homo sapiens
  Payload ID: 19112
  Gene Name: uncharacterized serine/threonine-protein kinase SgK494 [Source:EntrezGene
  Acc:124923]
  ENSP ID: ENSP00000463890
VSLKSVAPEVLSGGPYNHAADWWSLGVLLFSLATGKFPVAAERDHVAMLASVTHSDSEIPASLNQGLSLLLHELLCQNPLHRLRYLHHFQVHPFFRGVAFDPELLQKQPVNFVTETQATQPSSAETMPFDDFDCDLESFLLYPIPA

SEQ ID NO: 95784 - protein, 173 aa, Homo sapiens
  Payload ID: 19112
  Gene Name: uncharacterized serine/threonine-protein kinase SgK494 [Source:EntrezGene
  Acc:124923]
  ENSP ID: ENSP00000464010
MGAVSCRQGQHTQQGEHTRVAVPHKGGNIRGPWARGWKSLWTGLGTIRSDLEELWELRGHHYLHQESLKPAPVLVEKPLPEWPVPQFINLFLPEFPIRPIRGQQQLKILGLVAKGSFGTVLKVLDCTQKAVFAVKVVPKVKVLQRDTVRQCKEEVSIQVCTESWKGLWEELGH

SEQ ID NO: 95785 - protein, 92 aa, Homo sapiens
  Payload ID: 19112
  Gene Name: uncharacterized serine/threonine-protein kinase SgK494 [Source:EntrezGene
  Acc:124923]
  ENSP ID: ENSP00000468448
  MOD_RES (1)..(1): Any amino acid
XCSYCSTDLYSLWSAVGCFPEASIRLFAAELVLVLCYLHDLGIMHRDVKMENILLDERGHLKLTDFGLSRHVPQGAQAYTICGTLQYMGERG

SEQ ID NO: 95786 - protein, 259 aa, Homo sapiens
  Payload ID: 19113
  Gene Name: unconventional SNARE in the ER 1 homolog (S. cerevisiae)
  Uniprot ID: Q9NZ43
  ENSP ID: ENSP00000263897
MAASRLELNLVRLLSRCEAMAAEKRDPDEWRLEKYVGALEDMLQALKVHASKPASEVINEYSWKVDFLKGMLQAEKLTSSSEKALANQFLAPGRVPTTARERVPATKTVHLQSRARYTSEMRSELLGTDSAEPEMDVRKRTGVAGSQPVSEKQLAAELDLVLQRHQNLQEKLAEEMLGLARSLKTNTLAAQSVIKKDNQTLSHSLKMADQNLEKLKTESERLEQHTQKSVNWLLWAMLIIVCFIFISMILFIRIMPKLK

SEQ ID NO: 95787 - protein, 256 aa, Homo sapiens
  Payload ID: 19113
  Gene Name: unconventional SNARE in the ER 1 homolog (S. cerevisiae)
  ENSP ID: ENSP00000390287
MAASRLELNLVRLLSRCEAMAAEKRDPDEWRLEKYVGALEDMLQALKVHASKPASEVINEYSWKVDFLKGMLQAEKLTSSSEKALANQFLAPGRVPTTARERVPATKTVHLQSRARYTSEMRSELLGTEPEMDVRKRTGVAGSQPVSEKQLAAELDLVLQRHQNLQEKLAEEMLGLARSLKTNTLAAQSVIKKDNQTLSHSLKMADQNLEKLKTESERLEQHTQKSVNWLLWAMLIIVCFIFISMILFIRIMPKLK

SEQ ID NO: 95788 - protein, 38 aa, Homo sapiens
  Payload ID: 19113
  Gene Name: unconventional SNARE in the ER 1 homolog (S. cerevisiae)
  ENSP ID: ENSP00000469658
MAASRLELNLVRLLSRCEAMAAEKRDPDEWRLEKQTGL

SEQ ID NO: 95789 - protein, 161 aa, Homo sapiens
  Payload ID: 19113
  Gene Name: unconventional SNARE in the ER 1 homolog (S. cerevisiae)
  ENSP ID: ENSP00000470065
MLQALKVHASKPASEVINEYSWKVDFLKGMLQAEKLTSSSEKALANQFLAPGRVPTTARERVPATKTVHLQSRARYTSEMRSELLGTDSAEPEMDVRKRTGVAGSQPVSEKQLAAELDLVLQRHQNLQEKLAEEMLGLARSLKTNTLAAQSVIKKDNQTLS

SEQ ID NO: 95790 - protein, 133 aa, Homo sapiens
  Payload ID: 19113
  Gene Name: unconventional SNARE in the ER 1 homolog (S. cerevisiae)
  ENSP ID: ENSP00000470487
MAASRLELNLVRLLSRCEAMAAEKRDPDEWRLEKYVGALEDMLQALKVHASKPASEVINEYSWKVDFLKGMLQAEKLTSSSEKALANQFLAPGRVPTTARERVPATKTVHLQSRARYTSEMRSELLGTVGLLP

SEQ ID NO: 95791 - protein, 38 aa, Homo sapiens; identical to SEQ ID NO: 95788
  Payload ID: 19113
  Gene Name: unconventional SNARE in the ER 1 homolog (S. cerevisiae)
  ENSP ID: ENSP00000470882

SEQ ID NO: 95792 - protein, 135 aa, Homo sapiens
  Payload ID: 19113
  Gene Name: unconventional SNARE in the ER 1 homolog (S. cerevisiae)
  Uniprot ID: Q9NZ43
  ENSP ID: ENSP00000472362
MAASRLELNLVRLLSRCEAMAAEKRDPDEWRLEKYVGALEDMLQALKVHASKPASEVINEYSWKVDFLKGMLQAEKLTSSSEKALANQFLAPGRVPTTARERVPATKTVHLQSRARYTSEMRSELLGTDSAGESP

SEQ ID NO: 95793 - protein, 146 aa, Homo sapiens
  Payload ID: 19113
  Gene Name: unconventional SNARE in the ER 1 homolog (S. cerevisiae)
  Uniprot ID: Q9NZ43
  ENSP ID: ENSP00000473239
MAASRLELNLVRLLSRCEAMAAEKRDPDEWRLEKYVGALEDMLQALKVHASKPASEVINEYSWKVDFLKGMLQAEKLTSSSEKALANQFLAPGRVPTTARERVPATKTVHLQSRARYTSEMRSELLGTDSAEPEMDVRKRTPCHTH

SEQ ID NO: 95794 - protein, 307 aa, Homo sapiens
  Payload ID: 19114
  Gene Name: uncoupling protein 1 (mitochondrial, proton carrier)
  Uniprot ID: P25874
  ENSP ID: ENSP00000262999
MGGLTASDVHPTLGVQLFSAGIAACLADVITFPLDTAKVRLQVQGECPTSSVIRYKGVLGTITAVVKTEGRMKLYSGLPAGLQRQISSASLRIGLYDTVQEFLTAGKETAPSLGSKILAGLTTGGVAVFIGQPTEVVKVRLQAQSHLHGIKPRYTGTYNAYRIIATTEGLTGLWKGTTPNLMRSVIINCTELVTYDLMKEAFVKNNILADDVPCHLVSALIAGFCATAMSSPVDVVKTRFINSPPGQYKSVPNCAMKVFTNEGPTAFFKGLVPSFLRLGSWNVIMFVCFEQLKRELSKSRQTMDCAT

SEQ ID NO: 95795 - protein, 309 aa, Homo sapiens
  Payload ID: 19115
  Gene Name: uncoupling protein 2 (mitochondrial, proton carrier)
  Uniprot ID: P55851
  ENSP ID: ENSP00000312029
MVGFKATDVPPTATVKFLGAGTAACIADLITFPLDTAKVRLQIQGESQGPVRATASAQYRGVMGTILTMVRTEGPRSLYNGLVAGLQRQMSFASVRIGLYDSVKQFYTKGSEHASIGSRLLAGSTTGALAVAVAQPTDVVKVRFQAQARAGGGRRYQSTVNAYKTIAREEGFRGLWKGTSPNVARNAIVNCAELVTYDLIKDALLKANLMTDDLPCHFTSAFGAGFCTTVIASPVDVVKTRYMNSALGQYSSAGHCALTMLQKEGPRAFYKGFMPSFLRLGSWNVVMFVTYEQLKRALMAACTSREAPF

SEQ ID NO: 95796 - protein, 32 aa, Homo sapiens
  Payload ID: 19115
  Gene Name: uncoupling protein 2 (mitochondrial, proton carrier)
  ENSP ID: ENSP00000438230
MVGFKATDVPPTATVKFLGAGTAACIADLITF

SEQ ID NO: 95797 - protein, 129 aa, Homo sapiens
  Payload ID: 19115
  Gene Name: uncoupling protein 2 (mitochondrial, proton carrier)
  ENSP ID: ENSP00000439706
GSRLLAGSTTGALAVAVAQPTDVVKVRFQAQARAGGGRRYQSTVNAYKTIAREEGFRGLWKGTSPNVARNAIVNCAELVTYDLIKDALLKANLMTGFCTTVIASPVDVVKTRYMNSALGQYSSAGHCAL

SEQ ID NO: 95798 - protein, 282 aa, Homo sapiens
  Payload ID: 19115
  Gene Name: uncoupling protein 2 (mitochondrial, proton carrier)
  ENSP ID: ENSP00000439951
GQHAYPCSYPVLALQIQGESQGPVRATASAQYRGVMGTILTMVRTEGPRSLYNGLVAGLQRQMSFASVRIGLYDSVKQFYTKGSEHASIGSRLLAGSTTGALAVAVAQPTDVVKVRFQAQARAGGGRRYQSTVNAYKTIAREEGFRGLWKGTSPNVARNAIVNCAELVTYDLIKDALLKANLMTDDLPCHFTSAFGAGFCTTVIASPVDVVKTRYMNSALGQYSSAGHCALTMLQKEGPRAFYKGFMPSFLRLGSWNVVMFVTYEQLKRALMAACTSREAPF

SEQ ID NO: 95799 - protein, 225 aa, Homo sapiens
  Payload ID: 19115
  Gene Name: uncoupling protein 2 (mitochondrial, proton carrier)
  ENSP ID: ENSP00000441147
MVGFKATDVPPTATVKFLGAGTAACIADLITFPLDTAKVRLQIQGESQGPVRATASAQYRGVMGTILTMVRTEGPRSLYNGLVAGLQRQMSFASVRIGLYDSVKQFYTKGSEHASIGSRLLAGSTTGALAVAVAQPTDVVKVRFQAQARAGGGRRYQSTVNAYKTIAREEGFRGLWKGTSPNVARNAIVNCAELVTYDLIKDALLKANLMTGSCPPFSAWVPGTW

SEQ ID NO: 95800 - protein, 312 aa, Homo sapiens
  Payload ID: 19116
  Gene Name: uncoupling protein 3 (mitochondrial, proton carrier)
  Uniprot ID: P55916
  ENSP ID: ENSP00000323740
MVGLKPSDVPPTMAVKFLGAGTAACFADLVTFPLDTAKVRLQIQGENQAVQTARLVQYRGVLGTILTMVRTEGPCSPYNGLVAGLQRQMSFASIRIGLYDSVKQVYTPKGADNSSLTTRILAGCTTGAMAVTCAQPTDVVKVRFQASIHLGPSRSDRKYSGTMDAYRTIAREEGVRGLWKGTLPNIMRNAIVNCAEVVTYDILKEKLLDYHLLTDNFPCHFVSAFGAGFCATVVASPVDVVKTRYMNSPPGQYFSPLDCMIKMVAQEGPTAFYKGFTPSFLRLGSWNVVMFVTYEQLKRALMKVQMLRESPF

SEQ ID NO: 95801 - protein, 275 aa, Homo sapiens
  Payload ID: 19116
  Gene Name: uncoupling protein 3 (mitochondrial, proton carrier)
  Uniprot ID: P55916
  ENSP ID: ENSP00000392143
MVGLKPSDVPPTMAVKFLGAGTAACFADLVTFPLDTAKVRLQIQGENQAVQTARLVQYRGVLGTILTMVRTEGPCSPYNGLVAGLQRQMSFASIRIGLYDSVKQVYTPKGADNSSLTTRILAGCTTGAMAVTCAQPTDVVKVRFQASIHLGPSRSDRKYSGTMDAYRTIAREEGVRGLWKGTLPNIMRNAIVNCAEVVTYDILKEKLLDYHLLTDNFPCHFVSAFGAGFCATVVASPVDVVKTRYMNSPPGQYFSPLDCMIKMVAQEGPTAFYKG

SEQ ID NO: 95802 - protein, 96 aa, Homo sapiens
  Payload ID: 19116
  Gene Name: uncoupling protein 3 (mitochondrial, proton carrier)
  ENSP ID: ENSP00000445279
MVGLKPSDVPPTMAVKFLGAGTAACFADLVTFPLDTAKVRLQIQGENQAVQTARLVQYRGVLGTILTMVRTEGPCSPYNGLVAGLQRQMSFASIRI

SEQ ID NO: 95803 - protein, 341 aa, Homo sapiens
  Payload ID: 19117
  Gene Name: undifferentiated embryonic cell transcription factor 1
  Uniprot ID: Q5T230
  ENSP ID: ENSP00000305906
MLLRPRRPPPLAPPAPPSPASPDPEPRTPGDAPGTPPRRPASPSALGELGLPVSPGSAQRTPWSARETELLLGTLLQPAVWRALLLDRRQALPTYRRVSAALAQQQVRRTPAQCRRRYKFLKDKFREAHGQPPGPFDEQIRKLMGLLGDNGRKRPRRRSPGSGRPQRARRPVPNAHAPAPSEPDATPLPTARDRDADPTWTLRFSPSPPKSADASPAPGSPPAPAPTALATCIPEDRAPVRGPGSPPPPPAREDPDSPPGRPEDCAPPPAAPPSLNTALLQTLGHLGDIANILGPLRDQLLTLNQHVEQLRGAFDQTVSLAVGFILGSAAAERGVLRDPCQ

SEQ ID NO: 95804 - protein, 810 aa, Homo sapiens
  Payload ID: 19118
  Gene Name: unkempt family zinc finger
  Uniprot ID: Q9C0B0
  ENSP ID: ENSP00000464893
MSKGPGPGGSAASSAPPAATAQVLQAQPEKPQHYTYLKEFRTEQCPLFVQHKCTQHRPYTCFHWHFVNQRRRRSIRRRDGTFNYSPDVYCTKYDEATGLCPEGDECPFLHRTTGDTERRYHLRYYKTGICIHETDSKGNCTKNGLHCAFAHGPHDLRSPVYDIRELQAMEALQNGQTTVEGSIEGQSAGAASHAMIEKILSEEPRWQETAYVLGNYKTEPCKKPPRLCRQGYACPYYHNSKDRRRSPRKHKYRSSPCPNVKHGDEWGDPGKCENGDACQYCHTRTEQQFHPEIYKSTKCNDMQQSGSCPRGPFCAFAHVEQPPLSDDLQPSSAVSSPTQPGPVLYMPSAAGDSVPVSPSSPHAPDLSALLCRNSSLGSPSNLCGSPPGSIRKPPNLEGIVFPGESGLAPGSYKKAPGFEREDQVGAEYLKNFKCQAKLKPHSLEPRSQEQPLLQPKQDMLGILPAGSPLTSSISSSITSSLAATPPSPVGTSSVPGMNANALPFYPTSDTVESVIESALDDLDLNEFGVAALEKTFDNSTVPHPGSITIGGSLLQSSAPVNIPGSLGSSASFHSASPSPPVSLSSHFLQQPQGHLSQSENTFLGTSASHGSLGLNGMNSSIWEHFASGSFSPGTSPAFLSGPGAAELARLRQELDEANSTIKQWEESWKQAKQACDAWKKEAEEAGERASAAGAECELAREQRDALEVQVKKLQEELERLHAGPEPQALPAFSDLEALSLSTLYSLQKQLRAHLEQVDKAVFHMQSVKCLKCQEQKRAVLPCQHAALCELCAEGSECPICQPGRAHTLQS

SEQ ID NO: 95805 - protein, 37 aa, Homo sapiens
  Payload ID: 19118
  Gene Name: unkempt family zinc finger
  ENSP ID: ENSP00000464953
MSKGPGPGGSAASSAPPAATAQVLQAQPEKPQHYTYG

SEQ ID NO: 95806 - protein, 69 aa, Homo sapiens
  Payload ID: 19118
  Gene Name: unkempt family zinc finger
  ENSP ID: ENSP00000466054
  MOD_RES (1)..(1): Any amino acid
XRRYHLRYYKTGICIHETDSKGNCTKNGLHCAFAHGPHDLRSPVYDIRWAGCWAGLMAVGWGPGQGPGG

SEQ ID NO: 95807 - protein, 41 aa, Homo sapiens
  Payload ID: 19118
  Gene Name: unkempt family zinc finger
  ENSP ID: ENSP00000466431
MSKGPGPGGSAASSAPPAATAQVLQAQPEKPQHYTAEERDQ

SEQ ID NO: 95808 - protein, 220 aa, Homo sapiens
  Payload ID: 19118
  Gene Name: unkempt family zinc finger
  ENSP ID: ENSP00000467726
  MOD_RES (1)..(1): Any amino acid
XTFDNSTVPHPGSITIGGSLLQSSAPVNIPGSLGSSASFHSASPSPPVSLSSHFLQQPQGHLSQSENTFLGTSASHGSLGPGAAELARLRQELDEANSTIKQWEESWKQAKQACDAWKKEAEEAGERASAAGAECELAREQRDALEVQVKKLQEELERLHAGPEPQALPAFSDLEALSLSTLYSLQKQLRAHLEQVDKAVFHMQSVKCLKCQEQKRAVLP

SEQ ID NO: 95809 - protein, 39 aa, Homo sapiens
  Payload ID: 19118
  Gene Name: unkempt family zinc finger
  ENSP ID: ENSP00000467849
MSKGPGPGGSAASSAPPAATAQVLQAQPEKPQHYTYVRY

SEQ ID NO: 95810 - protein, 229 aa, Homo sapiens
  Payload ID: 19119
  Gene Name: unkempt family zinc finger-like
  Uniprot ID: Q9H9P5
  ENSP ID: ENSP00000248104
MTCCSQVPPRRRPSLALSPRLDCNGLNGVPGSIWDFVSGSFSPSPSPILSAGPPSSSSASPNGAELARVRRQLDEAKRKIRQWEESWQQVKQVCDAWQREAQEAKERARVADSDRQLALQKKEEVEAQVKQLQEELEGLGVASTLPGLRGCGDIGTIPLPKLHSLQSQLRLDLEAVDGVIFQLRAKQCVACRERAHGAVLRPCQHHILCEPCAATAPECPYCKGQPLQW

SEQ ID NO: 95811 - protein, 277 aa, Homo sapiens
  Payload ID: 19119
  Gene Name: unkempt family zinc finger-like
  Uniprot ID: Q9H9P5
  ENSP ID: ENSP00000301712
MPSVSKAAAAALSGSPPQTEKPTHYRYLKEFRTEQCPLFSQHKCAQHRPFTCFHWHFLNQRRRRPLRRRDGTFNYSPDVYCSKYNEATGVCPDGDECPYLHRTTGDTERKYHLRYYKTGTCIHETDARGHCVKNGLHCAFAHGPLDLRPPVCDVRELQAQEALQNGQLGGGEGVPDLQPGVLASQAMIEKILSEDPRWQDANFVLGSYKTEQCPKPPRLCRQGYACPHYHNSRDRRRNPRRFQYSWQLGRRVLRLSPRANNPRVALPRVHTGPSSTA

SEQ ID NO: 95812 - protein, 116 aa, Homo sapiens
  Payload ID: 19119
  Gene Name: unkempt family zinc finger-like
  ENSP ID: ENSP00000372205
MPSVSKAAAAALSGSPPQTEKPTHYSTSARSTGRSPASTGTSSTSGAAGPSAGATAPSTTAPTCTAPSTTKPPACAPTATSVPTCTGRRGTQNASTTCVTTKQEPASTRQTHVATA

SEQ ID NO: 95813 - protein, 683 aa, Homo sapiens
  Payload ID: 19119
  Gene Name: unkempt family zinc finger-like
  ENSP ID: ENSP00000373873
MPSVSKAAAAALSGSPPQTEKPTHYRYLKEFRTEQCPLFSQHKCAQHRPFTCFHWHFLNQRRRRPLRRRDGTFNYSPDVYCSKYNEATGVCPDGDECPYLHRTTGDTERKYHLRYYKTGTCIHETDARGHCVKNGLHCAFAHGPLDLRPPVCDVRELQAQEALQNGQLGGGEGVPDLQPGVLASQAMIEKILSEDPRWQDANFVLGSYKTEQCPKPPRLCRQGYACPHYHNSRDRRRNPRRFQYRSTPCPSVKHGDEWGEPSRCDGGDGCQYCHSRTEQQFHPEIYKSTKCNDMRQTGYCPRGPFCAFAHVEKSLGMVNEWGCHDLHLTSPSSTGSGQPGNAKRRDSPAEGGPRGSEQDSKQNHLAVFAAVHPPAPSVSSSVASSLASSAGSGSSSPTALPAPPARALPLGPASSTVEAVLGSALDLHLSNVNIASLEKDLEEQDGHDLGAAGPRSLAGSAPVAIPGSLPRAPSLHSPSSASTSPLGSLSQPLPGPVGSSAMTPPQQPPPLRSEPGTLGSAASSYSPLGLNGVPGSIWDFVSGSFSPSPSPILSAGPPSSSSASPNGAELARVRRQLDEAKRKIRQWEESWQQVKQVCDAWQREAQEAKERARVADSDRQLALQKKEEVEAQVIFQLRAKQCVACRERAHGAVLRPCQHHILCEPCAATAPECPYCKGQPLQW

SEQ ID NO: 95814 - protein, 182 aa, Homo sapiens
  Payload ID: 19119
  Gene Name: unkempt family zinc finger-like
  Uniprot ID: Q9H9P5
  ENSP ID: ENSP00000380606
MTPPQQPPPLRSEPGTLGSAASSYSPLGLNGVPGSIWDFVSGSFSPSPSPILSAGPPSSSSASPNGAELARVRRQLDEAKRKIRQWEESWQQVKQVCDAWQREAQEAKERARVADSDRQLALQKKEEVEAQVIFQLRAKQCVACRERAHGAVLRPCQHHILCEPCAATAPECPYCKGQPLQW

SEQ ID NO: 95815 - protein, 114 aa, Homo sapiens
  Payload ID: 19119
  Gene Name: unkempt family zinc finger-like
  ENSP ID: ENSP00000384850
MTPPQQPPPLRSEPGTLGSAASSYSPLGLNGVPGSIWDFVSGSFSPSPSPILSAGPPSSSSASPNGAELARVRRQLDEAKRKIRQWEESWQQVKQVCDAWQREAQEAKERARVA

SEQ ID NO: 95816 - protein, 52 aa, Homo sapiens
  Payload ID: 19119
  Gene Name: unkempt family zinc finger-like
  ENSP ID: ENSP00000385895
MTPPQQPPPLRSEPGTLGSAASSYSPLGECRLPPCWRCREASVGLPPRCRPD

SEQ ID NO: 95817 - protein, 733 aa, Homo sapiens
  Payload ID: 19119
  Gene Name: unkempt family zinc finger-like
  ENSP ID: ENSP00000422852
MPSVSKAAAAALSGSPPQTEKPTHYRYLKEFRTEQCPLFSQHKCAQHRPFTCFHWHFLNQRRRRPLRRRDGTFNYSPDVYCSKYNEATGVCPDGDECPYLHRTTGDTERKYHLRYYKTGTCIHETDARGHCVKNGLHCAFAHGPLDLRPPVCDVRELQAQEALQNGQLGGGEGVPDLQPGVLASQAMIEKILSEDPRWQDANFVLGSYKTEQCPKPPRLCRQGYACPHYHNSRDRRRNPRRFQYRSTPCPSVKHGDEWGEPSRCDGGDGCQYCHSRTEQQFHPEIYKSTKCNDMRQTGYCPRGPFCAFAHVEKSLGMVNEWGCHDLHLTSPSSTGSGQPGNAKRRDSPAEGGPRGSEQDSKQNHLAVFAAVHPPAPSVSSSVASSLASSAGSGSSSPTALPAPPARALPLGPASSTVEAVLGSALDLHLSNVNIASLEKDLEEQDGHDLGAAGPRSLAGSAPVAIPGSLPRAPSLHSPSSASTSPLGSLSQPLPGPVGSSAMTPPQQPPPLRSEPGTLGSAASSYSPLGLNGVPGSIWDFVSGSFSPSPSPILSAGPPSSSSASPNGAELARVRRQLDEAKRKIRQWEESWQQVKQVCDAWQREAQEAKERARVADSDRQLALQKKEEVEAQVKQLQEELEGLGVASTLPGLRGCGDIGTIPLPKLHSLQSQLRLDLEAVDGVIFQLRAKQCVACRERAHGAVLRPCQHHILCEPCAATAPECPYCKGQPLQW

SEQ ID NO: 95818 - protein, 76 aa, Homo sapiens
  Payload ID: 19119
  Gene Name: unkempt family zinc finger-like
  ENSP ID: ENSP00000423107
MTPPQQPPPLRSEPGTLGSAASSYSPLGLNGVPGSIWDFVSGSFSPSPSPILSAGPPSSSSASPNGAELARVRRQL

SEQ ID NO: 95819 - protein, 622 aa, Homo sapiens; identical to SEQ ID NO: 17210
  Payload ID: 19120
  Gene Name: UPF0704 protein C6orf165  [Source:UniProtKB/Swiss-Prot
  Acc:Q8IYR0]
  Uniprot ID: Q8IYR0
  ENSP ID: ENSP00000426769

SEQ ID NO: 95820 - protein, 1118 aa, Homo sapiens
  Payload ID: 19121
  Gene Name: UPF1 regulator of nonsense transcripts homolog (yeast)
  Uniprot ID: Q92900
  ENSP ID: ENSP00000262803
MSVEAYGPSSQTLTFLDTEEAELLGADTQGSEFEFTDFTLPSQTQTPPGGPGGPGGGGAGGPGGAGAGAAAGQLDAQVGPEGILQNGAVDDSVAKTSQLLAELNFEEDEEDTYYTKDLPIHACSYCGIHDPACVVYCNTSKKWFCNGRGNTSGSHIVNHLVRAKCKEVTLHKDGPLGETVLECYNCGCRNVFLLGFIPAKADSVVVLLCRQPCASQSSLKDINWDSSQWQPLIQDRCFLSWLVKIPSEQEQLRARQITAQQINKLEELWKENPSATLEDLEKPGVDEEPQHVLLRYEDAYQYQNIFGPLVKLEADYDKKLKESQTQDNITVRWDLGLNKKRIAYFTLPKTDSDMRLMQGDEICLRYKGDLAPLWKGIGHVIKVPDNYGDEIAIELRSSVGAPVEVTHNFQVDFVWKSTSFDRMQSALKTFAVDETSVSGYIYHKLLGHEVEDVIIKCQLPKRFTAQGLPDLNHSQVYAVKTVLQRPLSLIQGPPGTGKTVTSATIVYHLARQGNGPVLVCAPSNIAVDQLTEKIHQTGLKVVRLCAKSREAIDSPVSFLALHNQIRNMDSMPELQKLQQLKDETGELSSADEKRYRALKRTAERELLMNADVICCTCVGAGDPRLAKMQFRSILIDESTQATEPECMVPVVLGAKQLILVGDHCQLGPVVMCKKAAKAGLSQSLFERLVVLGIRPIRLQVQYRMHPALSAFPSNIFYEGSLQNGVTAADRVKKGFDFQWPQPDKPMFFYVTQGQEEIASSGTSYLNRTEAANVEKITTKLLKAGAKPDQIGIITPYEGQRSYLVQYMQFSGSLHTKLYQEVEIASVDAFQGREKDFIILSCVRANEHQGIGFLNDPRRLNVALTRARYGVIIVGNPKALSKQPLWNHLLNYYKEQKVLVEGPLNNLRESLMQFSKPRKLVNTINPGARFMTTAMYDAREAIIPGSVYDRSSQGRPSSMYFQTHDQIGMISAGPSHVAAMNIPIPFNLVMPPMPPPGYFGQANGPAAGRGTPKGKTGRGGRQKNRFGLPGPSQTNLPNSQASQDVASQPFSQGALTQGYISMSQPSQMSQPGLSQPELSQDSYLGDEFKSQIDVALSQDSTYQGERAYQHGGVTGLSQY

SEQ ID NO: 95821 - protein, 1129 aa, Homo sapiens
  Payload ID: 19121
  Gene Name: UPF1 regulator of nonsense transcripts homolog (yeast)
  Uniprot ID: Q92900
  ENSP ID: ENSP00000470142
MSVEAYGPSSQTLTFLDTEEAELLGADTQGSEFEFTDFTLPSQTQTPPGGPGGPGGGGAGGPGGAGAGAAAGQLDAQVGPEGILQNGAVDDSVAKTSQLLAELNFEEDEEDTYYTKDLPIHACSYCGIHDPACVVYCNTSKKWFCNGRGNTSGSHIVNHLVRAKCKEVTLHKDGPLGETVLECYNCGCRNVFLLGFIPAKADSVVVLLCRQPCASQSSLKDINWDSSQWQPLIQDRCFLSWLVKIPSEQEQLRARQITAQQINKLEELWKENPSATLEDLEKPGVDEEPQHVLLRYEDAYQYQNIFGPLVKLEADYDKKLKESQTQDNITVRWDLGLNKKRIAYFTLPKTDSGNEDLVIIWLRDMRLMQGDEICLRYKGDLAPLWKGIGHVIKVPDNYGDEIAIELRSSVGAPVEVTHNFQVDFVWKSTSFDRMQSALKTFAVDETSVSGYIYHKLLGHEVEDVIIKCQLPKRFTAQGLPDLNHSQVYAVKTVLQRPLSLIQGPPGTGKTVTSATIVYHLARQGNGPVLVCAPSNIAVDQLTEKIHQTGLKVVRLCAKSREAIDSPVSFLALHNQIRNMDSMPELQKLQQLKDETGELSSADEKRYRALKRTAERELLMNADVICCTCVGAGDPRLAKMQFRSILIDESTQATEPECMVPVVLGAKQLILVGDHCQLGPVVMCKKAAKAGLSQSLFERLVVLGIRPIRLQVQYRMHPALSAFPSNIFYEGSLQNGVTAADRVKKGFDFQWPQPDKPMFFYVTQGQEEIASSGTSYLNRTEAANVEKITTKLLKAGAKPDQIGIITPYEGQRSYLVQYMQFSGSLHTKLYQEVEIASVDAFQGREKDFIILSCVRANEHQGIGFLNDPRRLNVALTRARYGVIIVGNPKALSKQPLWNHLLNYYKEQKVLVEGPLNNLRESLMQFSKPRKLVNTINPGARFMTTAMYDAREAIIPGSVYDRSSQGRPSSMYFQTHDQIGMISAGPSHVAAMNIPIPFNLVMPPMPPPGYFGQANGPAAGRGTPKGKTGRGGRQKNRFGLPGPSQTNLPNSQASQDVASQPFSQGALTQGYISMSQPSQMSQPGLSQPELSQDSYLGDEFKSQIDVALSQDSTYQGERAYQHGGVTGLSQY

SEQ ID NO: 95822 - protein, 1272 aa, Homo sapiens
  Payload ID: 19122
  Gene Name: UPF2 regulator of nonsense transcripts homolog (yeast)
  Uniprot ID: Q9HAU5
  ENSP ID: ENSP00000348708
MPAERKKPASMEEKDSLPNNKEKDCSERRTVSSKERPKDDIKLTAKKEVSKAPEDKKKRLEDDKRKKEDKERKKKDEEKVKAEEESKKKEEEEKKKHQEEERKKQEEQAKRQQEEEAAAQMKEKEESIQLHQEAWERHHLRKELRSKNQNAPDSRPEENFFSRLDSSLKKNTAFVKKLKTITEQQRDSLSHDFNGLNLSKYIAEAVASIVEAKLKISDVNCAVHLCSLFHQRYADFAPSLLQVWKKHFEARKEEKTPNITKLRTDLRFIAELTIVGIFTDKEGLSLIYEQLKNIINADRESHTHVSVVISFCRHCGDDIAGLVPRKVKSAAEKFNLSFPPSEIISPEKQQPFQNLLKEYFTSLTKHLKRDHRELQNTERQNRRILHSKGELSEDRHKQYEEFAMSYQKLLANSQSLADLLDENMPDLPQDKPTPEEHGPGIDIFTPGKPGEYDLEGGIWEDEDARNFYENLIDLKAFVPAILFKDNEKSCQNKESNKDDTKEAKESKENKEVSSPDDLELELENLEINDDTLELEGGDEAEDLTKKLLDEQEQEDEEASTGSHLKLIVDAFLQQLPNCVNRDLIDKAAMDFCMNMNTKANRKKLVRALFIVPRQRLDLLPFYARLVATLHPCMSDVAEDLCSMLRGDFRFHVRKKDQINIETKNKTVRFIGELTKFKMFTKNDTLHCLKMLLSDFSHHHIEMACTLLETCGRFLFRSPESHLRTSVLLEQMMRKKQAMHLDARYVTMVENAYYYCNPPPAEKTVKKKRPPLQEYVRKLLYKDLSKVTTEKVLRQMRKLPWQDQEVKDYVICCMINIWNVKYNSIHCVANLLAGLVLYQEDVGIHVVDGVLEDIRLGMEVNQPKFNQRRISSAKFLGELYNYRMVESAVIFRTLYSFTSFGVNPDGSPSSLDPPEHLFRIRLVCTILDTCGQYFDRGSSKRKLDCFLVYFQRYVWWKKSLEVWTKDHPFPIDIDYMISDTLELLRPKIKLCNSLEESIRQVQDLEREFLIKLGLVNDKDSKDSMTEGENLEEDEEEEEGGAETEEQSGNESEVNEPEEEEGSDNDDDEGEEEEEENTDYLTDSNKENETDEENTEVMIKGGGLKHVPCVEDEDFIQALDKMMLENLQQRSGESVKVHQLDVAIPLHLKSQLRKGPPLGGGEGEAESADTMPFVMLTRKGNKQQFKILNVPMSSQLAANHWNQQQAEQEERMRMKKLTLDINERQEQEDYQEMLQSLAQRPAPANTNRERRPRYQHPKGAPNADLIFKTGGRRR

SEQ ID NO: 95823 - protein, 1272 aa, Homo sapiens; identical to SEQ ID NO: 95822
  Payload ID: 19122
  Gene Name: UPF2 regulator of nonsense transcripts homolog (yeast)
  Uniprot ID: Q9HAU5
  ENSP ID: ENSP00000350221

SEQ ID NO: 95824 - protein, 1272 aa, Homo sapiens; identical to SEQ ID NO: 95822
  Payload ID: 19122
  Gene Name: UPF2 regulator of nonsense transcripts homolog (yeast)
  Uniprot ID: Q9HAU5
  ENSP ID: ENSP00000380244

SEQ ID NO: 95825 - protein, 443 aa, Homo sapiens
  Payload ID: 19123
  Gene Name: UPF3 regulator of nonsense transcripts homolog A (yeast)
  Uniprot ID: Q9H1J1
  ENSP ID: ENSP00000329592
MRSEKEGAGGLRAAVAARGPSGREKLSALEVQFHRDSQQQEAETPPTSSSGCGGGAGKPREEKRTALSKVVIRRLPPGLTKEQLEEQLRPLPAHDYFEFFAADLSLYPHLYSRAYINFRNPDDILLFRDRFDGYIFLDSKDPEYKKFLETYCVEEEKTSANPETLLGEMEAKTRELIARRTTPLLEYIKNRKLEKQRIREEKREERRRRELEKKRLREEEKRRRREEERCKKKETDKQKKIAEKEVRIKLLKKPEKGEEPTTEKPKERGEEIDTGGGKQESCAPGAVVKARPMEGSLEEPQETSHSGSDKEHRDVERSQEQESEAQRYHVDDGRRHRAHHEPERLSRRSEDEQRWGKGPGQDRGKKGSQDSGAPGEAMERLGRAQRCDDSPAPRKERLANKDRPALQLYDPGARFRARECGGNRRICKAEGSGTGPEKREEAE

SEQ ID NO: 95826 - protein, 476 aa, Homo sapiens
  Payload ID: 19123
  Gene Name: UPF3 regulator of nonsense transcripts homolog A (yeast)
  Uniprot ID: Q9H1J1
  ENSP ID: ENSP00000364448
MRSEKEGAGGLRAAVAARGPSGREKLSALEVQFHRDSQQQEAETPPTSSSGCGGGAGKPREEKRTALSKVVIRRLPPGLTKEQLEEQLRPLPAHDYFEFFAADLSLYPHLYSRAYINFRNPDDILLFRDRFDGYIFLDSKGLEYPAVVEFAPFQKIAKKKLRKKDAKTGSIEDDPEYKKFLETYCVEEEKTSANPETLLGEMEAKTRELIARRTTPLLEYIKNRKLEKQRIREEKREERRRRELEKKRLREEEKRRRREEERCKKKETDKQKKIAEKEVRIKLLKKPEKGEEPTTEKPKERGEEIDTGGGKQESCAPGAVVKARPMEGSLEEPQETSHSGSDKEHRDVERSQEQESEAQRYHVDDGRRHRAHHEPERLSRRSEDEQRWGKGPGQDRGKKGSQDSGAPGEAMERLGRAQRCDDSPAPRKERLANKDRPALQLYDPGARFRARECGGNRRICKAEGSGTGPEKREEAE

SEQ ID NO: 95827 - protein, 105 aa, Homo sapiens
  Payload ID: 19123
  Gene Name: UPF3 regulator of nonsense transcripts homolog A (yeast)
  ENSP ID: ENSP00000482320
MRSEKEGAGGLRAAVAARGPSGREKLSALEVQFHRDSQQQEAETPPTSSSGCGGGAGKPREEKRTALSKVVIRRLPPGLTKEQLEEQLRPLPAHDYFEFFAADLR

SEQ ID NO: 95828 - protein, 470 aa, Homo sapiens
  Payload ID: 19124
  Gene Name: UPF3 regulator of nonsense transcripts homolog B (yeast)
  Uniprot ID: Q9BZI7
  ENSP ID: ENSP00000245418
MKEEKEHRPKEKRVTLLTPAGATGSGGGTSGDSSKGEDKQDRNKEKKEALSKVVIRRLPPTLTKEQLQEHLQPMPEHDYFEFFSNDTSLYPHMYARAYINFKNQEDIILFRDRFDGYVFLDNKGQEYPAIVEFAPFQKAAKKKTKKRDTKVGTIDDDPEYRKFLESYATDNEKMTSTPETLLEEIEAKNRELIAKKTTPLLSFLKNKQRMREEKREERRRREIERKRQREEERRKWKEEEKRKRKDIEKLKKIDRIPERDKLKDEPKIKLLKKPEKGDEKELDKREKAKKLDKENLSDERASGQSCTLPKRSDSELKDEKPKRPEDESGRDYREREREYERDQERILRERERLKRQEEERRRQKERYEKEKTFKRKEEEMKKEKDTLRDKGKKAESTESIGSSEKTEKKEEVVKRDRIRNKDRPAMQLYQPGARSRNRLCPPDDSTKSGDSAAERKQESGISHRKEGGEE

SEQ ID NO: 95829 - protein, 483 aa, Homo sapiens
  Payload ID: 19124
  Gene Name: UPF3 regulator of nonsense transcripts homolog B (yeast)
  Uniprot ID: Q9BZI7
  ENSP ID: ENSP00000276201
MKEEKEHRPKEKRVTLLTPAGATGSGGGTSGDSSKGEDKQDRNKEKKEALSKVVIRRLPPTLTKEQLQEHLQPMPEHDYFEFFSNDTSLYPHMYARAYINFKNQEDIILFRDRFDGYVFLDNKGQEYPAIVEFAPFQKAAKKKTKKRDTKVGTIDDDPEYRKFLESYATDNEKMTSTPETLLEEIEAKNRELIAKKTTPLLSFLKNKQRMREEKREERRRREIERKRQREEERRKWKEEEKRKRKDIEKLKKIDRIPERDKLKDEPKIKVHRFLLQAVNQKNLLKKPEKGDEKELDKREKAKKLDKENLSDERASGQSCTLPKRSDSELKDEKPKRPEDESGRDYREREREYERDQERILRERERLKRQEEERRRQKERYEKEKTFKRKEEEMKKEKDTLRDKGKKAESTESIGSSEKTEKKEEVVKRDRIRNKDRPAMQLYQPGARSRNRLCPPDDSTKSGDSAAERKQESGISHRKEGGEE

SEQ ID NO: 95830 - protein, 217 aa, Homo sapiens [sequence omitted]

SEQ ID NO: 95831 - protein, 138 aa, Homo sapiens
  Payload ID: 19125
  Gene Name: upper zone of growth plate and cartilage matrix associated
  Uniprot ID: Q8WVF2
  ENSP ID: ENSP00000367952
MTWRQAVLLSCFSAVVLLSMLREGTSVSVGTMQMAGEEASEDAKQKIFMQESDASNFLKRRGKRSPKSRDEVNVENRQKLRVDELRREYYEEQRNEFENFVEEQNDEQEERSREAVEQWRQWHYDGLHPSYLYNRHHT

SEQ ID NO: 95832 - protein, 116 aa, Homo sapiens
  Payload ID: 19125
  Gene Name: upper zone of growth plate and cartilage matrix associated
  ENSP ID: ENSP00000473368
MTWRQAVLLSCFSAVVLLSNAKQKIFMQESDASNFLKRRGKRSPKSRDEVNVENRQKLRVDELRREYYEEQRNEFENFVEEQNDEQEERSREAVEQWRQWHYDGLHPSYLYNRHHT

SEQ ID NO: 95833 - protein, 58 aa, Homo sapiens
  Payload ID: 19126
  Gene Name: up-regulated during skeletal muscle growth 5 homolog (mouse)
  Uniprot ID: Q96IX5
  ENSP ID: ENSP00000311245
MAGPESDAQYQFTGIKKYFNSYTLTGRMNCVLATYGSIALIVLYFKLRSKKTPAVKAT

SEQ ID NO: 95834 - protein, 58 aa, Homo sapiens; identical to SEQ ID NO: 95833
  Payload ID: 19126
  Gene Name: up-regulated during skeletal muscle growth 5 homolog (mouse)
  Uniprot ID: Q96IX5
  ENSP ID: ENSP00000337705

SEQ ID NO: 95835 - protein, 58 aa, Homo sapiens; identical to SEQ ID NO: 95833
  Payload ID: 19126
  Gene Name: up-regulated during skeletal muscle growth 5 homolog (mouse)
  Uniprot ID: Q96IX5
  ENSP ID: ENSP00000358826

SEQ ID NO: 95836 - protein, 58 aa, Homo sapiens; identical to SEQ ID NO: 95833
  Payload ID: 19126
  Gene Name: up-regulated during skeletal muscle growth 5 homolog (mouse)
  Uniprot ID: Q96IX5
  ENSP ID: ENSP00000358830

SEQ ID NO: 95837 - protein, 58 aa, Homo sapiens; identical to SEQ ID NO: 95833
  Payload ID: 19126
  Gene Name: up-regulated during skeletal muscle growth 5 homolog (mouse)
  Uniprot ID: Q96IX5
  ENSP ID: ENSP00000358840

SEQ ID NO: 95838 - protein, 888 aa, Homo sapiens
  Payload ID: 19127
  Gene Name: upregulator of cell proliferation
  Uniprot ID: Q8TCY9
  ENSP ID: ENSP00000336872
MEGDDCEFRYGDGTNEAQDNDFPTVERSRLQEMLSLLGLETYQVQKLSLQDSLQISFDSMKNWAPQVPKDLPWNFLRKLQALNADARNTTMVLDVLPDARPVEKESQMEEEIIYWDPADDLAADIYSFSELPTPDTPVNPLDLLCALLLSSDSFLQQEIALKMALCQFALPLVLPDSENHYHTFLLWAMRGIVRTWWSQPPRGMGSFREDSVVLSRAPAFAFVRMDVSSNSKSQLLNAVLSPGHRQWDCFWHRDLNLGTNAREISDGLVEISWFFPSGREDLDIFPEPVAFLNLRGDIGSHWLQFKLLTEISSAVFILTDNISKKEYKLLYSMKESTTKYYFILSPYRGKRNTNLRFLNKLIPVLKIDHSHVLVKVSSTDSDSFVKRIRAIVGNVLRAPCRRVSVEDMAHAARKLGLKVDEDCEECQKAKDRMERITRKIKDSDAYRRDELRLQGDPWRKAAQVEKEFCQLQWAVDPPEKHRAELRRRLLELRMQQNGHDPSSGVQEFISGISSPSLSEKQYFLRWMEWGLARVAQPRLRQPPETLLTLRPKHGGTTDVGEPLWPEPLGVEHFLREMGQFYEAESCLVEAGRLPAGQRRFAHFPGLASELLLTGLPLELIDGSTLSMPVRWVTGLLKELHVRLERRSRLVVLSTVGVPGTGKSTLLNTMFGLRFATGKSCGPRGAFMQLITVAEGFSQDLGCDHILVIDSGGLIGGALTSAGDRFELEASLATLLMGLSNVTVISLAETKDIPAAILHAFLRLEKTGHMPNYQFVYQNLHDVSVPGPRPRDKRQLLDPPGDLSRAAAQMEKQGDGFRALAGLAFCDPEKQHIWHIPGLWHGAPPMAAVSLAYSEAIFELKRCLLENIRNGLSNQNKNIQQLIELVRRL

SEQ ID NO: 95839 - protein, 922 aa, Homo sapiens
  Payload ID: 19127
  Gene Name: upregulator of cell proliferation
  Uniprot ID: Q8TCY9
  ENSP ID: ENSP00000384955
MASPGHSDLGEVAPEIKASERRTAVAIADLEWREMEGDDCEFRYGDGTNEAQDNDFPTVERSRLQEMLSLLGLETYQVQKLSLQDSLQISFDSMKNWAPQVPKDLPWNFLRKLQALNADARNTTMVLDVLPDARPVEKESQMEEEIIYWDPADDLAADIYSFSELPTPDTPVNPLDLLCALLLSSDSFLQQEIALKMALCQFALPLVLPDSENHYHTFLLWAMRGIVRTWWSQPPRGMGSFREDSVVLSRAPAFAFVRMDVSSNSKSQLLNAVLSPGHRQWDCFWHRDLNLGTNAREISDGLVEISWFFPSGREDLDIFPEPVAFLNLRGDIGSHWLQFKLLTEISSAVFILTDNISKKEYKLLYSMKESTTKYYFILSPYRGKRNTNLRFLNKLIPVLKIDHSHVLVKVSSTDSDSFVKRIRAIVGNVLRAPCRRVSVEDMAHAARKLGLKVDEDCEECQKAKDRMERITRKIKDSDAYRRDELRLQGDPWRKAAQVEKEFCQLQWAVDPPEKHRAELRRRLLELRMQQNGHDPSSGVQEFISGISSPSLSEKQYFLRWMEWGLARVAQPRLRQPPETLLTLRPKHGGTTDVGEPLWPEPLGVEHFLREMGQFYEAESCLVEAGRLPAGQRRFAHFPGLASELLLTGLPLELIDGSTLSMPVRWVTGLLKELHVRLERRSRLVVLSTVGVPGTGKSTLLNTMFGLRFATGKSCGPRGAFMQLITVAEGFSQDLGCDHILVIDSGGLIGGALTSAGDRFELEASLATLLMGLSNVTVISLAETKDIPAAILHAFLRLEKTGHMPNYQFVYQNLHDVSVPGPRPRDKRQLLDPPGDLSRAAAQMEKQGDGFRALAGLAFCDPEKQHIWHIPGLWHGAPPMAAVSLAYSEAIFELKRCLLENIRNGLSNQNKNIQQLIELVRRL

SEQ ID NO: 95840 - protein, 163 aa, Homo sapiens
  Payload ID: 19127
  Gene Name: upregulator of cell proliferation
  ENSP ID: ENSP00000389990
MEGDDCEFRYGDGTNEAQDNDFPTVERSRLQEMLSLLGLETYQVQKLSLQDSLQISFDSMKNWAPQVPKDLPWNFLRKLQALNADARNTTMVLDVLPDARPVEKESQMEEEIIYWDPADDLAADIYSFSELPTPDTPVNPLDLLCALLLSSDSFLQQEIALKM

SEQ ID NO: 95841 - protein, 888 aa, Homo sapiens; identical to SEQ ID NO: 95838
  Payload ID: 19127
  Gene Name: upregulator of cell proliferation
  Uniprot ID: Q8TCY9
  ENSP ID: ENSP00000392136

SEQ ID NO: 95842 - protein, 122 aa, Homo sapiens
  Payload ID: 19127
  Gene Name: upregulator of cell proliferation
  ENSP ID: ENSP00000392963
MEGDDCEFRYGDGTNEAQDNDFPTVERSRLQEMLSLLGLETYQVQKLSLQDSLQISFDSMKNWAPQVPKDLPWNFLRKLQALNADARNTTMVLDVLPDARPVEKESQMEEEIIYWDPADDLA

SEQ ID NO: 95843 - protein, 931 aa, Homo sapiens
  Payload ID: 19127
  Gene Name: upregulator of cell proliferation
  Uniprot ID: Q8TCY9
  ENSP ID: ENSP00000396918
MASPGIEVELLGKGHSDLGEVAPEIKASERRTAVAIADLEWREMEGDDCEFRYGDGTNEAQDNDFPTVERSRLQEMLSLLGLETYQVQKLSLQDSLQISFDSMKNWAPQVPKDLPWNFLRKLQALNADARNTTMVLDVLPDARPVEKESQMEEEIIYWDPADDLAADIYSFSELPTPDTPVNPLDLLCALLLSSDSFLQQEIALKMALCQFALPLVLPDSENHYHTFLLWAMRGIVRTWWSQPPRGMGSFREDSVVLSRAPAFAFVRMDVSSNSKSQLLNAVLSPGHRQWDCFWHRDLNLGTNAREISDGLVEISWFFPSGREDLDIFPEPVAFLNLRGDIGSHWLQFKLLTEISSAVFILTDNISKKEYKLLYSMKESTTKYYFILSPYRGKRNTNLRFLNKLIPVLKIDHSHVLVKVSSTDSDSFVKRIRAIVGNVLRAPCRRVSVEDMAHAARKLGLKVDEDCEECQKAKDRMERITRKIKDSDAYRRDELRLQGDPWRKAAQVEKEFCQLQWAVDPPEKHRAELRRRLLELRMQQNGHDPSSGVQEFISGISSPSLSEKQYFLRWMEWGLARVAQPRLRQPPETLLTLRPKHGGTTDVGEPLWPEPLGVEHFLREMGQFYEAESCLVEAGRLPAGQRRFAHFPGLASELLLTGLPLELIDGSTLSMPVRWVTGLLKELHVRLERRSRLVVLSTVGVPGTGKSTLLNTMFGLRFATGKSCGPRGAFMQLITVAEGFSQDLGCDHILVIDSGGLIGGALTSAGDRFELEASLATLLMGLSNVTVISLAETKDIPAAILHAFLRLEKTGHMPNYQFVYQNLHDVSVPGPRPRDKRQLLDPPGDLSRAAAQMEKQGDGFRALAGLAFCDPEKQHIWHIPGLWHGAPPMAAVSLAYSEAIFELKRCLLENIRNGLSNQNKNIQQLIELVRRL

SEQ ID NO: 95844 - protein, 96 aa, Homo sapiens
  Payload ID: 19127
  Gene Name: upregulator of cell proliferation
  ENSP ID: ENSP00000409496
MASPGHSDLGEVAPEIKASERRTAVAIADLEWREMEGDDCEFRYGDGTNEAQDNDFPTDQDTGPRASKQPAKGHTLGRSVFFVFFPLPFTTMLLKK

SEQ ID NO: 95845 - protein, 181 aa, Homo sapiens
  Payload ID: 19127
  Gene Name: upregulator of cell proliferation
  ENSP ID: ENSP00000412599
MEGDDCEFRYGDGTNEAQDNDFPTVERSRLQEMLSLLGLETYQVQKLSLQDSLQISFDSMKNWAPQVPKDLPWNFLRKLQALNADARNTTMVLDVLPDARPVEKESQMEEEIIYWDPADDLAADIYSFSELPTPDTPVNPLDLLCALLLSSDSFLQQEIALKMALCQFALPLVLPDSENHY

SEQ ID NO: 95846 - protein, 540 aa, Homo sapiens
  Payload ID: 19128
  Gene Name: upstream binding protein 1 (LBP-1a)
  Uniprot ID: Q9NZI7
  ENSP ID: ENSP00000283628
MAWVLKMDEVIESGLVHDFDASLSGIGQELGAGAYSMSDVLALPIFKQEDSSLPLDGETEHPPFQYVMCAATSPAVKLHDETLTYLNQGQSYEIRMLDNRKMGDMPEINGKLVKSIIRVVFHDRRLQYTEHQQLEGWKWNRPGDRLLDLDIPMSVGIIDTRTNPSQLNAVEFLWDPAKRTSAFIQVHCISTEFTPRKHGGEKGVPFRIQVDTFKQNENGEYTDHLHSASCQIKVFKPKGADRKQKTDREKMEKRTAHEKEKYQPSYDTTILTEMRLEPIIEDAVEHEQKKSSKRTLPADYGDSLAKRGSCSPWPDAPTAYVNNSPSPAPTFTSPQQSTCSVPDSNSSSPNHQGDGASQTSGEQIQPSATIQETQQWLLKNRFSSYTRLFSNFSGADLLKLTKEDLVQICGAADGIRLYNSLKSRSVRPRLTIYVCREQPSSTVLQGQQQAASSASENGSGAPYVYHAIYLEEMIASEVARKLALVFNIPLHQINQVYRQGPTGIHILVSDQMVQNFQDESCFLFSTVKAESSDGIHIILK

SEQ ID NO: 95847 - protein, 540 aa, Homo sapiens; identical to SEQ ID NO: 95846
  Payload ID: 19128
  Gene Name: upstream binding protein 1 (LBP-1a)
  Uniprot ID: Q9NZI7
  ENSP ID: ENSP00000283629

SEQ ID NO: 95848 - protein, 164 aa, Homo sapiens
  Payload ID: 19128
  Gene Name: upstream binding protein 1 (LBP-1a)
  ENSP ID: ENSP00000393842
MEKRTAHEKEKYQPSYDTTILTECSPWPDAPTAYVNNSPSPAPTFTSPQQSTCSVPDSNSSSPNHQGDGASQTSGEQIQPSATIQETQQWLLKNRFSSYTRLFSNFSGADLLKLTKEDLVQICGAADGIRLYNSLKSRAGPDMMQALMRAEVDCKTGRNAHGQY

SEQ ID NO: 95849 - protein, 504 aa, Homo sapiens
  Payload ID: 19128
  Gene Name: upstream binding protein 1 (LBP-1a)
  Uniprot ID: Q9NZI7
  ENSP ID: ENSP00000395558
MAWVLKMDEVIESGLVHDFDASLSGIGQELGAGAYSMSDVLALPIFKQEDSSLPLDGETEHPPFQYVMCAATSPAVKLHDETLTYLNQGQSYEIRMLDNRKMGDMPEINGKLVKSIIRVVFHDRRLQYTEHQQLEGWKWNRPGDRLLDLDIPMSVGIIDTRTNPSQLNAVEFLWDPAKRTSAFIQVHCISTEFTPRKHGGEKGVPFRIQVDTFKQNENGEYTDHLHSASCQIKVFKPKGADRKQKTDREKMEKRTAHEKEKYQPSYDTTILTECSPWPDAPTAYVNNSPSPAPTFTSPQQSTCSVPDSNSSSPNHQGDGASQTSGEQIQPSATIQETQQWLLKNRFSSYTRLFSNFSGADLLKLTKEDLVQICGAADGIRLYNSLKSRSVRPRLTIYVCREQPSSTVLQGQQQAASSASENGSGAPYVYHAIYLEEMIASEVARKLALVFNIPLHQINQVYRQGPTGIHILVSDQMVQNFQDESCFLFSTVKAESSDGIHIILK

SEQ ID NO: 95850 - protein, 148 aa, Homo sapiens
  Payload ID: 19128
  Gene Name: upstream binding protein 1 (LBP-1a)
  ENSP ID: ENSP00000401614
MAWVLKMDEVIESGLVHDFDASLSGIGQELGAGAYSMSDVLALPIFKQEDSSLPLDGETEHPPFQYVMCAATSPAVKLHDETLTYLNQGQSYEIRMLDNRKMGDMPEINGKLVKSIIRVVFHDRRLQYTEHQQLEGWKWNRPGDRLLD

SEQ ID NO: 95851 - protein, 764 aa, Homo sapiens
  Payload ID: 19129
  Gene Name: upstream binding transcription factor, RNA polymerase I
  Uniprot ID: P17480
  ENSP ID: ENSP00000302640
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDATTKEVKDSLGKQWSQLSDKKRLKWIHKALEQRKEYEEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQATSPASKKPAQEGGKGGSEKPKRPVSAMFIFSEEKRRQLQEERPELSESELTRLLARMWNDLSEKKKAKYKAREAALKAQSERKPGGEREERGKLPESPKRAEEIWQQSVIGDYLARFKNDRVKALKAMEMTWNNMEKKEKLMWIKKAAEDQKRYERELSEMRAPPAATNSSKKMKFQGEPKKPPMNGYQKFSQELLSNGELNHLPLKERMVEIGSRWQRISQSQKEHYKKLAEEQQKQYKVHLDLWVKSLSPQDRAAYKEYISNKRKSMTKLRGPNPKSSRTTLQSKSESEEDDEEDEDDEDEDEEEEDDENGDSSEDGGDSSESSSEDESEDGDENEEDDEDEDDDEDDDEDEDNESEGSSSSSSSSGDSSDSDSN

SEQ ID NO: 95852 - protein, 727 aa, Homo sapiens
  Payload ID: 19129
  Gene Name: upstream binding transcription factor, RNA polymerase I
  Uniprot ID: P17480
  ENSP ID: ENSP00000345297
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQATSPASKKPAQEGGKGGSEKPKRPVSAMFIFSEEKRRQLQEERPELSESELTRLLARMWNDLSEKKKAKYKAREAALKAQSERKPGGEREERGKLPESPKRAEEIWQQSVIGDYLARFKNDRVKALKAMEMTWNNMEKKEKLMWIKKAAEDQKRYERELSEMRAPPAATNSSKKMKFQGEPKKPPMNGYQKFSQELLSNGELNHLPLKERMVEIGSRWQRISQSQKEHYKKLAEEQQKQYKVHLDLWVKSLSPQDRAAYKEYISNKRKSMTKLRGPNPKSSRTTLQSKSESEEDDEEDEDDEDEDEEEEDDENGDSSEDGGDSSESSSEDESEDGDENEEDDEDEDDDEDDDEDEDNESEGSSSSSSSSGDSSDSDSN

SEQ ID NO: 95853 - protein, 727 aa, Homo sapiens; identical to SEQ ID NO: 95852
  Payload ID: 19129
  Gene Name: upstream binding transcription factor, RNA polymerase I
  Uniprot ID: P17480
  ENSP ID: ENSP00000377231

SEQ ID NO: 95854 - protein, 764 aa, Homo sapiens; identical to SEQ ID NO: 95851
  Payload ID: 19129
  Gene Name: upstream binding transcription factor, RNA polymerase I
  Uniprot ID: P17480
  ENSP ID: ENSP00000390669

SEQ ID NO: 95855 - protein, 194 aa, Homo sapiens
  Payload ID: 19129
  Gene Name: upstream binding transcription factor, RNA polymerase I
  ENSP ID: ENSP00000431295
MFIFSEEKRRQLQEERPELSESELTRLLARMWNDLSEKKKAKYKAREAALKAQSERKPGGEREERGKLPESPKRAEEIWQQSVIGDYLARFKNDRVKALKAMEMTWNNMEKKEKLMWIKKAAEDQKRYERELSEMRAPPAATNSSKKMKFQGEPKKPPMNGYQKFSQELLSNGELNHLPLKERMVEIGSRWQRI

SEQ ID NO: 95856 - protein, 745 aa, Homo sapiens
  Payload ID: 19129
  Gene Name: upstream binding transcription factor, RNA polymerase I
  ENSP ID: ENSP00000431539
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQATSPASKKPAQEGGKGGSEKPKRPVSAMFIFSEEKRRQLQEERPELSESELTRLLARMWNDLSEKKKAKYKAREAALKAQSERKPGGEREERGKLPESPKRAEEIWQQSVIGDYLARFKNDRVKALKAMEMTWNNMEKKEKLMWIKKAAEDQKRYERELSEMRAPPAATNSSKKMKFQGEPKKPPMNGYQKFSQELLSNGELNHLPLKERMVEIGSRWQRISQSQKEHYKKLAEEQQKQYKVHLDLWVKSLSPQDRAAYKEYISNKRKSMTKLRGPNPKSSRTTLQSKSPRRMMKRMRMTRTRMKKRKMMRMGTPLKMAATPLSPAARTRARMGMRMKRMTRTKTTTRMTMRMKIMSPRAAAPAPPPQGTPQTLTPTEAQPHPRAARESPGAPLPN

SEQ ID NO: 95857 - protein, 727 aa, Homo sapiens; identical to SEQ ID NO: 95852
  Payload ID: 19129
  Gene Name: upstream binding transcription factor, RNA polymerase I
  Uniprot ID: P17480
  ENSP ID: ENSP00000432925

SEQ ID NO: 95858 - protein, 149 aa, Homo sapiens
  Payload ID: 19129
  Gene Name: upstream binding transcription factor, RNA polymerase I
  ENSP ID: ENSP00000433046
MNGEADCPTDLEMAAPKGQDRWSQEDMLTLLECMKNNLPSNDSSKFKTTESHMDWEKVAFKDFSGDMCKLKWVEISNEKHPDFPKKPLTPYFRFFMEKRAKYAKLHPEMSNLDLTKILSKKYKELPEKKKMKYIQDFQREKQEFERNLA

SEQ ID NO: 95859 - protein, 36 aa, Homo sapiens
  Payload ID: 19129
  Gene Name: upstream binding transcription factor, RNA polymerase I
  ENSP ID: ENSP00000433625
  MOD_RES (1)..(1): Any amino acid
XEHYKKLAEEQQKQYKVHLDLWVKRWAGWSRTPDLM

SEQ ID NO: 95860 - protein, 764 aa, Homo sapiens; identical to SEQ ID NO: 95851
  Payload ID: 19129
  Gene Name: upstream binding transcription factor, RNA polymerase I
  Uniprot ID: P17480
  ENSP ID: ENSP00000435708

SEQ ID NO: 95861 - protein, 727 aa, Homo sapiens; identical to SEQ ID NO: 95852
  Payload ID: 19129
  Gene Name: upstream binding transcription factor, RNA polymerase I
  Uniprot ID: P17480
  ENSP ID: ENSP00000437180

SEQ ID NO: 95862 - protein, 393 aa, Homo sapiens
  Payload ID: 19130
  Gene Name: upstream binding transcription factor, RNA polymerase I-like 1
  Uniprot ID: P0CB47
  ENSP ID: ENSP00000485108
MALPRSQGHWSNKDILRLLECMENNRPSDDNSTFSSTQSHMDWGKVAFKNFSGEMCRLKWLEISCNLRKFGTLKELVLEAKKCVKKMNKSQKYRNGPDFPKRPLTAYNRFFKESWPQYSQMYPGMRSQELTKILSKKYRELPEQMKQKYIQDFRKEKQEFEEKLARFREEHPDLVQKAKKSSVSKRTQNKVQKKFQKNIEEVRSLPKTDRFFKKVKFHGEPQKPPMNGYHKFHQDSWSSKEMQHLSVRERMVEIGRRWQRIPQSQKDHFKSQAEELQKQYKVKLDLWLKTLSPENYAAYKESTYAKGKNMAMTGGPDPRLKQADPQSSSAKGLQEGFGEGQGLQAAGTDSSQTIWVNCHVSMEPEENRKKDREKEESSNSSDCSSGEEIEVDV

SEQ ID NO: 95863 - protein, 282 aa, Homo sapiens
  Payload ID: 19131
  Gene Name: upstream transcription factor 1
  ENSP ID: ENSP00000356998
MKGQQKTAETEEGTVQIQEGAVATGEDPTSVAIASIQSAATFPDPNVKYVFRTENGGQVMYRVIQVSEGQLDGQTEGTGAISGYPATQSMTQAVIQGAFTSDDAVDTEGTAAETHYTYFPSTAVGDGAGGQFFVMMSPQEVLQGGSQRSIAPRTHPYSPKSEAPRTTRDEKRRAQHNEVERRRRDKINNWIVQLSKIIPDCSMESTKSGQSKGGILSKACDYIQELRQSNHRLSEELQGLDQLQLDNDVLRQQVEDLKNKNLLLRAQLRHHGLEVVIKNDSN

SEQ ID NO: 95864 - protein, 310 aa, Homo sapiens
  Payload ID: 19131
  Gene Name: upstream transcription factor 1
  Uniprot ID: P22415
  ENSP ID: ENSP00000356999
MKGQQKTAETEEGTVQIQEGAVATGEDPTSVAIASIQSAATFPDPNVKYVFRTENGGQVMYRVIQVSEGQLDGQTEGTGAISGYPATQSMTQAVIQGAFTSDDAVDTEGTAAETHYTYFPSTAVGDGAGGTTSGSTAAVVTTQGSEALLGQATPPGTGQFFVMMSPQEVLQGGSQRSIAPRTHPYSPKSEAPRTTRDEKRRAQHNEVERRRRDKINNWIVQLSKIIPDCSMESTKSGQSKGGILSKACDYIQELRQSNHRLSEELQGLDQLQLDNDVLRQQVEDLKNKNLLLRAQLRHHGLEVVIKNDSN

SEQ ID NO: 95865 - protein, 310 aa, Homo sapiens; identical to SEQ ID NO: 95864
  Payload ID: 19131
  Gene Name: upstream transcription factor 1
  Uniprot ID: P22415
  ENSP ID: ENSP00000357000

SEQ ID NO: 95866 - protein, 105 aa, Homo sapiens
  Payload ID: 19131
  Gene Name: upstream transcription factor 1
  ENSP ID: ENSP00000432533
MYRVIQVSEGQLDGQTEGTGAISGYPATQSMTQAVIQGAFTSDDAVDTEGTAAETHYTYFPSTAVGDGAGGTTSGSTAAVVTTQGSEALLGQATPPGTGQFFVMM

SEQ ID NO: 95867 - protein, 165 aa, Homo sapiens
  Payload ID: 19131
  Gene Name: upstream transcription factor 1
  ENSP ID: ENSP00000433041
  MOD_RES (1)..(1): Any amino acid
XSTAAVVTTQGSEALLGQATPPGTGQFFVMMSPQEVLQGGSQRSIAPRTHPYSPKSEAPRTTRDEKRRAQHNEVERRRRDKINNWIVQLSKIIPDCSMESTKSGQVGFYPKLVIISRSFGRVTTACLKNCRDLTNCSWTMTCFDNRWKILKTRICCFELSCGTTD

SEQ ID NO: 95868 - protein, 217 aa, Homo sapiens
  Payload ID: 19131
  Gene Name: upstream transcription factor 1
  ENSP ID: ENSP00000435005
MKGQQKTAETEEGTVQIQEGAVATGEDPTSVAIASIQSAATFPDPNVKYVFRTENGGQVMYRVIQVSEGQLDGQTEGTGAISGYPATQSMTQAVIQGQFFVMMSPQEVLQGGSQRSIAPRTHPYSPKSEAPRTTRDEKRRAQHNEVERRRRDKINNWIVQLSKIIPDCSMESTKSGQSKGGILSKACDYIQELRQSNHRLSEELQGLDQLQLDNDVL

SEQ ID NO: 95869 - protein, 48 aa, Homo sapiens
  Payload ID: 19131
  Gene Name: upstream transcription factor 1
  ENSP ID: ENSP00000435671
MKGQQKTAETEEGTVQIQEGAVATGEDPTSVAIASIQSAATFPDPNVK

SEQ ID NO: 95870 - protein, 346 aa, Homo sapiens
  Payload ID: 19132
  Gene Name: upstream transcription factor 2, c-fos interacting
  Uniprot ID: Q15853
  ENSP ID: ENSP00000222305
MDMLDPGLDPAASATAAAAASHDKGPEAEEGVELQEGGDGPGAEEQTAVAITSVQQAAFGDHNIQYQFRTETNGGQVTYRVVQVTDGQLDGQGDTAGAVSVVSTAAFAGGQQAVTQVGVDGAAQRPGPAAASVPPGPAAPFPLAVIQNPFSNGGSPAAEAVSGEARFAYFPASSVGDTTAVSVQTTDQSLQAGGQFYVMMTPQDVLQTGTQRTIAPRTHPYSPKIDGTRTPRDERRRAQHNEVERRRRDKINNWIVQLSKIIPDCNADNSKTGASKGGILSKACDYIRELRQTNQRMQETFKEAERLQMDNELLRQQIEELKNENALLRAQLQQHNLEMVGEGTRQ

SEQ ID NO: 95871 - protein, 279 aa, Homo sapiens
  Payload ID: 19132
  Gene Name: upstream transcription factor 2, c-fos interacting
  Uniprot ID: Q15853
  ENSP ID: ENSP00000340633
MDMLDPGLDPAASATAAAAASHDKGPEAEEGVELQEGGDGPGAEEQTAVAITSVQQAAFGDHNIQYQFRTETNGGQAVIQNPFSNGGSPAAEAVSGEARFAYFPASSVGDTTAVSVQTTDQSLQAGGQFYVMMTPQDVLQTGTQRTIAPRTHPYSPKIDGTRTPRDERRRAQHNEVERRRRDKINNWIVQLSKIIPDCNADNSKTGASKGGILSKACDYIRELRQTNQRMQETFKEAERLQMDNELLRQQIEELKNENALLRAQLQQHNLEMVGEGTRQ

SEQ ID NO: 95872 - protein, 215 aa, Homo sapiens
  Payload ID: 19132
  Gene Name: upstream transcription factor 2, c-fos interacting
  Uniprot ID: Q15853
  ENSP ID: ENSP00000368429
MDMLDPGLDPAASATAAAAASHDKGPEAEEGVELQEGGDGPGAEEQTAVAITSVQQAAFGDHNIQYQFRTETNGGQTGTQRTIAPRTHPYSPKIDGTRTPRDERRRAQHNEVERRRRDKINNWIVQLSKIIPDCNADNSKTGASKGGILSKACDYIRELRQTNQRMQETFKEAERLQMDNELLRQQIEELKNENALLRAQLQQHNLEMVGEGTRQ

SEQ ID NO: 95873 - protein, 253 aa, Homo sapiens
  Payload ID: 19132
  Gene Name: upstream transcription factor 2, c-fos interacting
  ENSP ID: ENSP00000469364
VIQNPFSNGGSPAAEAVSGEARFAYFPASSVGDTTAVSVQTTDQSLQAGGQFYVMMTPQDVLQTGTQRTIAPRTHPYSPKIDGTRTPRDERRRAQHNEVERRRRDKINNWIVQLSKIIPDCNADNSKTGAVSTPDPQCLRWSRPPTLACRKSNSHGARESSLGWRPVGGACPKAPGPLAPQSKGGILSKACDYIRELRQTNQRMQETFKEAERLQMDNELLRQQIEELKNENALLRAQLQQHNLEMVGEGTRQ

SEQ ID NO: 95874 - protein, 170 aa, Homo sapiens
  Payload ID: 19132
  Gene Name: upstream transcription factor 2, c-fos interacting
  ENSP ID: ENSP00000469585
  MOD_RES (1)..(1): Any amino acid
XPGLDPAASATAAAAASHDKGPEAEEGVELQEGGDGPGAEEQTAVAITSVQQAAFGDHNIQYQFRTETNGGQVTYRVVQVTDGQLDGQGDTAGAVSVVSTAAFAGGQQAVTQVGVDGAAQRPGPAAASVPPGPAAPFPLVGALPPLGGGGREWRGDTGSALGEPRGWGRC

SEQ ID NO: 95875 - protein, 149 aa, Homo sapiens
  Payload ID: 19132
  Gene Name: upstream transcription factor 2, c-fos interacting
  ENSP ID: ENSP00000470081
  MOD_RES (1)..(1): Any amino acid
XSNLILSRCLGKQLCDNTCPLFFSSSCRKIDGTRTPRDERRRAQHNEVERRRRDKINNWIVQLSKIIPDCNADNSKTGASKGGILSKACDYIRELRQTNQRMQETFKEAERLQMDNELLRQQIEELKNENALLRAQLQQHNLEMVGEGT

SEQ ID NO: 95876 - protein, 86 aa, Homo sapiens
  Payload ID: 19132
  Gene Name: upstream transcription factor 2, c-fos interacting
  ENSP ID: ENSP00000470277
  MOD_RES (1)..(1): Any amino acid
XAVSGEARFAYFPASSVGDTTAVSVQTTDQSLQAGGQFYVMMTPQDVLQTGTQRTIAPRTHPYSPKIDGTRTPRDERRRAQHNEVP

SEQ ID NO: 95877 - protein, 338 aa, Homo sapiens
  Payload ID: 19132
  Gene Name: upstream transcription factor 2, c-fos interacting
  Uniprot ID: Q15853
  ENSP ID: ENSP00000471099
MDMLDPGLDPAASATAAAAASHDKGPEAEEGVELQEGGDGPGAEEQTAVAITSVQQAAFGDHNIQYQFRTETNGGQVTYRVVQVTDGQLDGQGDTAGAVSVVSTAAFAGGQQAVTQVGVDGAAQRPGPAAASVPPGPAAPFPLAVIQNPFSNGGSPAAEAVSGEARFAYFPASSVGDTTAVSVQTTDQSLQAGGQFYVMMTPQDVLQTGTQRTIAPRTHPYSPKIDGTRTPRDERRRAQHNEVERRRRDKINNWIVQLSKIIPDCNADNSKTGAACDYIRELRQTNQRMQETFKEAERLQMDNELLRQQIEELKNENALLRAQLQQHNLEMVGEGTRQ

SEQ ID NO: 95878 - protein, 349 aa, Homo sapiens
  Payload ID: 19132
  Gene Name: upstream transcription factor 2, c-fos interacting
  ENSP ID: ENSP00000471511
MLDPGLDPAASATAAAAASHDKGPEAEEGVELQEGGDGPGAEEQTAVAITSVQQAAFGDHNIQYQFRTETNGGQVTYRVVQVTDGQLDGQGDTAGAVSVVSTAAFAGGQQAVTQVGVDGAAQRPGPAAASVPPGPAAPFPLAVIQNPFSNGGSPAAEAVSGEARFAYFPASSVGDTTAVSVQTTDQSLQAGGQFYVMMTPQDVLQTGTQRTIAPRTHPYSPKIDGTRTPRDERRRAQHNEVERRRRDKINNWIVQLSKIIPDCNADNSKTGASKGGILSKACDYIRELRQTNQRMQETFKEAERLQMDNELLRQQVGAGPGAGQGPGAPDARRWPSAPLTSVVSARSRS

SEQ ID NO: 95879 - protein, 143 aa, Homo sapiens
  Payload ID: 19132
  Gene Name: upstream transcription factor 2, c-fos interacting
  ENSP ID: ENSP00000471775
MRGRDGGTEKAKGSLCPPTPQAVIQNPFSNGGSPAAEAVSGEARFAYFPASSVGDTTAVSVQTTDQSLQAGGQFYVMMTPQDVLQTGTQRTIAPRTHPYSPKIDGTRTPRDERRRAQHNEVERRRRDKINNWIVQLSKIIPDC

SEQ ID NO: 95880 - protein, 112 aa, Homo sapiens
  Payload ID: 19132
  Gene Name: upstream transcription factor 2, c-fos interacting
  ENSP ID: ENSP00000477020
MLDPGLDPAASATAAAAASHDKGPEAEEGVELQEGECLPGRPRPGRAGGARRGPDRAPTLLGPRRGRPRSGGADSGGHHQRPAGGVRRPQHPVPVPHRDKWRTGDIPRSPGD

SEQ ID NO: 95881 - protein, 2245 aa, Homo sapiens
  Payload ID: 19133
  Gene Name: upstream transcription factor family member 3
  Uniprot ID: Q68DE3
  ENSP ID: ENSP00000320794
MPEMTENETPTKKQHRKKNRETHNAVERHRKKKINAGINRIGELIPCSPALKQSKNMILDQAFKYITELKRQNDELLLNGGNNEQAEEIKKLRKQLEEIQKENGRYIELLKANDICLYDDPTIHWKGNLKNSKVSVVIPSDQVQKKIIVYSNGNQPGGNSQGTAVQGITFNVSHNLQKQTANVVPVQRTCNLVTPVSISGVYPSENKPWHQTTVPALATNQPVPLCLPAAISAQSILELPTSESESNVLGATSGSLIAVSIESEPHQHHSLHTCLNDQNSSENKNGQENPKVLKKMTPCVTNIPHSSSATATKVHHGNKSCLSIQDFRGDFQNTFVVSVTTTVCSQPPRTAGDSSPMSISKSADLTSTATVVASSAPGVGKATIPISTLSGNPLDNGWTLSCSLPSSSVSTSDLKNINSLTRISSAGNTQTTWTTLQLAGNTIQPLSQTPSSAVTPVLNESGTSPTTSNHSRYVATDINLNNSFPADGQPVEQVVVTLPSCPSLPMQPLIAQPQVKSQPPKNILPLNSAMQVIQMAQPVGSAVNSAPTNQNVIILQPPSTTPCPTVMRAEVSNQTVGQQIVIIQAANQNPLPLLPAPPPGSVRLPINGANTVIGSNNSVQNVPTPQTFGGKHLVHILPRPSSLSASNSTQTFSVTMSNQQPQTISLNGQLFALQPVMSSSGTTNQTPMQIIQPTTSEDPNTNVALNTFGALASLNQSISQMAGQSCVQLSISQPANSQTAANSQTTTANCVSLTTTAAPPVTTDSSATLASTYNLVSTSSMNTVACLPNMKSKRLNKKPGGRKHLAANKSACPLNSVRDVSKLDCPNTEGSAEPPCNDGLLESFPAVLPSVSVSQANSVSVSASHSLGVLSSESLIPESVSKSKSAEKSSPPSQESVTSEHFAMAAAKSKDSTPNLQQETSQDKPPSSLALSDAAKPCASANVLIPSPSDPHILVSQVPGLSSTTSTTSTDCVSEVEIIAEPCRVEQDSSDTMQTTGLLKGQGLTTLLSDLAKKKNPQKSSLSDQMDHPDFSSENPKIVDSSVNLHPKQELLLMNNDDRDPPQHHSCLPDQEVINGSLINGRQADSPMSTSSGSSRSFSVASMLPETTREDVTSNATTNTCDSCTFVEQTDIVALAARAIFDQENLEKGRVGLQADIREVASKPSEASLLEGDPPFKSQIPKESGTGQAEATPNEFNSQGSIEATMERPLEKPSCSLGIKTSNASLQDSTSQPPSITSLSVNNLIHQSSISHPLASCAGLSPTSEQTTVPATVNLTVSSSSYGSQPPGPSLMTEYSQEQLNTMTSTIPNSQIQEPLLKPSHESRKDSAKRAVQDDLLLSSAKRQKHCQPAPLRLESMSLMSRTPDTISDQTQMMVSQIPPNSSNSVVPVSNPAHGDGLTRLFPPSNNFVTPALRQTEVQCGSQPSVAEQQQTQASQHLQALQQHVPAQGVSHLHSNHLYIKQQQQQQQQQQQQQQQQQAGQLRERHHLYQMQHHVPHAESSVHSQPHNVHQQRTLQQEVQMQKKRNLVQGTQTSQLSLQPKHHGTDQSRSKTGQPHPHHQQMQQQMQQHFGSSQTEKSCENPSTSRNHHNHPQNHLNQDIMHQQQDVGSRQQGSGVSSEHVSGHNPMQRLLTSRGLEQQMVSQPSIVTRSSDMTCTPHRPERNRVSSYSAEALIGKTSSNSEQRMGISIQGSRVSDQLEMRSYLDVPRNKSLAIHNMQGRVDHTVASDIRLSDCQTFKPSGASQQPQSNFEVQSSRNNEIGNPVSSLRSMQSQAFRISQNTGPPPIDRQKRLSYPPVQSIPTGNGIPSRDSENTCHQSFMQSLLAPHLSDQVIGSQRSLSEHQRNTQCGPSSAIEYNCPPTHENVHIRRESESQNRESCDMSLGAINTRNSTLNIPFSSSSSSGDIQGRNTSPNVSVQKSNPMRITESHATKGHMNPPVTTNMHGVARPALPHPSVSHGNGDQGPAVRQANSSVPQRSRHPLQDSSGSKIRQPERNRSGNQRQSTVFDPSLPHLPLSTGGSMILGRQQPATEKRGSIVRFMPDSPQVPNDNSGPDQHTLSQNFGFSFIPEGGMNPPINANASFIPQVTQPSATRTPALIPVDPQNTLPSFYPPYSPAHPTLSNDISIPYFPNQMFSNPSTEKVNSGSLNNRFGSILSPPRPVGFAQPSFPLLPDMPPMHMTNSHLSNFNMTSLFPEIATALPDGSAMSPLLTIANSSASDSSKQSSNRPAHNISHILGHDCSSAV

SEQ ID NO: 95882 - protein, 2245 aa, Homo sapiens; identical to SEQ ID NO: 95881
  Payload ID: 19133
  Gene Name: upstream transcription factor family member 3
  Uniprot ID: Q68DE3
  ENSP ID: ENSP00000420721

SEQ ID NO: 95883 - protein, 88 aa, Homo sapiens
  Payload ID: 19133
  Gene Name: upstream transcription factor family member 3
  ENSP ID: ENSP00000420752
MPEMTENETPTKKQHRKKNRETHNAVERHRKKKINAGINRIGELIPCSPALKQSKNMILDQAFKYITELKRQNDELLLNGGNNEQGFY

SEQ ID NO: 95884 - protein, 313 aa, Homo sapiens
  Payload ID: 19134
  Gene Name: uracil DNA glycosylase
  Uniprot ID: P13051
  ENSP ID: ENSP00000242576
MIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 95885 - protein, 304 aa, Homo sapiens
  Payload ID: 19134
  Gene Name: uracil DNA glycosylase
  Uniprot ID: P13051
  ENSP ID: ENSP00000337398
MGVFCLGPWGLGRKLRTPGKGPLQLLSRLCGDHLQAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 95886 - protein, 141 aa, Homo sapiens
  Payload ID: 19134
  Gene Name: uracil DNA glycosylase
  ENSP ID: ENSP00000400287
MGVFCLGPWGLGRKLRTPGKGPLQLLSRLCGDHLQAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDFGEHL

SEQ ID NO: 95887 - protein, 258 aa, Homo sapiens
  Payload ID: 19134
  Gene Name: uracil DNA glycosylase
  ENSP ID: ENSP00000440784
MGVFCLGPWGLGRKLRTPGKGPLQLLSRLCGDHLQAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDR

SEQ ID NO: 95888 - protein, 142 aa, Homo sapiens
  Payload ID: 19135
  Gene Name: uracil phosphoribosyltransferase (FUR1) homolog (S. cerevisiae)
  ENSP ID: ENSP00000362471
MATELQCPDSMPCHNQQVNSASTPSPEQLRPGDLILDHAGGNRASRAKVILLTGYAHSSLPAELDSGACGGSSLNSEGNSGSGDSSSYDAPAGNSFLEDCELSRQIGAQLKLLPMNDQIRELQTIIRDNFFSSRRDYGYDLK

SEQ ID NO: 95889 - protein, 281 aa, Homo sapiens
  Payload ID: 19135
  Gene Name: uracil phosphoribosyltransferase (FUR1) homolog (S. cerevisiae)
  ENSP ID: ENSP00000362477
MATELQCPDSMPCHNQQVNSASTPSPEQLRPGDLILDHAGGNRASRAKVILLTGYAHSSLPAELDSGACGGSSLNSEGNSGSGDSSSYDAPAGNSFLEDCELSRQIGAQLKLLPMNDQIRELQTIIRDKTASRGDFMFSADRLIRLVVEEGLNQLPYKECMVTTPTGYKYEGVKFEKGNCGVSIMRSGEAMEQGLRDCCRSIRIGKILIQSDEETQRAKVYYAKFPPDIYRRKVLLMYPILSTGNTVIEAVKVLIEHGVQPSVIILLSLFSTPHGEFSMRQ

SEQ ID NO: 95890 - protein, 309 aa, Homo sapiens
  Payload ID: 19135
  Gene Name: uracil phosphoribosyltransferase (FUR1) homolog (S. cerevisiae)
  Uniprot ID: Q96BW1
  ENSP ID: ENSP00000362481
MATELQCPDSMPCHNQQVNSASTPSPEQLRPGDLILDHAGGNRASRAKVILLTGYAHSSLPAELDSGACGGSSLNSEGNSGSGDSSSYDAPAGNSFLEDCELSRQIGAQLKLLPMNDQIRELQTIIRDKTASRGDFMFSADRLIRLVVEEGLNQLPYKECMVTTPTGYKYEGVKFEKGNCGVSIMRSGEAMEQGLRDCCRSIRIGKILIQSDEETQRAKVYYAKFPPDIYRRKVLLMYPILSTGNTVIEAVKVLIEHGVQPSVIILLSLFSTPHGAKSIIQEFPEITILTTEVHPVAPTHFGQKYFGTD

SEQ ID NO: 95891 - protein, 176 aa, Homo sapiens
  Payload ID: 19135
  Gene Name: uracil phosphoribosyltransferase (FUR1) homolog (S. cerevisiae)
  Uniprot ID: Q96BW1
  ENSP ID: ENSP00000433987
MATELQCPDSMPCHNQQVNSASTPSPEQLRPGDLILDHAGGNRASRAKVILLTGYAHSSLPAELDSGACGGSSLNSEGNSGSGDSSSYDAPAGNSFLEDCELSRQIGAQLKLLPMNDQIRELQTIIRDKTASRGDFMFSADRLVLPEDLFQKSIDNSCSAFHHQTCCGRGIESAAI

SEQ ID NO: 95892 - protein, 173 aa, Homo sapiens
  Payload ID: 19135
  Gene Name: uracil phosphoribosyltransferase (FUR1) homolog (S. cerevisiae)
  ENSP ID: ENSP00000434037
MFSADRLIRLVVEEGLNQLPYKECMVTTPTGYKYEGVKFEKGNCGVSIMRSGEAMEQGLRDCCRSIRIGKILIQSDEETQRAKVYYAKFPPDIYRRKVLLMYPILSTGNTVIEAVKVLIEHGVQPSVIILLSLFSTPHGAKSIIQEFPEITILTTEVHPVAPTHFGQKYFGTD

SEQ ID NO: 95893 - protein, 2271 aa, Homo sapiens
  Payload ID: 19136
  Gene Name: URB1 ribosome biogenesis 1 homolog (S. cerevisiae)
  Uniprot ID: O60287
  ENSP ID: ENSP00000372199
MGVPKRKASGGQDGAASSAGAAKRARKEELTGVRFKAQLKDPQGPGPGLEAFVSAAKKLPREDVYDVVEGYIKISVECVEIFQLLSGEKRPESETMLIFQVFEAILLRTASDLSHFHVVGTNIVKKLMNNHMKLICESLYASGYRLARACLSLMTAMVTQGPEAARDVCSHFDLNKKTLYTLVTKRDSKGVYDVRQAYVQFALSFLIAGDDSTIVQVLEVKEFIPCIFSSGIKEDRISTINILLSTLKTKVVHNKNITKTQKVRFFTGQLLNHIASLYNWNGITDVNPENVKVSAEEAGKTMVRELVHNFLMDLCCSLKHGINFYDASLGTFGRGGNLTLLHFLLGLKTAADDDLVADLVVNILKVCPDLLNKYFKEVTFSFIPRAKSTWLNNIKLLNKIYEAQPEISRAFQTREFIPLPRLLAMVMVTTVPLVCNKSMFTQALNLDSTSVRHTALSLISVILKRALKTVDHCLNKEVWQESGVYTAVMMEEFVQLFREALSKILPDLNTVVWVWQSLKKQETKQDDKKGQKRSDGPPAACDAHQCDDAETILLKAVLLQVICLYQKVVPHVVMQYNFDFSKLLKGVISEQGLREEVPPILQHHMLKVALELPASKFLWLKAQEGPDAEIIGGERSVFYLLMKMFVTSSHLQLKSLTKLLIMKILRDTGVFEHTWKELELWLEHLENTMEEDKETVIQFLERILLTLVANPYSYTDKASDFVQEASMLQATMTKQEADDMSIPISHIDDVLDMVDVLVEGSEGLDEEIGFTLSEDMILLTFPFSAVVPAALEARNKLLLGTGNEAAENVVTYLTAVLTDLLHTQRDPLALCLLLQAYDKLEPPCLVPCCQQLSRFNRYYSLWIPEQAREAWLLQAQGSPSPPALPLASSFTALLQAAYESQALRDEHIQVQLQATMPHLSMQQVLLAAKQVLLYLRSTVENFGQLGRSVGPPLLQLFLDLLRRLVVHCEQLDAQNQQRCEAARAEADLFLDMESVASLELANDQTLEEVLVAILRHPTLEGWFLALEQQALPPHTLSPVLVKLLATHFSAGVLQLLAASAPILQNIGQLGLLARYSEAITQSVLKELQNRRAGPATSPPKTPPQLEALQELHPYMEGAQLREVTLALLSLPETHLVTQQPTKSPGKERHLNALGKTLVQLLTCSPQDQLQSGELLWSSEYVRGLGALLPTLAVDELDTVLLHTLQRDPVLAPAVGADLLDYCLARRTQAALSIAALLLQESCTHLLWFEQWCLQAGPGLGLQGDLDDFLPLIHVYLQCRTRSHFTRPAGVSSAVIPVLRKTLWRQLQSRLLSTDSPPASGLYQEILAQLVPFARAKDLSVLMDRLPSLLHTPSSHKRWIVADSISAALEGSAEELCAWRRTLLESCVKWLIVSFSGGQQDDDNTQNQEKEMLLRLNALLHALNEVDPGDWQKFVKKGLKFRYQDHTFLKMLLTAVQLLYSPESSVRTKLIQLPVVYVMLMQHSLFLPTLLTSDGEESPDSQVKEALVDLMLTVVEMCPSVCESSHFAVLLGAYGATLSVLDQKILLLLRAYEQNKLSLINFRVLLWGPAAVEHHKTCRSLGRSLWQQPSVGDILRLLDRDRMMQTILHFPQNRRLLPPEDTQELIFKDKSRVDLDGLYDPCFLLQLFSELTRPEFVVDCRKFLDSNALGLTVTALSSYDPQMRAIAYHVLAAYYSHLEGARFQEQSQLLYLLDVVRNGIRTQDMRLTFTLALFIAKAALQILKPEEHMYLKVSNFLLSHEYLNMDKVPGFYQFFYSSDFEQKTEQKWVFGVLRQGIRDKQCYELCARRGIFHIILSFFHSPLCDEAAQNWILEILQNAAQVARSAYEIIRDYSLLTWILHILESKFLETPLLSNVISLLHTLWVTNLGDKAVEWESQRLCQPSSQEPAKRLALHLVNEFLYVLIVLMKHLRPTLAPVQLTNFFGTLDSVLRYRATVIQAFRDMNRFTVNETVLSTKDVLVLLHKWSLIERDLKLQEDLRAAIEKAQARELMKMLKDKNKPVMPARAKGPRGRKRRPGEAEEMADPELMASTLETCKGLLRSILTYWRPVIPGPDPTQEPVDSASPESDAPGPVYAAASLAVSWVLRSVAEHPLSRAEAAGLIGWLKSHILPHPVVVADLLKDSAVRSSIFRLYSRLCGAEGLAGPVQEVACLFNTVMLQLVAAQGRAGSPFHPAMEALSLSSLSEKDEATQASAAFLVSLYIKDIWLGAQRPDTLLTHVRMVCEAADDAPSSEEEAIVVLCKDAASAASDA

SEQ ID NO: 95894 - protein, 1524 aa, Homo sapiens
  Payload ID: 19137
  Gene Name: URB2 ribosome biogenesis 2 homolog (S. cerevisiae)
  Uniprot ID: Q14146
  ENSP ID: ENSP00000258243
MAAVYSGISLKLKSKTTSWEDKLKLAHFAWISHQCFLPNKEQVLLDWARQSLVAFYKKKLELKEDIVERLWIYIDNILHSRKLQNLLKNGKTINLQISLVKIINERVAEFSLSGSQRNICAVLRCCQGILSTPALAVIYTAKQELMVALLSQLCWSACRQPEGAVVAQLFEVIHLALGHYLLILQQQVNPRRAFGDVTAHLLQPCLVLRHLLSGGTWTQAGQGQLRQVLSRDIRSQIEAMFRGGIFQPELLSSYKEGLLDQQQGDVKTGAMKNLLAPMDTVLNRLVDAGYCAASLHTSVVANSVALLYKLFLDSYFKEGNQLLCFQVLPRLFGCLKISHLQEEQSKALSTSDWTTELLVVEQLLNSVANNNIYNIAADRIRHEEAQFRFYRHVAELLINHAQAPIPAWFRCLKTLISLNHLILEPDLDDLLASAWIDAEVTEFRTKKAQEALIRTVFQTYAKLRQVPRLFEEVLGVICRPAAEALRQPVLASGPSTVLSACLLELPPSQILDTWSLVLEKFQSLVLPYLQSDADMALKSLSLSLLLHCIMFNMRSLDSSTPLPIVRRTQCMMERMMRELVQPLLALLPDTPGPEPELWLQKVSDSVLLLSYTWAQVDAMFSLNCSQYHSMSGPLIGVALEISNLPSLLPGVKTQHWKKIEKFTAQFSSLGTYCLEQLYLQKMKRTLMQTSFRSEGAIQSLRCDAAFIIGSGRKSLNQRTTASWDGQVGMVSGLTYPVAHWHLIVSNLTILISYLCPDDVGYLASVLLRTLPMGKAQEVSIDEEAYITLEKISKAFLHSPLFPEMQSLHSAFLTCVTTSCSSILCSGAQRDSGLVSQQLPWLFEKDHMVVGHWENRFAKAGPEGIEPRGEIAQNLLSLVKSDFPIQLEGEQLESILGLLEVISALQLDSLLPPYHVHYFLVLLSMAVTKLGCSCSSSLALKFLTTCYQLLGYLQKGKSARSVFKIMYGSDIFEVVLTSLFRASSRFLIEMDDPAWLEFLQVIGTFLEELMQMLIQMKLSLVLNFRKITAFLSSSKPYTEAASSKQLENQNPQGRQLLLVSLTRLCHVLGPFLKEQKLGQEAPAALSELLQQVVLQTGAVLQLCSVPGARGWRLPSVLISSVSTLLEADLGQHCRDGGADISQGSDRTLLSHVALYQGVYSQILLELPALAGHDQSFQAALQFLTLFFLAPELHPKKDSVFTSMFHSVRRVLADPEIPVQVTQDIEPHLGALFTQMLEVGTTEDLRLVMQCILQGLDVSNMWKADVQAVVSAVTLLRLLLNCPLSGEKASLLWRACPQIVTALTLLNREASQEQPVSLTVVGPVLDVLAALLRQGEEAIGNPHHVSLAFSILLTVPLDHLKPLEYGSVFPRLHNVLFSILQCHPKVMLKAIPSFLNSFNRLVFSVMREGRQKDKGSIDDLPTVLKCARLVERMYSHIAARAEEFAVFSPFMVAQYVLEVQKVTLYPAVKSLLQEGIYLILDLCIEPDVQFLRASLQPGMRDIFKELYNDYLKYHKAKHEGEKRYTA

SEQ ID NO: 95895 - protein, 84 aa, Homo sapiens
  Payload ID: 19137
  Gene Name: URB2 ribosome biogenesis 2 homolog (S. cerevisiae)
  ENSP ID: ENSP00000395107
MLKAIPSFLNSFNRLVFSVMREGRQKDKGSIDDLPTVLKCARLVERMYSHIAARAEEFAVFSPFMVAQYVLEVQKVTLYPAVKS

SEQ ID NO: 95896 - protein, 173 aa, Homo sapiens
  Payload ID: 19138
  Gene Name: ureidoimidazoline (2-oxo-4-hydroxy-4-carboxy-5-) decarboxylase
  Uniprot ID: A6NGE7
  ENSP ID: ENSP00000333490
MDIEKVNSMDLGEFVDVFGNATERCPLIAAAVWSQRPFSDLEDLEKHFFAFIDALAQSGQEGILRCHPDLAGSELQRGTLTAESQREQSGAGLRSLGADERLRLAELNAQYRARFGFPFVLAARFSDRTAVPRELARRLLCPSAQELRTALGEVKKIGSLRLADLLRADPAKL

SEQ ID NO: 95897 - protein, 384 aa, Homo sapiens
  Payload ID: 19139
  Gene Name: ureidopropionase, beta
  Uniprot ID: Q9UBR1
  ENSP ID: ENSP00000324343
MAGAEWKSLEECLEKHLPLPDLQEVKRVLYGKELRKLDLPREAFEAASREDFELQGYAFEAAEEQLRRPRIVHVGLVQNRIPLPANAPVAEQVSALHRRIKAIVEVAAMCGVNIICFQEAWTMPFAFCTREKLPWTEFAESAEDGPTTRFCQKLAKNHDMVVVSPILERDSEHGDVLWNTAVVISNSGAVLGKTRKNHIPRVGDFNESTYYMEGNLGHPVFQTQFGRIAVNICYGRHHPLNWLMYSINGAEIIFNPSATIGALSESLWPIEARNAAIANHCFTCAINRVGTEHFPNEFTSGDGKKAHQDFGYFYGSSYVAAPDSSRTPGLSRSRDGLLVAKLDLNLCQQVNDVWNFKMTGRYEMYARELAEAVKSNYSPTIVKE

SEQ ID NO: 95898 - protein, 186 aa, Homo sapiens
  Payload ID: 19139
  Gene Name: ureidopropionase, beta
  ENSP ID: ENSP00000372208
MAGAEWKSLEECLEKHLPLPDLQEVKRVLYGKELRKLDLPREAFEAASREDFELQGYAFEAAEEQLRRPRIVHVGLVQNRIPLPANAPVAEQVSALHRRIKAIVEVAAMCGVNIICFQEAWILRPHHQEPRPPCCYAPSCCLIPSVFPHRSESIRSSPSLYHHLVQAPGSSPLAFVIPSSWSPVPS

SEQ ID NO: 95899 - protein, 42 aa, Homo sapiens
  Payload ID: 19139
  Gene Name: ureidopropionase, beta
  ENSP ID: ENSP00000400684
MAGAEWKSLEECLEKHLPLPDLQEVKRVLYGKELRSLPFIDA

SEQ ID NO: 95900 - protein, 110 aa, Homo sapiens
  Payload ID: 19140
  Gene Name: URGCP-MRPS24 readthrough
  ENSP ID: ENSP00000473871
MASPGHSDLGEVAPEIKASERRTAVAIADLEWREMEGDDCEFRYGDGTNEAQDNDFPTGAVLEPRAALRLARPAHLPGLRQEPGGPSTRKQGGQAGDLRGGTRAALHRPP

SEQ ID NO: 95901 - protein, 475 aa, Homo sapiens
  Payload ID: 19141
  Gene Name: URI1, prefoldin-like chaperone
  Uniprot ID: O94763
  ENSP ID: ENSP00000353817
MTTWSSLQGSHVSKRALAYALVVTNCQERIQHWKKVDNDYNALRERLSTLPDKLSYNIMVPFGPFAFMPGKLVHTNEVTVLLGDNWFAKCSAKQAVGLVEHRKEHVRKTIDDLKKVMKNFESRVEFTEDLQKMSDAAGDIVDIREEIKCDFEFKAKHRIAHKPHSKPKTSDIFEADIANDVKSKDLLADKELWARLEELERQEELLGELDSKPDTVIANGEDTTSSEEEKEDRNTNVNAMHQVTDSHTPCHKDVASSEPFSGQVNSQLNCSVNGSSSYHSDDDDDDDDDDDDDNIDDDDGDNDHEALGVGDNSIPTIYFSHTVEPKRVRINTGKNTTLKFSEKKEEAKRKRKNSTGSGHSAQELPTIRTPADIYRAFVDVVNGEYVPRKSILKSRSRENSVCSDTSESSAAEFDDRRGVLRSISCEEATCSDTSESILEEEPQENQKKLLPLSVTPEVLRLVGYSRNLAPLNVIL

SEQ ID NO: 95902 - protein, 535 aa, Homo sapiens
  Payload ID: 19141
  Gene Name: URI1, prefoldin-like chaperone
  Uniprot ID: O94763
  ENSP ID: ENSP00000376097
MEAPTVETPPDPSPPSAPAPALVPLRAPDVARLREEQEKVVTNCQERIQHWKKVDNDYNALRERLSTLPDKLSYNIMVPFGPFAFMPGKLVHTNEVTVLLGDNWFAKCSAKQAVGLVEHRKEHVRKTIDDLKKVMKNFESRVEFTEDLQKMSDAAGDIVDIREEIKCDFEFKAKHRIAHKPHSKPKTSDIFEADIANDVKSKDLLADKELWARLEELERQEELLGELDSKPDTVIANGEDTTSSEEEKEDRNTNVNAMHQVTDSHTPCHKDVASSEPFSGQVNSQLNCSVNGSSSYHSDDDDDDDDDDDDDNIDDDDGDNDHEALGVGDNSIPTIYFSHTVEPKRVRINTGKNTTLKFSEKKEEAKRKRKNSTGSGHSAQELPTIRTPADIYRAFVDVVNGEYVPRKSILKSRSRENSVCSDTSESSAAEFDDRRGVLRSISCEEATCSDTSESILEEEPQENQKKLLPLSVTPEAFSGTVIEKEFVSPSLTPPPAIAHPALPTIPERKEVLLEASEETGKRVSKFKAARLQQKD

SEQ ID NO: 95903 - protein, 40 aa, Homo sapiens
  Payload ID: 19141
  Gene Name: URI1, prefoldin-like chaperone
  ENSP ID: ENSP00000458161
  MOD_RES (1)..(1): Any amino acid
XSISCEEATCSDTSESILEEEPQENQKKLLPLSVTPELNI

SEQ ID NO: 95904 - protein, 71 aa, Homo sapiens
  Payload ID: 19141
  Gene Name: URI1, prefoldin-like chaperone
  ENSP ID: ENSP00000458480
MVPFGPFAFMPGKLVHTNEVTVLLGDNWFAKCSAKQAVGLVEHRKEHVRKTIDDLKKVMKNFESRVEFTED

SEQ ID NO: 95905 - protein, 50 aa, Homo sapiens
  Payload ID: 19141
  Gene Name: URI1, prefoldin-like chaperone
  ENSP ID: ENSP00000458533
MEAPTVETPPDPSPPSAPAPALVPLRAPDVARLREEQEKVVTNCQERIQH

SEQ ID NO: 95906 - protein, 228 aa, Homo sapiens
  Payload ID: 19141
  Gene Name: URI1, prefoldin-like chaperone
  ENSP ID: ENSP00000459450
  MOD_RES (1)..(1): Any amino acid
XVNAMHQVTDSHTPCHKDVASSEPFSGQVNSQLNCSVNGSSSYHSDDDDDDDDDDDDDNIDDDDGDNDHEALGVGDNSIPTIYFSHTVEPKRVRINTGKNTTLKFSEKKEEAKRKRKNSTGSGHSAQELPTIRTPADIYRAFVDVVNGEYVPRKSILKSRSRENSVCSDTSESSAAEFDDRRGVLRSISCEEATCSDTSESILEEEPQENQKKLLPLSVTPEVCVCIF

SEQ ID NO: 95907 - protein, 33 aa, Homo sapiens
  Payload ID: 19141
  Gene Name: URI1, prefoldin-like chaperone
  ENSP ID: ENSP00000459966
MVPFGPFAFMPGKLVHTNEVTVLLGDNWFAKCS

SEQ ID NO: 95908 - protein, 43 aa, Homo sapiens
  Payload ID: 19141
  Gene Name: URI1, prefoldin-like chaperone
  ENSP ID: ENSP00000461003
MEAPTVETPPDPSPPSAPAPALVPLRAPDVARLREEQEKEEGR

SEQ ID NO: 95909 - protein, 122 aa, Homo sapiens
  Payload ID: 19141
  Gene Name: URI1, prefoldin-like chaperone
  ENSP ID: ENSP00000461895
MVPFGPFAFMPGKLVHTNEVTVLLGDNWFAKCSAKQAVGLVEHRKEHVRKTIDDLKKVMKNFESRVEFTEDLQKMSDAAGDIVDIREEIKCDFEFKAKHRIAHKPHSKPKTSDIFEADIAND

SEQ ID NO: 95910 - protein, 17 aa, Homo sapiens
  Payload ID: 19141
  Gene Name: URI1, prefoldin-like chaperone
  ENSP ID: ENSP00000468048
RALAYALGLCEVLMNEG

SEQ ID NO: 95911 - protein, 480 aa, Homo sapiens
  Payload ID: 19142
  Gene Name: uridine monophosphate synthetase
  Uniprot ID: P11172
  ENSP ID: ENSP00000232607
MAVARAALGPLVTGLYDVQAFKFGDFVLKSGLSSPIYIDLRGIVSRPRLLSQVADILFQTAQNAGISFDTVCGVPYTALPLATVICSTNQIPMLIRRKETKDYGTKRLVEGTINPGETCLIIEDVVTSGSSVLETVEVLQKEGLKVTDAIVLLDREQGGKDKLQAHGIRLHSVCTLSKMLEILEQQKKVDAETVGRVKRFIQENVFVAANHNGSPLSIKEAPKELSFGARAELPRIHPVASKLLRLMQKKETNLCLSADVSLARELLQLADALGPSICMLKTHVDILNDFTLDVMKELITLAKCHEFLIFEDRKFADIGNTVKKQYEGGIFKIASWADLVNAHVVPGSGVVKGLQEVGLPLHRGCLLIAEMSSTGSLATGDYTRAAVRMAEEHSEFVVGFISGSRVSMKPEFLHLTPGVQLEAGGDNLGQQYNSPQEVIGKRGSDIIIVGRGIISAADRLEAAEMYRKAAWEAYLSRLGV

SEQ ID NO: 95912 - protein, 57 aa, Homo sapiens
  Payload ID: 19142
  Gene Name: uridine monophosphate synthetase
  ENSP ID: ENSP00000417893
MAVARAALGPLVTGLYDVQAFKFGDFVLKSGLSSPIYIDLRGIVSRPRLLSQELSVL

SEQ ID NO: 95913 - protein, 57 aa, Homo sapiens; identical to SEQ ID NO: 95912
  Payload ID: 19142
  Gene Name: uridine monophosphate synthetase
  ENSP ID: ENSP00000419121

SEQ ID NO: 95914 - protein, 66 aa, Homo sapiens
  Payload ID: 19142
  Gene Name: uridine monophosphate synthetase
  ENSP ID: ENSP00000419618
MAVARAALGPLVTGLYDVQAFKFGDFVLKSGLSSPIYIDLRGIVSRPRLLSQMGSLLRHPGWSAAL

SEQ ID NO: 95915 - protein, 142 aa, Homo sapiens
  Payload ID: 19142
  Gene Name: uridine monophosphate synthetase
  ENSP ID: ENSP00000420348
MAVARAALGPLVTGLYDVQAFKFGDFVLKSGLSSPIYIDLRGIVSRPRLLSQVADILFQTAQNAGISFDTVCGVPYTALPLATVICSTNQIPMLIRRKETKDYGSTQRTQLRCTCRAAQDPPSCIEASQAYAKEGDQSVSIC

SEQ ID NO: 95916 - protein, 66 aa, Homo sapiens; identical to SEQ ID NO: 95914
  Payload ID: 19142
  Gene Name: uridine monophosphate synthetase
  ENSP ID: ENSP00000420409

SEQ ID NO: 95917 - protein, 342 aa, Homo sapiens
  Payload ID: 19142
  Gene Name: uridine monophosphate synthetase
  ENSP ID: ENSP00000420754
MAVARAALGPLVTGLYDVQAFKFGDFVLKSGLSSPIYIDLRGIVSRPRLLSQVADILFQTAQNAGISFDTVCGVPYTALPLATVICSTNQIPMLIRRKETKDYGTKRLVEGTINPGETCLIIEDVVTSGSSVLETVEVLQKEGLKVTDAIVLLDREQGGKDKLQAHGIRLHSVCTLSKMLEILEQQKKVDAETVGRVKRFIQENVFVAANHNGSPLSIKEAPKELSFGARAELPRIHPVASKLLRLMQKKETNLCLSADVSLARELLQLADALGPSICMLKTHVDILNDFTLDVMKELITLAKCHEFLIFEDRKFADIGNTVKKQYEGKCIIQESARIRNPA

SEQ ID NO: 95918 - protein, 66 aa, Homo sapiens; identical to SEQ ID NO: 95914
  Payload ID: 19142
  Gene Name: uridine monophosphate synthetase
  ENSP ID: ENSP00000486143

SEQ ID NO: 95919 - protein, 310 aa, Homo sapiens
  Payload ID: 19143
  Gene Name: uridine phosphorylase 1
  Uniprot ID: Q16831
  ENSP ID: ENSP00000330032
MAATGANAEKAESHNDCPVRLLNPNIAKMKEDILYHFNLTTSRHNFPALFGDVKFVCVGGSPSRMKAFIRCVGAELGLDCPGRDYPNICAGTDRYAMYKVGPVLSVSHGMGIPSISIMLHELIKLLYYARCSNVTIIRIGTSGGIGLEPGTVVITEQAVDTCFKAEFEQIVLGKRVIRKTDLNKKLVQELLLCSAELSEFTTVVGNTMCTLDFYEGQGRLDGALCSYTEKDKQAYLEAAYAAGVRNIEMESSVFAAMCSACGLQAAVVCVTLLNRLEGDQISSPRNVLSEYQQRPQRLVSYFIKKKLSKA

SEQ ID NO: 95920 - protein, 36 aa, Homo sapiens
  Payload ID: 19143
  Gene Name: uridine phosphorylase 1
  Uniprot ID: Q16831
  ENSP ID: ENSP00000378927
MAATGANAEKAESHKSGARHCGHNRAGSGYLLQGRV

SEQ ID NO: 95921 - protein, 310 aa, Homo sapiens; identical to SEQ ID NO: 95919
  Payload ID: 19143
  Gene Name: uridine phosphorylase 1
  Uniprot ID: Q16831
  ENSP ID: ENSP00000378931

SEQ ID NO: 95922 - protein, 29 aa, Homo sapiens
  Payload ID: 19143
  Gene Name: uridine phosphorylase 1
  ENSP ID: ENSP00000387607
MAATGANAEKAESHNDCPVRLLNPNIAKM

SEQ ID NO: 95923 - protein, 146 aa, Homo sapiens
  Payload ID: 19143
  Gene Name: uridine phosphorylase 1
  ENSP ID: ENSP00000390118
MAATGANAEKAESHNDCPVRLLNPNIAKMKEDILYHFNLTTSRHNFPALFGDVKFVCVGGSPSRMKAFIRCVGAELGLDCPGRDYPNICAGTDRYAMYKVGPVLSVSHGMGIPSISIMLHELIKLLYYARCSNVTIIRIGTSGGIG

SEQ ID NO: 95924 - protein, 85 aa, Homo sapiens
  Payload ID: 19143
  Gene Name: uridine phosphorylase 1
  ENSP ID: ENSP00000396820
MAATGANAEKAESHNDCPVRLLNPNIAKMKEDILYHFNLTTSRHNFPALFGDVKFVCVGGSPSRMKAFISMVWAFLLSQSCCMSS

SEQ ID NO: 95925 - protein, 144 aa, Homo sapiens
  Payload ID: 19143
  Gene Name: uridine phosphorylase 1
  ENSP ID: ENSP00000405209
MAATGANAEKAESHNDCPVRLLNPNIAKMKEDILYHFNLTTSRHNFPALFGDVKFVCVGGSPSRMKAFIRCVGAELGLDCPGRDYPNICAGTDRYAMYKVGPVLSVSHGMGIPSISIMLHELIKLLYYARCSNVTIIRIGTSGG

SEQ ID NO: 95926 - protein, 36 aa, Homo sapiens; identical to SEQ ID NO: 95920
  Payload ID: 19143
  Gene Name: uridine phosphorylase 1
  Uniprot ID: Q16831
  ENSP ID: ENSP00000408899

SEQ ID NO: 95927 - protein, 36 aa, Homo sapiens; identical to SEQ ID NO: 95920
  Payload ID: 19143
  Gene Name: uridine phosphorylase 1
  Uniprot ID: Q16831
  ENSP ID: ENSP00000413611

SEQ ID NO: 95928 - protein, 171 aa, Homo sapiens
  Payload ID: 19143
  Gene Name: uridine phosphorylase 1
  ENSP ID: ENSP00000414963
MAATGANAEKAESHNDCPVRLLNPNIAKMKEDILYHFNLTTSRHNFPALFGDVKFVCVGGSPSRMKAFIRCVGAELGLDCPGRDYPNICAGTDRYAMYKVGPVLSVSHGMGIPSISIMLHELIKLLYYARCSNVTIIRIGTSGGIGILKHLRRKDTGKSKGGRERRSTKLR

SEQ ID NO: 95929 - protein, 317 aa, Homo sapiens
  Payload ID: 19144
  Gene Name: uridine phosphorylase 2
  Uniprot ID: O95045
  ENSP ID: ENSP00000005756
MASVIPASNRSMRSDRNTYVGKRFVHVKNPYLDLMDEDILYHLDLGTKTHNLPAMFGDVKFVCVGGSPNRMKAFALFMHKELGFEEAEEDIKDICAGTDRYCMYKTGPVLAISHGMGIPSISIMLHELIKLLHHARCCDVTIIRIGTSGGIGIAPGTVVITDIAVDSFFKPRFEQVILDNIVTRSTELDKELSEELFNCSKEIPNFPTLVGHTMCTYDFYEGQGRLDGALCSFSREKKLDYLKRAFKAGVRNIEMESTVFAAMCGLCGLKAAVVCVTLLDRLDCDQINLPHDVLVEYQQRPQLLISNFIRRRLGLCD

SEQ ID NO: 95930 - protein, 374 aa, Homo sapiens
  Payload ID: 19144
  Gene Name: uridine phosphorylase 2
  Uniprot ID: O95045
  ENSP ID: ENSP00000474090
MLAPGCELDPDQEVVRTRPEDVPASPSTSTMIVSVLRPPSHASCTACGTVTFHIVERMASVIPASNRSMRSDRNTYVGKRFVHVKNPYLDLMDEDILYHLDLGTKTHNLPAMFGDVKFVCVGGSPNRMKAFALFMHKELGFEEAEEDIKDICAGTDRYCMYKTGPVLAISHGMGIPSISIMLHELIKLLHHARCCDVTIIRIGTSGGIGIAPGTVVITDIAVDSFFKPRFEQVILDNIVTRSTELDKELSEELFNCSKEIPNFPTLVGHTMCTYDFYEGQGRLDGALCSFSREKKLDYLKRAFKAGVRNIEMESTVFAAMCGLCGLKAAVVCVTLLDRLDCDQINLPHDVLVEYQQRPQLLISNFIRRRLGLCD

SEQ ID NO: 95931 - protein, 201 aa, Homo sapiens
  Payload ID: 19145
  Gene Name: uridine-cytidine kinase 1
  Uniprot ID: Q9HA47
  ENSP ID: ENSP00000361282
MASAGGEDCESPAPEADRPHQRPFLIGVSGGTASGKSTVCEKIMELLGQNEVEQRQRKVVILSQDRFYKVLTAEQKAKALKGQYNFDHPDAFDNDLMHRTLKNIVEGKTVEVPTYDFVTHSRLPETTVVYPADVVLFEGILVFYSQEIRDMFHLRLFVDTDSDVRLSRRDKEVCRCDHPARSGQYGCHQPDRAAHPGHSEW

SEQ ID NO: 95932 - protein, 268 aa, Homo sapiens
  Payload ID: 19145
  Gene Name: uridine-cytidine kinase 1
  Uniprot ID: Q9HA47
  ENSP ID: ENSP00000361284
MASAGGEDCESPAPEADRPHQRPFLIGSTVCEKIMELLGQNEVEQRQRKVVILSQDRFYKVLTAEQKAKALKGQYNFDHPDAFDNDLMHRTLKNIVEGKTVEVPTYDFVTHSRLPETTVVYPADVVLFEGILVFYSQEIRDMFHLRLFVDTDSDVRLSRRVLRDVRRGRDLEQILTQYTTFVKPAFEEFCLPTKKYADVIIPRGVDNMVAINLIVQHIQDILNGDICKWHRGGSNGRSYKRTFSEPGDHPGMLTSGKRSHLESSSRPH

SEQ ID NO: 95933 - protein, 282 aa, Homo sapiens
  Payload ID: 19145
  Gene Name: uridine-cytidine kinase 1
  Uniprot ID: Q9HA47
  ENSP ID: ENSP00000361285
MASAGGEDCESPAPEADRPHQRPFLIGDERFQAGIPLLCLQSTVCEKIMELLGQNEVEQRQRKVVILSQDRFYKVLTAEQKAKALKGQYNFDHPDAFDNDLMHRTLKNIVEGKTVEVPTYDFVTHSRLPETTVVYPADVVLFEGILVFYSQEIRDMFHLRLFVDTDSDVRLSRRVLRDVRRGRDLEQILTQYTTFVKPAFEEFCLPTKKYADVIIPRGVDNMVAINLIVQHIQDILNGDICKWHRGGSNGRSYKRTFSEPGDHPGMLTSGKRSHLESSSRPH

SEQ ID NO: 95934 - protein, 277 aa, Homo sapiens
  Payload ID: 19145
  Gene Name: uridine-cytidine kinase 1
  Uniprot ID: Q9HA47
  ENSP ID: ENSP00000361289
MASAGGEDCESPAPEADRPHQRPFLIGVSGGTASGKSTVCEKIMELLGQNEVEQRQRKVVILSQDRFYKVLTAEQKAKALKGQYNFDHPDAFDNDLMHRTLKNIVEGKTVEVPTYDFVTHSRLPETTVVYPADVVLFEGILVFYSQEIRDMFHLRLFVDTDSDVRLSRRVLRDVRRGRDLEQILTQYTTFVKPAFEEFCLPTKKYADVIIPRGVDNMVAINLIVQHIQDILNGDICKWHRGGSNGRSYKRTFSEPGDHPGMLTSGKRSHLESSSRPH

SEQ ID NO: 95935 - protein, 218 aa, Homo sapiens
  Payload ID: 19145
  Gene Name: uridine-cytidine kinase 1
  ENSP ID: ENSP00000432363
MASAGGEDCESPAPEADRPHQRPFLIGVSGGTASGKDERFQAGIPLLCLQSTVCEKIMELLGQNEVEQRQRKVVILSQDRFYKVLTAEQKAKALKGQYNFDHPDAFDNDLMHRTLKNIVEGKTVEVPTYDFVTHSRLPETTVVYPADVVLFEGILVFYSQEIRDMFHLRLFVDTDSDVRLSRRVLRDVRRGRDLEQILTQYTTFVKPAFEEFCLPQSI

SEQ ID NO: 95936 - protein, 548 aa, Homo sapiens
  Payload ID: 19146
  Gene Name: uridine-cytidine kinase 1-like 1
  Uniprot ID: Q9NWZ5
  ENSP ID: ENSP00000346155
MAAPPARADADPSPTSPPTARDTPGRQAEKSETACEDRSNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEERELSVRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPELHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDEEEVAYTG

SEQ ID NO: 95937 - protein, 419 aa, Homo sapiens
  Payload ID: 19146
  Gene Name: uridine-cytidine kinase 1-like 1
  Uniprot ID: Q9NWZ5
  ENSP ID: ENSP00000351546
MAAPPARADADPSPTSPPTARDTPGRQAEKSETACEDRSNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEEGCAGLGTPVPPAAPDAERPEEHAAGTGHAHHHQVRAHLGTGRPRARAPAQLLAPQGQGDQSRRVHLLLQETDAAAHRARALLPALSGLRRTDPAGAGLCGQVLCGEADHRCVHSARR

SEQ ID NO: 95938 - protein, 533 aa, Homo sapiens
  Payload ID: 19146
  Gene Name: uridine-cytidine kinase 1-like 1
  Uniprot ID: Q9NWZ5
  ENSP ID: ENSP00000358924
MSSPPAYPGIRISGCRALGAEGSSNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEERELSVRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPELHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDEEEVAYTG

SEQ ID NO: 95939 - protein, 135 aa, Homo sapiens
  Payload ID: 19146
  Gene Name: uridine-cytidine kinase 1-like 1
  ENSP ID: ENSP00000402994
MHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPELHYLRLPKDISDDHVILMDCTVSTGAAAMMAVRVLL

SEQ ID NO: 95940 - protein, 261 aa, Homo sapiens
  Payload ID: 19147
  Gene Name: uridine-cytidine kinase 2
  Uniprot ID: Q9BZX2
  ENSP ID: ENSP00000356853
MAGDSEQTLQNHQQPNGGEPFLIGVSGGTASGKSSVCAKIVQLLGQNEVDYRQKQVVILSQDSFYRVLTSEQKAKALKGQFNFDHPDAFDNELILKTLKEITEGKTVQIPVYDFVSHSRKEETVTVYPADVVLFEGILAFYSQEVRDLFQMKLFVDTDADTRLSRRVLRDISERGRDLEQILSQYITFVKPAFEEFCLPTKKYADVIIPRGADNLVAINLIVQHIQDILNGGPSKRQTNGCLNGYTPSRKRQASESSSRPH

SEQ ID NO: 95941 - protein, 111 aa, Homo sapiens
  Payload ID: 19147
  Gene Name: uridine-cytidine kinase 2
  Uniprot ID: Q9BZX2
  ENSP ID: ENSP00000476327
MKLFVDTDADTRLSRRVLRDISERGRDLEQILSQYITFVKPAFEEFCLPTKKYADVIIPRGADNLVAINLIVQHIQDILNGGPSKRQTNGCLNGYTPSRKRQASESSSRPH

SEQ ID NO: 95942 - protein, 111 aa, Homo sapiens; identical to SEQ ID NO: 95941
  Payload ID: 19147
  Gene Name: uridine-cytidine kinase 2
  Uniprot ID: Q9BZX2
  ENSP ID: ENSP00000476692

SEQ ID NO: 95943 - protein, 676 aa, Homo sapiens
  Payload ID: 19148
  Gene Name: urocanate hydratase 1
  Uniprot ID: Q96N76
  ENSP ID: ENSP00000290868
MSSLQALCSGLPLRPLPENRGRQAGVPHAPVRTPSLSPVEKQLALRNALRYFPPDVQELLAPEFAQELQLYGHIYMYRFCPDIEMRAYPIEQYPCQTKVAAAIMHMIMNNLDPAVAQFPQELVTYGGNGQVFSNWAQFWLTMFYLSKMTEEQTLVMYSGHPLGLFPSSRSAPRLVITNGMVIPNYSSRTEYEKLFALGVTMYGQMTAGSYCYIGPQGIVHGTVLTVLNAARRYLGIEDLAGKVFVTSGLGGMSGAQAKAAVIVGCIGVIAEVDKAALEKRHRQGWLMEVTDSLDRCIQRLREARKKKEVLSLGYHGNVVALWERLVHELDTTGECLVDLGSDQTSCHNPFNGGYYPVQLSFTEAQSLMASNPAVFKDLVQESLRRQVSAINRLAEEKFFFWDYGNAFLLEAQRAGADVEKKGAGRTEFRYPSYVQHIMGDIFSQGFGPFRWVCTSGDPQDLAVTDELATSVLEEAIADGVKVSVKLQYMDNIRWIREAARHRLVVGSQARILYSDQKGRVAIAVAINQAIACRRIKAPVVLSRDHHDVSGTDSPFRETSNIYDGSAFCADMAVQNFVGDACRGATWVALHNGGGVGWGEVINGGFGLVLDGTPEAEGRARLMLSWDVSNGVARRCWSGNQKAYEIICQTMQENSTLVVTLPHKVEDERVLQQALQL

SEQ ID NO: 95944 - protein, 736 aa, Homo sapiens
  Payload ID: 19148
  Gene Name: urocanate hydratase 1
  Uniprot ID: Q96N76
  ENSP ID: ENSP00000373073
MSSLQALCSGLPLRPLPENRGRQAGVPHAPVRTPSLSPVEKQLALRNALRYFPPDVQELLAPEFAQELQLYGHIYMYRFCPDIEMRAYPIEQYPCQTKVAAAIMHMIMNNLDPAVAQFPQELVTYGGNGQVFSNWAQFWLTMFYLSKMTEEQTLVMYSGHPLGLFPSSRSAPRLVITNGMVIPNYSSRTEYEKLFALGVTMYGQMTAGSYCYIGPQGIVHGTVLTVLNAARRYLGIEDLAGKVFVTSGLGGMSGAQAKAAVIVGCIGVIAEVDKAALEKRHRQGWLMEVTDSLDRCIQRLRVLQLGLQQALGWAGLPAALGLCVLSCFVNLAPLGEGRCLAPSGFSRPLLGAPVLLLCPSREARKKKEVLSLGYHGNVVALWERLVHELDTTGECLVDLGSDQTSCHNPFNGGYYPVQLSFTEAQSLMASNPAVFKDLVQESLRRQVSAINRLAEEKFFFWDYGNAFLLEAQRAGADVEKKGAGRTEFRYPSYVQHIMGDIFSQGFGPFRWVCTSGDPQDLAVTDELATSVLEEAIADGVKVSVKLQYMDNIRWIREAARHRLVVGSQARILYSDQKGRVAIAVAINQAIACRRIKAPVVLSRDHHDVSGTDSPFRETSNIYDGSAFCADMAVQNFVGDACRGATWVALHNGGGVGWGEVINGGFGLVLDGTPEAEGRARLMLSWDVSNGVARRCWSGNQKAYEIICQTMQENSTLVVTLPHKVEDERVLQQALQL

SEQ ID NO: 95945 - protein, 124 aa, Homo sapiens
  Payload ID: 19149
  Gene Name: urocortin
  Uniprot ID: P55089
  ENSP ID: ENSP00000296099
MRQAGRAALLAALLLLVQLCPGSSQRSPEAAGVQDPSLRWSPGARNQGGGARALLLLLAERFPRRAGPGRLGLGTAGERPRRDNPSLSIDLTFHLLRTLLELARTQSQRERAEQNRIIFDSVGK

SEQ ID NO: 95946 - protein, 112 aa, Homo sapiens
  Payload ID: 19150
  Gene Name: urocortin 2
  Uniprot ID: Q96RP3
  ENSP ID: ENSP00000273610
MTRCALLLLMVLMLGRVLVVPVTPIPTFQLRPQNSPQTTPRPAASESPSAAPTWPWAAQSHCSPTRHPGSRIVLSLDVPIGLLQILLEQARARAAREQATTNARILARVGHC

SEQ ID NO: 95947 - protein, 161 aa, Homo sapiens
  Payload ID: 19151
  Gene Name: urocortin 3
  Uniprot ID: Q969E3
  ENSP ID: ENSP00000369798
MLMPVHFLLLLLLLLGGPRTGLPHKFYKAKPIFSCLNTALSEAEKGQWEDASLLSKRSFHYLRSRDASSGEEEEGKEKKTFPISGARGGARGTRYRYVSQAQPRGKPRQDTAKSPHRTKFTLSLDVPTNIMNLLFNIAKAKNLRAQAAANAHLMAQIGRKK

SEQ ID NO: 95948 - protein, 640 aa, Homo sapiens
  Payload ID: 19152
  Gene Name: uromodulin
  Uniprot ID: P07911
  ENSP ID: ENSP00000306279
MGQPSLTWMLMVVVASWFITTAATDTSEARWCSECHSNATCTEDEAVTTCTCQEGFTGDGLTCVDLDECAIPGAHNCSANSSCVNTPGSFSCVCPEGFRLSPGLGCTDVDECAEPGLSHCHALATCVNVVGSYLCVCPAGYRGDGWHCECSPGSCGPGLDCVPEGDALVCADPCQAHRTLDEYWRSTEYGEGYACDTDLRGWYRFVGQGGARMAETCVPVLRCNTAAPMWLNGTHPSSDEGIVSRKACAHWSGHCCLWDASVQVKACAGGYYVYNLTAPPECHLAYCTDPSSVEGTCEECSIDEDCKSNNGRWHCQCKQDFNITDISLLEHRLECGANDMKVSLGKCQLKSLGFDKVFMYLSDSRCSGFNDRDNRDWVSVVTPARDGPCGTVLTRNETHATYSNTLYLADEIIIRDLNIKINFACSYPLDMKVSLKTALQPMVSALNIRVGGTGMFTVRMALFQTPSYTQPYQGSSVTLSTEAFLYVGTMLDGGDLSRFALLMTNCYATPSSNATDPLKYFIIQDRCPHTRDSTIQVVENGESSQGRFSVQMFRFAGNYDLVYLHCEVYLCDTMNEKCKPTCSGTRFRSGSVIDQSRVLNLGPITRKGVQATVSRAFSSLGLLKVWLPLLLSATLTLTFQ

SEQ ID NO: 95949 - protein, 673 aa, Homo sapiens
  Payload ID: 19152
  Gene Name: uromodulin
  Uniprot ID: P07911
  ENSP ID: ENSP00000379438
MGQPSLTWMLMVVVASWFITTAATDTSEARTKYNCPARWSWRTPQRGGDTEQGPDEDFTSQGRWCSECHSNATCTEDEAVTTCTCQEGFTGDGLTCVDLDECAIPGAHNCSANSSCVNTPGSFSCVCPEGFRLSPGLGCTDVDECAEPGLSHCHALATCVNVVGSYLCVCPAGYRGDGWHCECSPGSCGPGLDCVPEGDALVCADPCQAHRTLDEYWRSTEYGEGYACDTDLRGWYRFVGQGGARMAETCVPVLRCNTAAPMWLNGTHPSSDEGIVSRKACAHWSGHCCLWDASVQVKACAGGYYVYNLTAPPECHLAYCTDPSSVEGTCEECSIDEDCKSNNGRWHCQCKQDFNITDISLLEHRLECGANDMKVSLGKCQLKSLGFDKVFMYLSDSRCSGFNDRDNRDWVSVVTPARDGPCGTVLTRNETHATYSNTLYLADEIIIRDLNIKINFACSYPLDMKVSLKTALQPMVSALNIRVGGTGMFTVRMALFQTPSYTQPYQGSSVTLSTEAFLYVGTMLDGGDLSRFALLMTNCYATPSSNATDPLKYFIIQDRCPHTRDSTIQVVENGESSQGRFSVQMFRFAGNYDLVYLHCEVYLCDTMNEKCKPTCSGTRFRSGSVIDQSRVLNLGPITRKGVQATVSRAFSSLGLLKVWLPLLLSATLTLTFQ

SEQ ID NO: 95950 - protein, 689 aa, Homo sapiens
  Payload ID: 19152
  Gene Name: uromodulin
  ENSP ID: ENSP00000379442
MRHIMTRLTLPFWLQDTRHQRQREKFKGPTRLSFGQVLSRPEVAGRAERMGQPSLTWMLMVVVASWFITTAATDTSEARWCSECHSNATCTEDEAVTTCTCQEGFTGDGLTCVDLDECAIPGAHNCSANSSCVNTPGSFSCVCPEGFRLSPGLGCTDVDECAEPGLSHCHALATCVNVVGSYLCVCPAGYRGDGWHCECSPGSCGPGLDCVPEGDALVCADPCQAHRTLDEYWRSTEYGEGYACDTDLRGWYRFVGQGGARMAETCVPVLRCNTAAPMWLNGTHPSSDEGIVSRKACAHWSGHCCLWDASVQVKACAGGYYVYNLTAPPECHLAYCTDPSSVEGTCEECSIDEDCKSNNGRWHCQCKQDFNITDISLLEHRLECGANDMKVSLGKCQLKSLGFDKVFMYLSDSRCSGFNDRDNRDWVSVVTPARDGPCGTVLTRNETHATYSNTLYLADEIIIRDLNIKINFACSYPLDMKVSLKTALQPMVSALNIRVGGTGMFTVRMALFQTPSYTQPYQGSSVTLSTEAFLYVGTMLDGGDLSRFALLMTNCYATPSSNATDPLKYFIIQDRCPHTRDSTIQVVENGESSQGRFSVQMFRFAGNYDLVYLHCEVYLCDTMNEKCKPTCSGTRFRSGSVIDQSRVLNLGPITRKGVQATVSRAFSSLGLLKVWLPLLLSATLTLTFQ

SEQ ID NO: 95951 - protein, 29 aa, Homo sapiens
  Payload ID: 19152
  Gene Name: uromodulin
  ENSP ID: ENSP00000458695
MGQPSLTWMLMVVVASWFITTAATDTSEA

SEQ ID NO: 95952 - protein, 125 aa, Homo sapiens
  Payload ID: 19152
  Gene Name: uromodulin
  ENSP ID: ENSP00000458939
MGQPSLTWMLMVVVASWFITTAATDTSEARWCSECHSNATCTEDEAVTTCTCQEGFTGDGLTCVDLDECAIPGAHNCSANSSCVNTPGSFSCVCPEGFRLSPGLGCTDVDECAEPGLSHCHALAT

SEQ ID NO: 95953 - protein, 88 aa, Homo sapiens
  Payload ID: 19152
  Gene Name: uromodulin
  ENSP ID: ENSP00000459724
MGQPSLTWMLMVVVASWFITTAATDTSEARWCSECHSNATCTEDEAVTTCTCQEGFTGDGLTCVDLDECAIPGAHNCSANSSCVNTPG

SEQ ID NO: 95954 - protein, 138 aa, Homo sapiens
  Payload ID: 19152
  Gene Name: uromodulin
  ENSP ID: ENSP00000459738
MRHIMTRLTLPFWLQVLSRPEVAGRAERMGQPSLTWMLMVVVASWFITTAATDTSEARWCSECHSNATCTEDEAVTTCTCQEGFTGDGLTCVDLDECAIPGAHNCSANSSCVNTPGSFSCVCPEGFRLSPGLGCTDVD

SEQ ID NO: 95955 - protein, 161 aa, Homo sapiens
  Payload ID: 19152
  Gene Name: uromodulin
  ENSP ID: ENSP00000460374
MGQPSLTWMLMVVVASWFITTAATDTSEARTKYNCPARWSWRTPQRGGDTEQGWCSECHSNATCTEDEAVTTCTCQEGFTGDGLTCVDLDECAIPGAHNCSANSSCVNTPGSFSCVCPEGFRLSPGLGCTDVDECAEPGLSHCHALATCVNVVGSYLCVCP

SEQ ID NO: 95956 - protein, 640 aa, Homo sapiens; identical to SEQ ID NO: 95948
  Payload ID: 19152
  Gene Name: uromodulin
  Uniprot ID: P07911
  ENSP ID: ENSP00000460548

SEQ ID NO: 95957 - protein, 161 aa, Homo sapiens
  Payload ID: 19152
  Gene Name: uromodulin
  ENSP ID: ENSP00000460845
MGQPSLTWMLMVVVASWFITTAATDTSEARTKYNCPARWSWRTPQRGGDTEQGPDEDFTSQGSRKHKMCKEREGQQVHRKSYQRWCSECHSNATCTEDEAVTTCTCQEGFTGDGLTCVDLDECAIPGAHNCSANSSCVNTPGSFSCVCPEGFRLSPGLGCT

SEQ ID NO: 95958 - protein, 86 aa, Homo sapiens
  Payload ID: 19152
  Gene Name: uromodulin
  ENSP ID: ENSP00000461120
MGQPSLTWMLMVVVASWFITTAATDTSEARWCSECHSNATCTEDEAVTTCTCQEGFTGDGLTCVDLDECAIPGAHNCSANSSCVNT

SEQ ID NO: 95959 - protein, 102 aa, Homo sapiens
  Payload ID: 19152
  Gene Name: uromodulin
  ENSP ID: ENSP00000461641
MGQPSLTWMLMVVVASWFITTAATDTSEARWCSECHSNATCTEDEAVTTCTCQEGFTGDGLTCVDLDECAIPGAHNCSANSSCVNTPGSFSCVCPEGFRLSP

SEQ ID NO: 95960 - protein, 242 aa, Homo sapiens
  Payload ID: 19153
  Gene Name: uromodulin-like 1
  ENSP ID: ENSP00000383273
  MOD_RES (1)..(1): Any amino acid
XPVGSWYNVTILVKMDFKELQQVDPRLLNHMRLLHSLVTSALQPMASTVHHLHSAPGNASTTVSRLLLGLPRPLPVADVSTLLGDIAKRVYEVISVQVQDVNECFYEELNACSGRELCANLEGSYWCVCHQEAPATSPRKLNLEWEDCPPVSDYVVLNVTSDSFQVSWRLNSTQNHTFHVRVYRGMELLRSARTQSQALAVAGLEAGVLYRVKTSYQGCGADVSTTLTIKTKYVLEKLDFQS

SEQ ID NO: 95961 - protein, 1246 aa, Homo sapiens
  Payload ID: 19153
  Gene Name: uromodulin-like 1
  Uniprot ID: Q5DID0
  ENSP ID: ENSP00000383276
MVYRTQYLVVEVPESRNVTDCCEGYEQLGLYCVLPLNQSGQFTSRPGACPAEGPEPSTSPCSLDIDCPGLEKCCPWSGGRYCMAPAPQAPERDPVGSWYNVTILVKMDFKELQQVDPRLLNHMRLLHSLVTSALQPMASTVHHLHSAPGNASTTVSRLLLGLPRPLPVADVSTLLGDIAKRVYEVISVQVQDVNECFYEELNACSGRELCANLEGSYWCVCHQEAPATSPRKLNLEWEDCPPVSDYVVLNVTSDSFQVSWRLNSTQNHTFHVRVYRGMELLRSARTQSQALAVAGLEAGVLYRVKTSYQGCGADVSTTLTIKTNAQVFEVTIKIVNHNLTEKLLNRSSVEYQDFSRQLLHEVESSFPPVVSDLYRSGKLRMQIVSLQAGSVVVRLKLTVQDPGFPMGISTLAPILQPLLASTVFQIDRQGTRVQDWDECVDSAEHDCSPAAWCINLEGSYTCQCRTTRDATPSRAGRACEGDLVSPMGGGLSAATGVTVPGLGTGTAALGLENFTLSPSPGYPQGTPAAGQAWTPEPSPRRGGSNVVGYDRNNTGKGVEQELQGNSIMEPPSWPSPTEDPTGHFLWHATRSTRETLLNPTWLRNEDSGPSGSVDLPLTSTLTALKTPACVPVSIGRIMVSNVTSTGFHLAWEADLAMDSTFQLTLTSMWSPAVVLETWNTSVTLSGLEPGVLHLVEIMAKACGKEGARAHLKVRTAARKLIGKVRIKNVRYSESFRNASSQEYRDFLELFFRMVRGSLPATMCQHMDAGGVRMEVVSVTNGSIVVEFHLLIIADVDVQEVSAAFLTAFQTVPLLEVIRGDTFIQDYDECERKEDDCVPGTSCRNTLGSFTCSCEGGAPDFPVEYSERPCEGDSPGNETWATSPERPLTTAGTKAAFVQGTSPTPQGLPQRLNLTGAVRVLCEIEKVVVAIQKRFLQQESIPESSLYLSHPSCNVSHSNGTHVLLEAGWSECGTLMQSNMTNTVVRTTLRNDLSQEGIIHHLKILSPIYCAFQNDLLTSSGFTLEWGVYTIIEDLHGAGNFVTEMQLFIGDSPIPQNYSVSASDDVRIEVGLYRQKSNLKVVLTECWATPSSNARDPITFSFINNSCPVPNTYTNVIENGNSNKAQFKLRIFSFINDSIVYLHCKLRVCMESPGATCKINCNNFRLLQNSETSATHQMSWGPLIRSEGEPPHAEAGLGAGYVVLIVVAIFVLVAGTATLLIVRYQRMNGRYNFKIQSNNFSYQVFYE

SEQ ID NO: 95962 - protein, 1374 aa, Homo sapiens
  Payload ID: 19153
  Gene Name: uromodulin-like 1
  Uniprot ID: Q5DID0
  ENSP ID: ENSP00000383279
MVYRTQYLVVEVPESRNVTDCCEGYEQLGLYCVLPLNQSGQFTSRPGACPAEGPEPSTSPCSLDIDCPGLEKCCPWSGGRYCMAPAPQAPERDPVGSWYNVTILVKMDFKELQQVDPRLLNHMRLLHSLVTSALQPMASTVHHLHSAPGNASTTVSRLLLGLPRPLPVADVSTLLGDIAKRVYEVISVQVQDVNECFYEELNACSGRELCANLEGSYWCVCHQEAPATSPRKLNLEWEDCPPVSDYVVLNVTSDSFQVSWRLNSTQNHTFHVRVYRGMELLRSARTQSQALAVAGLEAGVLYRVKTSYQGCGADVSTTLTIKTNAQVFEVTIKIVNHNLTEKLLNRSSVEYQDFSRQLLHEVESSFPPVVSDLYRSGKLRMQIVSLQAGSVVVRLKLTVQDPGFPMGISTLAPILQPLLASTVFQIDRQGTRVQDWDECVDSAEHDCSPAAWCINLEGSYTCQCRTTRDATPSRAGRACEGDLVSPMGGGLSAATGVTVPGLGTGTAALGLENFTLSPSPGYPQGTPAAGQAWTPEPSPRRGGSNVVGYDRNNTGKGVEQEVPSTAPGLGMDQGSPSQVNPSQGSPSQGSLRQESTSQASPSQRSTSQGSPSQVNPSQRSTSHANSSQGSPSQGSPSQESPSQGSTSQASPSHRNTIGVIGTTSSPKATGSTHSFPPGATDGPLALPGQLQGNSIMEPPSWPSPTEDPTGHFLWHATRSTRETLLNPTWLRNEDSGPSGSVDLPLTSTLTALKTPACVPVSIGRIMVSNVTSTGFHLAWEADLAMDSTFQLTLTSMWSPAVVLETWNTSVTLSGLEPGVLHLVEIMAKACGKEGARAHLKVRTAARKLIGKVRIKNVRYSESFRNASSQEYRDFLELFFRMVRGSLPATMCQHMDAGGVRMEVVSVTNGSIVVEFHLLIIADVDVQEVSAAFLTAFQTVPLLEVIRGDTFIQDYDECERKEDDCVPGTSCRNTLGSFTCSCEGGAPDFPVEYSERPCEGDSPGNETWATSPERPLTTAGTKAAFVQGTSPTPQGLPQRLNLTGAVRVLCEIEKVVVAIQKRFLQQESIPESSLYLSHPSCNVSHSNGTHVLLEAGWSECGTLMQSNMTNTVVRTTLRNDLSQEGIIHHLKILSPIYCAFQNDLLTSSGFTLEWGVYTIIEDLHGAGNFVTEMQLFIGDSPIPQNYSVSASDDVRIEVGLYRQKSNLKVVLTECWATPSSNARDPITFSFINNSCPVPNTYTNVIENGNSNKAQFKLRIFSFINDSIVYLHCKLRVCMESPGATCKINCNNFRLLQNSETSATHQMSWGPLIRSEGEPPHAEAGLGAGYVVLIVVAIFVLVAGTATLLIVRYQRMNGRYNFKIQSNNFSYQVFYE

SEQ ID NO: 95963 - protein, 1446 aa, Homo sapiens
  Payload ID: 19153
  Gene Name: uromodulin-like 1
  Uniprot ID: Q5DID0
  ENSP ID: ENSP00000386126
MLRTSGLALLALVSAVGPSQASGFTEKGLSLLGYQLCSHRVTHTVQKVEAVQTSYTSYVSCGGWIPWRRCPKMVYRTQYLVVEVPESRNVTDCCEGYEQLGLYCVLPLNQSGQFTSRPGACPAEGPEPSTSPCSLDIDCPGLEKCCPWSGGRYCMAPAPQAPERDPVGSWYNVTILVKMDFKELQQVDPRLLNHMRLLHSLVTSALQPMASTVHHLHSAPGNASTTVSRLLLGLPRPLPVADVSTLLGDIAKRVYEVISVQVQDVNECFYEELNACSGRELCANLEGSYWCVCHQEAPATSPRKLNLEWEDCPPVSDYVVLNVTSDSFQVSWRLNSTQNHTFHVRVYRGMELLRSARTQSQALAVAGLEAGVLYRVKTSYQGCGADVSTTLTIKTNAQVFEVTIKIVNHNLTEKLLNRSSVEYQDFSRQLLHEVESSFPPVVSDLYRSGKLRMQIVSLQAGSVVVRLKLTVQDPGFPMGISTLAPILQPLLASTVFQIDRQGTRVQDWDECVDSAEHDCSPAAWCINLEGSYTCQCRTTRDATPSRAGRACEGDLVSPMGGGLSAATGVTVPGLGTGTAALGLENFTLSPSPGYPQGTPAAGQAWTPEPSPRRGGSNVVGYDRNNTGKGVEQEVPSTAPGLGMDQGSPSQVNPSQGSPSQGSLRQESTSQASPSQRSTSQGSPSQVNPSQRSTSHANSSQGSPSQGSPSQESPSQGSTSQASPSHRNTIGVIGTTSSPKATGSTHSFPPGATDGPLALPGQLQGNSIMEPPSWPSPTEDPTGHFLWHATRSTRETLLNPTWLRNEDSGPSGSVDLPLTSTLTALKTPACVPVSIGRIMVSNVTSTGFHLAWEADLAMDSTFQLTLTSMWSPAVVLETWNTSVTLSGLEPGVLHLVEIMAKACGKEGARAHLKVRTAARKLIGKVRIKNVRYSESFRNASSQEYRDFLELFFRMVRGSLPATMCQHMDAGGVRMEVVSVTNGSIVVEFHLLIIADVDVQEVSAAFLTAFQTVPLLEVIRGDTFIQDYDECERKEDDCVPGTSCRNTLGSFTCSCEGGAPDFPVEYSERPCEGDSPGNETWATSPERPLTTAGTKAAFVQGTSPTPQGLPQRLNLTGAVRVLCEIEKVVVAIQKRFLQQESIPESSLYLSHPSCNVSHSNGTHVLLEAGWSECGTLMQSNMTNTVVRTTLRNDLSQEGIIHHLKILSPIYCAFQNDLLTSSGFTLEWGVYTIIEDLHGAGNFVTEMQLFIGDSPIPQNYSVSASDDVRIEVGLYRQKSNLKVVLTECWATPSSNARDPITFSFINNSCPVPNTYTNVIENGNSNKAQFKLRIFSFINDSIVYLHCKLRVCMESPGATCKINCNNFRLLQNSETSATHQMSWGPLIRSEGEPPHAEAGLGAGYVVLIVVAIFVLVAGTATLLIVRYQRMNGRYNFKIQSNNFSYQVFYE

SEQ ID NO: 95964 - protein, 1318 aa, Homo sapiens
  Payload ID: 19153
  Gene Name: uromodulin-like 1
  Uniprot ID: Q5DID0
  ENSP ID: ENSP00000386147
MLRTSGLALLALVSAVGPSQASGFTEKGLSLLGYQLCSHRVTHTVQKVEAVQTSYTSYVSCGGWIPWRRCPKMVYRTQYLVVEVPESRNVTDCCEGYEQLGLYCVLPLNQSGQFTSRPGACPAEGPEPSTSPCSLDIDCPGLEKCCPWSGGRYCMAPAPQAPERDPVGSWYNVTILVKMDFKELQQVDPRLLNHMRLLHSLVTSALQPMASTVHHLHSAPGNASTTVSRLLLGLPRPLPVADVSTLLGDIAKRVYEVISVQVQDVNECFYEELNACSGRELCANLEGSYWCVCHQEAPATSPRKLNLEWEDCPPVSDYVVLNVTSDSFQVSWRLNSTQNHTFHVRVYRGMELLRSARTQSQALAVAGLEAGVLYRVKTSYQGCGADVSTTLTIKTNAQVFEVTIKIVNHNLTEKLLNRSSVEYQDFSRQLLHEVESSFPPVVSDLYRSGKLRMQIVSLQAGSVVVRLKLTVQDPGFPMGISTLAPILQPLLASTVFQIDRQGTRVQDWDECVDSAEHDCSPAAWCINLEGSYTCQCRTTRDATPSRAGRACEGDLVSPMGGGLSAATGVTVPGLGTGTAALGLENFTLSPSPGYPQGTPAAGQAWTPEPSPRRGGSNVVGYDRNNTGKGVEQELQGNSIMEPPSWPSPTEDPTGHFLWHATRSTRETLLNPTWLRNEDSGPSGSVDLPLTSTLTALKTPACVPVSIGRIMVSNVTSTGFHLAWEADLAMDSTFQLTLTSMWSPAVVLETWNTSVTLSGLEPGVLHLVEIMAKACGKEGARAHLKVRTAARKLIGKVRIKNVRYSESFRNASSQEYRDFLELFFRMVRGSLPATMCQHMDAGGVRMEVVSVTNGSIVVEFHLLIIADVDVQEVSAAFLTAFQTVPLLEVIRGDTFIQDYDECERKEDDCVPGTSCRNTLGSFTCSCEGGAPDFPVEYSERPCEGDSPGNETWATSPERPLTTAGTKAAFVQGTSPTPQGLPQRLNLTGAVRVLCEIEKVVVAIQKRFLQQESIPESSLYLSHPSCNVSHSNGTHVLLEAGWSECGTLMQSNMTNTVVRTTLRNDLSQEGIIHHLKILSPIYCAFQNDLLTSSGFTLEWGVYTIIEDLHGAGNFVTEMQLFIGDSPIPQNYSVSASDDVRIEVGLYRQKSNLKVVLTECWATPSSNARDPITFSFINNSCPVPNTYTNVIENGNSNKAQFKLRIFSFINDSIVYLHCKLRVCMESPGATCKINCNNFRLLQNSETSATHQMSWGPLIRSEGEPPHAEAGLGAGYVVLIVVAIFVLVAGTATLLIVRYQRMNGRYNFKIQSNNFSYQVFYE

SEQ ID NO: 95965 - protein, 78 aa, Homo sapiens
  Payload ID: 19153
  Gene Name: uromodulin-like 1
  ENSP ID: ENSP00000417444
  MOD_RES (1)..(1): Any amino acid
XPVGSWYNVTILVKMDFKELQQVDPRLLNHMRLLHSLMSMSVSMRSSMPALEGNCAQTWRARTGASVTRKLQPRLHGS

SEQ ID NO: 95966 - protein, 109 aa, Homo sapiens
  Payload ID: 19153
  Gene Name: uromodulin-like 1
  ENSP ID: ENSP00000418135
  MOD_RES (1)..(1): Any amino acid
XPVGSWYNVTILVKMDFKELQQVDPRLLNHMRLLHSLLVKGTAQLASKKLALKPHCLALVLPLISCVTLGHQRPATNGLHRPPPALSPWERLHHSVAAATGPATATACG

SEQ ID NO: 95967 - protein, 174 aa, Homo sapiens
  Payload ID: 19153
  Gene Name: uromodulin-like 1
  ENSP ID: ENSP00000418417
  MOD_RES (1)..(1): Any amino acid
XPVGSWYNVTILVKMDFKELQQVDPRLLNHMRLLHSLVTSALQPMASTVHHLHSAPGNASTTVSRLLLGLPRPLPVADVSTLLGDIAKRVYEVISVQVQDVNECFYEELNACSGRELCANLEGSYWCVCHQEAPATSPRKLNLEWEARGLEIHLELRATSTSHGTPLSSAENCL

SEQ ID NO: 95968 - protein, 113 aa, Homo sapiens
  Payload ID: 19153
  Gene Name: uromodulin-like 1
  ENSP ID: ENSP00000418848
  MOD_RES (1)..(1): Any amino acid
XPVGSWYNVTILVKMDFKELQQVDPRLLNHMRLLHSLVGETDGGCLHPPCGSCSGRPRSPAPCNQWPPPSTTCTQPLGTPPPQCRGCYWACHGHCLWLTSPPCWVTLRSVSMK

SEQ ID NO: 95969 - protein, 138 aa, Homo sapiens
  Payload ID: 19153
  Gene Name: uromodulin-like 1
  ENSP ID: ENSP00000420468
  MOD_RES (1)..(1): Any amino acid
XPVGSWYNVTILVKMDFKELQQVDPRLLNHMRLLHSLVTSALQPMASTVHHLHSAPGNASTTVSRLLLGLPRPLPVADVSTLLGDIAKRVYEVISVQMSMSVSMRSSMPALEGNCAQTWRARTGASVTRKLQPRLHGS

SEQ ID NO: 95970 - protein, 406 aa, Homo sapiens
  Payload ID: 19154
  Gene Name: uronyl-2-sulfotransferase
  Uniprot ID: Q9Y2C2
  ENSP ID: ENSP00000356433
MKKKQQHPGGGADPWPHGAPMGGAPPGLGSWKRRVPLLPFLRFSLRDYGFCMATLLVFCLGSLLYQLSGGPPRFLLDLRQYLGNSTYLDDHGPPPSKVLPFPSQVVYNRVGKCGSRTVVLLLRILSEKHGFNLVTSDIHNKTRLTKNEQMELIKNISTAEQPYLFTRHVHFLNFSRFGGDQPVYINIIRDPVNRFLSNYFFRRFGDWRGEQNHMIRTPSMRQEERYLDINECILENYPECSNPRLFYIIPYFCGQHPRCREPGEWALERAKLNVNENFLLVGILEELEDVLLLLERFLPHYFKGVLSIYKDPEHRKLGNMTVTVKKTVPSPEAVQILYQRMRYEYEFYHYVKEQFHLLKRKFGLKSHVSKPPLRPHFFIPTPLETEEPIDDEEQDDEKWLEDIYKR

SEQ ID NO: 95971 - protein, 258 aa, Homo sapiens
  Payload ID: 19155
  Gene Name: uroplakin 1A
  Uniprot ID: O00322
  ENSP ID: ENSP00000222275
MASAAAAEAEKGSPVVVGLLVVGNIIILLSGLSLFAETIWVTADQYRVYPLMGVSGKDDVFAGAWIAIFCGFSFFMVASFGVGAALCRRRSMVLTYLVLMLIVYIFECASCITSYTHRDYMVSNPSLITKQMLTFYSADTDQGQELTRLWDRVMIEQECCGTSGPMDWVNFTSAFRAATPEVVFPWPPLCCRRTGNFIPLNEEGCRLGHMDYLFTKGCFEHIGHAIDSYTWGISWFGFAILMWTLPVMLIAMYFYTML

SEQ ID NO: 95972 - protein, 273 aa, Homo sapiens
  Payload ID: 19155
  Gene Name: uroplakin 1A
  Uniprot ID: O00322
  ENSP ID: ENSP00000368298
MASAAAAEAEKGSPVVVGLLVVGNIIILLSGLSLFAETIWVTADQYRVYPLMGVSGKDDVFAGAWIAIFCGFSFFMVASFGVGAALCRRRSMVLTYLVLMLIVYIFECASCITSYTHRDYMVSNPSLITKQMLTFYSADTDQGQELTRLWDRVMIEQECCGTSGPMDWVNFTSAFRAATPEVVFPWPPLCCRRTGNFIPLNEEGCRLGHMDYLFTKAGVQWHNLSSLQRLPPGFKGFSHLSFQSSWDYRAASNTSATPSTATRGVSRGLGLPS

SEQ ID NO: 95973 - protein, 273 aa, Homo sapiens; identical to SEQ ID NO: 95972
  Payload ID: 19155
  Gene Name: uroplakin 1A
  Uniprot ID: O00322
  ENSP ID: ENSP00000478942

SEQ ID NO: 95974 - protein, 258 aa, Homo sapiens; identical to SEQ ID NO: 95971
  Payload ID: 19155
  Gene Name: uroplakin 1A
  Uniprot ID: O00322
  ENSP ID: ENSP00000483176

SEQ ID NO: 95975 - protein, 260 aa, Homo sapiens
  Payload ID: 19156
  Gene Name: uroplakin 1B
  Uniprot ID: O75841
  ENSP ID: ENSP00000264234
MAKDNSTVRCFQGLLIFGNVIIGCCGIALTAECIFFVSDQHSLYPLLEATDNDDIYGAAWIGIFVGICLFCLSVLGIVGIMKSSRKILLAYFILMFIVYAFEVASCITAATQQDFFTPNLFLKQMLERYQNNSPPNNDDQWKNNGVTKTWDRLMLQDNCCGVNGPSDWQKYTSAFRTENNDADYPWPRQCCVMNNLKEPLNLEACKLGVPGFYHNQGCYELISGPMNRHAWGVAWFGFAILCWTFWVLLGTMFYWSRIEY

SEQ ID NO: 95976 - protein, 252 aa, Homo sapiens
  Payload ID: 19156
  Gene Name: uroplakin 1B
  ENSP ID: ENSP00000418116
MAKDNSTVRCFQGLLIFGNVIIGCCGIALTAECIFFVSDQHSLYPLLEATDNDDIYGAAWIGIFVGICLFCLSVLGIVGIMKSSRKILLAYFILMFIVYAFEVASCITAATQQDFQMLERYQNNSPPNNDDQWKNNGVTKTWDRLMLQDNCCGVNGPSDWQKYTSAFRTENNDADYPWPRQCCVMNNLKEPLNLEACKLGVPGFYHNQGCYELISGPMNRHAWGVAWFGFAILCWTFWVLLGTMFYWSRIEY

SEQ ID NO: 95977 - protein, 169 aa, Homo sapiens
  Payload ID: 19156
  Gene Name: uroplakin 1B
  ENSP ID: ENSP00000418399
MAKDNSTVRCFQGLLIFGNVIIGCCGIALTAECIFFVSDQHSLYPLLEATDNDDIYGAAWIGIFVGICLFCLSVLGIVGIMKSSRKILLAYFILMFIVYAFEVASCITAATQQDFFTPNLFLKQMLERYQNNSPPNNDDQWKNNGVTKTWDRLMLQDNCCGVNGPSDWQ

SEQ ID NO: 95978 - protein, 189 aa, Homo sapiens
  Payload ID: 19156
  Gene Name: uroplakin 1B
  ENSP ID: ENSP00000418597
MAKDNSTVRCFQGLLIFGNVIIGCCGIALTAECIFFVSDQHSLYPLLEATDNDDIYGAAWIGIFVGICLFCLSVLGIVGIMKSSRKILLAYFILMFIVYAFEVASCITAATQQDFFTPNLFLKQMLERYQNNSPPNNDDQWKNNGVTKTWDRLMLQDNCCGVNGPSDWQKYTSAFRTENNDADYPWPRQ

SEQ ID NO: 95979 - protein, 180 aa, Homo sapiens
  Payload ID: 19156
  Gene Name: uroplakin 1B
  ENSP ID: ENSP00000418972
MKSSRKILLAYFILMFIVYAFEVASCITAATQQDFFTPNLFLKQMLERYQNNSPPNNDDQWKNNGVTKTWDRLMLQDNCCGVNGPSDWQKYTSAFRTENNDADYPWPRQCCVMNNLKEPLNLEACKLGVPGFYHNQGCYELISGPMNRHAWGVAWFGFAILCWTFWVLLGTMFYWSRIEY

SEQ ID NO: 95980 - protein, 184 aa, Homo sapiens
  Payload ID: 19157
  Gene Name: uroplakin 2
  Uniprot ID: O00526
  ENSP ID: ENSP00000264031
MAPLLPIRTLPLILILLALLSPGAADFNISSLSGLLSPALTESLLVALPPCHLTGGNATLMVRRANDSKVVTSSFVVPPCRGRRELVSVVDSGAGFTVTRLSAYQVTNLVPGTKFYISYLVKKGTATESSREIPMSTLPRRNMESIGLGMARTGGMVVITVLLSVAMFLLVLGFIIALALGSRK

SEQ ID NO: 95981 - protein, 287 aa, Homo sapiens
  Payload ID: 19158
  Gene Name: uroplakin 3A
  Uniprot ID: O75631
  ENSP ID: ENSP00000216211
MPPLWALLALGCLRFGSAVNLQPQLASVTFATNNPTLTTVALEKPLCMFDSKEALTGTHEVYLYVLVDSAISRNASVQDSTNTPLGSTFLQTEGGRTGPYKAVAFDLIPCSDLPSLDAIGDVSKASQILNAYLVRVGANGTCLWDPNFQGLCNAPLSAATEYRFKYVLVNMSTGLVEDQTLWSDPIRTNQLTPYSTIDTWPGRRSGGMIVITSILGSLPFFLLVGFAGAIALSLVDMGSSDGETTHDSQITQEAVPKSLGASESSYTSVNRGPPLDRAEVYSSKLQD

SEQ ID NO: 95982 - protein, 166 aa, Homo sapiens
  Payload ID: 19158
  Gene Name: uroplakin 3A
  Uniprot ID: O75631
  ENSP ID: ENSP00000379391
MPPLWALLALGCLRFGSAVNLQPQLASVTFATNNPTLTTVALEKPLCMFDSKEALTGTHEVYLYVLVDSVTPYSTIDTWPGRRSGGMIVITSILGSLPFFLLVGFAGAIALSLVDMGSSDGETTHDSQITQEAVPKSLGASESSYTSVNRGPPLDRAEVYSSKLQD

SEQ ID NO: 95983 - protein, 320 aa, Homo sapiens
  Payload ID: 19159
  Gene Name: uroplakin 3B
  Uniprot ID: Q9BT76
  ENSP ID: ENSP00000257632
MGLPWGQPHLGLQMLLLALNCLRPSLSLGEWGSWMDASSQTQGAGGPAGVIGPWAPAPLRLGEAAPGTPTPVSVAHLLSPVATELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYREDPRIHRHLARAAKWQHDRHYLHPLFSGRPPTLGLLGSLYHALLQPVVAGGGPGAAADRLLHGQALHDPPHPTQRGRHTAGGLQAWPGPPPQPQPLAWPLCMGLGEMGRWE

SEQ ID NO: 95984 - protein, 276 aa, Homo sapiens
  Payload ID: 19159
  Gene Name: uroplakin 3B
  Uniprot ID: Q9BT76
  ENSP ID: ENSP00000334938
MGLPWGQPHLGLQMLLLALNCLRPSLSLELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYRVKFLLMDTRGSPRAETKWSDPITLHQGKTPGSIDTWPGRRSGSMIVITSILSSLAGLLLLAFLAASTMRFSSLWWPEEAPEQLRIGSFMGKRYMTHHIPPREAATLPVGCKPGLDPLPSLSP

SEQ ID NO: 95985 - protein, 265 aa, Homo sapiens
  Payload ID: 19159
  Gene Name: uroplakin 3B
  Uniprot ID: Q9BT76
  ENSP ID: ENSP00000378319
MGLPWGQPHLGLQMLLLALNCLRPSLSLELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYREDPRIHRHLARAAKWQHDRHYLHPLFSGRPPTLGLLGSLYHALLQPVVAGGGPGAAADRLLHGQALHDPPHPTQRGRHTAGGLQAWPGPPPQPQPLAWPLCMGLGEMGRWE

SEQ ID NO: 95986 - protein, 320 aa, Homo sapiens
  Payload ID: 19159
  Gene Name: uroplakin 3B
  Uniprot ID: Q9BT76
  ENSP ID: ENSP00000441284
MGLPWGQPHLGLQMLLLALNCLRPSLSLGEWGSWMDASSQTQGAGGPAGVIGPWAPAPLRLGEAAPGTPTPVSVAHLLSPVATELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYREDPRIHRHLARAAKWQHDRHYLHPLFSGRPPTLGLLGSLYHALLQPVVAGGGPGAAADRLLHGQALHDPPHPTQRGRHTAGGLQAWPGPPPQPQPLAWPLCMGLGEMGRRE

SEQ ID NO: 95987 - protein, 276 aa, Homo sapiens
  Payload ID: 19159
  Gene Name: uroplakin 3B
  Uniprot ID: Q9BT76
  ENSP ID: ENSP00000479568
MGLPWGQPHLGLQMLLLALNCLRPSLSLELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYRVKFLLMDTRGSPRAETKWSDPITLHQGKTPGSIDTWPGRRSGSMIVITSILSSLAGLLLLAFLAASTMRFSSLWWPEEAPEQLRIGSFMGKRYMTHHIPPSEAATLPVGCKPGLDPLPSLSP

SEQ ID NO: 95988 - protein, 265 aa, Homo sapiens
  Payload ID: 19159
  Gene Name: uroplakin 3B
  ENSP ID: ENSP00000487650
MGLPWGQPHLGLQMLLLALNCLRPSLSLELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYREDPRIHRHLARAAKWQHDRHYLHPLFSGRPPTLGLLGSLYHALLQPVVAGGGPGAAADRLLHGQALHDPPHPTQRGRHTAGGLQAWPGPPPQPQPLAWPLCMGLGEMGRRE

SEQ ID NO: 95989 - protein, 263 aa, Homo sapiens
  Payload ID: 19160
  Gene Name: uroplakin 3B-like
  Uniprot ID: B0FP48
  ENSP ID: ENSP00000342938
MDNSWRLGPAIGLSAGQSQLLVSLLLLLTRVQPGTDVAAPEHISYVPQLSNDTLAGRLTLSTFTLEQPLGQFSSHNISDLDTIWLVVALSNATQSFTAPRTNQDIPAPANFSQRGYYLTLRANRVLYQTRGQLHVLRVGNDTHCQPTKIGCNHPLPGPGPYRVKFLVMNDEGPVAETKWSSDTRLQQAQALRAVPGPQSPGTVVIIAILSILLAVLLTVLLAVLIYTCFNSCRSTSLSGPEEAGSVRRYTTHLAFSTPAEGAS

SEQ ID NO: 95990 - protein, 367 aa, Homo sapiens
  Payload ID: 19161
  Gene Name: uroporphyrinogen decarboxylase
  Uniprot ID: P06132
  ENSP ID: ENSP00000246337
MEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPWTLMTYMVEGGGSSTMAQAKRWLYQRPQASHQLLRILTDALVPYLVGQVVAGAQALQLFESHAGHLGPQLFNKFALPYIRDVAKQVKARLREAGLAPVPMIIFAKDGHFALEELAQAGYEVVGLDWTVAPKKARECVGKTVTLQGNLDPCALYASEEEIGQLVKQMLDDFGPHRYIANLGHGLYPDMDPEHVGAFVDAVHKHSRLLRQN

SEQ ID NO: 95991 - protein, 228 aa, Homo sapiens
  Payload ID: 19161
  Gene Name: uroporphyrinogen decarboxylase
  ENSP ID: ENSP00000400253
  MOD_RES (1)..(1): Any amino acid
XPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPALQLFESHAGHLGPQLFNKFALPYIRDVAKQVKARLREAGLAPVPMIIFAKDGHFALEELAQAGYEVVGLDWTVAP

SEQ ID NO: 95992 - protein, 193 aa, Homo sapiens
  Payload ID: 19161
  Gene Name: uroporphyrinogen decarboxylase
  ENSP ID: ENSP00000404489
MEANGLGPQGFPELKNDTFLRAAWGEETDYTPVWCMRQAGRYLPEFRETRAAQDFFSTCRSPEACCELTLQALGMEVTMVPGKGPSFPEPLREEQDLERLRDPEVVASELGYVFQAITLTRQRLAGRVPLIGFAGAPWTLMTYMVEGGGSSTMAQAKRWLYQRPQASHQLLRILTDALVPYLVGQVVAGAQAL

SEQ ID NO: 95993 - protein, 133 aa, Homo sapiens
  Payload ID: 19162
  Gene Name: uroporphyrinogen III synthase
  ENSP ID: ENSP00000357763
MKVLLLKDAKEDDCGQDPYIRELGLYGLEATLIPVLSFEFLSLPSFSEKLSHPEDYGGLIFTSPRAVEAAELCLEQNNKTEVWERSLKEKWNAKSVYVVGNATASLVSKIGLDTEGETCGNAEKLAEYICSSK

SEQ ID NO: 95994 - protein, 139 aa, Homo sapiens
  Payload ID: 19162
  Gene Name: uroporphyrinogen III synthase
  ENSP ID: ENSP00000357767
MKVLLLKDAKEDDCGQDPYIRELGLYGLEATLIPVLSFEFLSLPSFSEKLSHPEDYGGLIFTSPRAVEAAELCLEQNNKTEVWERSLKEKWNAKSVYVVGNATASLVSKIGLDTEGETCGNAEKLAEYICSSEEVKGIF

SEQ ID NO: 95995 - protein, 265 aa, Homo sapiens
  Payload ID: 19162
  Gene Name: uroporphyrinogen III synthase
  Uniprot ID: P10746
  ENSP ID: ENSP00000357775
MKVLLLKDAKEDDCGQDPYIRELGLYGLEATLIPVLSFEFLSLPSFSEKLSHPEDYGGLIFTSPRAVEAAELCLEQNNKTEVWERSLKEKWNAKSVYVVGNATASLVSKIGLDTEGETCGNAEKLAEYICSRESSALPLLFPCGNLKREILPKALKDKGIAMESITVYQTVAHPGIQGNLNSYYSQQGVPASITFFSPSGLTYSLKHIQELSGDNIDQIKFAAIGPTTARALAAQGLPVSCTAESPTPQALATGIRKALQPHGCC

SEQ ID NO: 95996 - protein, 265 aa, Homo sapiens; identical to SEQ ID NO: 95995
  Payload ID: 19162
  Gene Name: uroporphyrinogen III synthase
  Uniprot ID: P10746
  ENSP ID: ENSP00000357787

SEQ ID NO: 95997 - protein, 185 aa, Homo sapiens
  Payload ID: 19162
  Gene Name: uroporphyrinogen III synthase
  ENSP ID: ENSP00000414833
MKVLLLKDAKEDDCGQDPYIRLSHPEDYGGLIFTSPRAVEAAELCLEQNNKTEVWERSLKEKWNAKSVYVVGNATASLVSKIGLDTEGETCGNAEKLAEYICSRESSALPLLFPCGNLKREILPKALKDKGIAMESITVYQTVAHPGIQGNLNSYYSQQGVPASITFFSPSGLTYSLKHIQELSG

SEQ ID NO: 95998 - protein, 110 aa, Homo sapiens
  Payload ID: 19162
  Gene Name: uroporphyrinogen III synthase
  ENSP ID: ENSP00000478957
  MOD_RES (1)..(1): Any amino acid
XEGETCGNAEKLAEYICSRESSALPLLFPCGNLKREILPKALKDKGIAMESITVYQTVAHPGIQGNLNSYYSQQGVPASITFFSPSGLTYSLKHIQELSGDNIDQIKKHP

SEQ ID NO: 95999 - protein, 68 aa, Homo sapiens
  Payload ID: 19162
  Gene Name: uroporphyrinogen III synthase
  ENSP ID: ENSP00000482520
  MOD_RES (1)..(1): Any amino acid
XYQTVAHPGIQGNLNSYYSQQGVPASITFFSPSGLTYSLKHIQELSGDNIDQIKIEELELQWASWALR

SEQ ID NO: 96000 - protein, 122 aa, Homo sapiens
  Payload ID: 19162
  Gene Name: uroporphyrinogen III synthase
  ENSP ID: ENSP00000483041
FPCGNLKREILPKALKDKGIAMESITVYQTVAHPGIQGNLNSYYSQQGVPASITFFSPSGLTYSLKHIQELSGDNIDQIKLLDGGELLKKFMQGRNKGSHRNLRAKVKCNWPPRPRGASSEN

SEQ ID NO: 96001 - protein, 139 aa, Homo sapiens
  Payload ID: 19163
  Gene Name: urotensin 2
  Uniprot ID: O95399
  ENSP ID: ENSP00000054668
METNVFHLMLCVTSARTHKSTSLCFGHFNSYPSLPLIHDLLLEISFQLSAPHEDARLTPEELERASLLQILPEMLGAERGDILRKADSSTNIFNPRGNLRKFQDFSGQDPNILLSHLLARIWKPYKKRETPDCFWKYCV

SEQ ID NO: 96002 - protein, 124 aa, Homo sapiens
  Payload ID: 19163
  Gene Name: urotensin 2
  Uniprot ID: O95399
  ENSP ID: ENSP00000355163
MYKLASCCLLFIGFLNPLLSLPLLDSREISFQLSAPHEDARLTPEELERASLLQILPEMLGAERGDILRKADSSTNIFNPRGNLRKFQDFSGQDPNILLSHLLARIWKPYKKRETPDCFWKYCV

SEQ ID NO: 96003 - protein, 139 aa, Homo sapiens
  Payload ID: 19163
  Gene Name: urotensin 2
  ENSP ID: ENSP00000366738
MYKLASCCLLFIGFLNPLLSLPLLDSREISFQLSAPHEDARLTPEELERASLLQILPEMLGAERGDILRKADSSTNIFNPRGNLRKFQDFSGQDPNILLSHLLARIWKPYKKQRRKLRQDLRLWKKEPGLRIFKNYVWV

SEQ ID NO: 96004 - protein, 389 aa, Homo sapiens
  Payload ID: 19164
  Gene Name: urotensin 2 receptor
  Uniprot ID: Q9UKP6
  ENSP ID: ENSP00000323516
MALTPESPSSFPGLAATGSSVPEPPGGPNATLNSSWASPTEPSSLEDLVATGTIGTLLSAMGVVGVVGNAYTLVVTCRSLRAVASMYVYVVNLALADLLYLLSIPFIVATYVTKEWHFGDVGCRVLFGLDFLTMHASIFTLTVMSSERYAAVLRPLDTVQRPKGYRKLLALGTWLLALLLTLPVMLAMRLVRRGPKSLCLPAWGPRAHRAYLTLLFATSIAGPGLLIGLLYARLARAYRRSQRASFKRARRPGARALRLVLGIVLLFWACFLPFWLWQLLAQYHQAPLAPRTARIVNYLTTCLTYGNSCANPFLYTLLTRNYRDHLRGRVRGPGSGGGRGPVPSLQPRARFQRCSGRSLSSCSPQPTDSLVLAPAAPARPAPEGPRAPA

SEQ ID NO: 96005 - protein, 119 aa, Homo sapiens
  Payload ID: 19165
  Gene Name: urotensin 2B
  Uniprot ID: Q765I0
  ENSP ID: ENSP00000340526
MNKILSSTVCFGLLTLLSVLSFLQSVHGRPYLTQGNEIFPDKKYTNREELLLALLNKNFDFQRPFNTDLALPNKLEELNQLEKLKEQLVEEKDSETSYAVDGLFSSHPSKRACFWKYCV

SEQ ID NO: 96006 - protein, 81 aa, Homo sapiens
  Payload ID: 19165
  Gene Name: urotensin 2B
  ENSP ID: ENSP00000398540
MNKILSSTVCFGLLTLLSVLSFLQSVHGRPYLTQGNEIFPDKKYTNREELLLALLNKNFDFQRPFNTAGKAKRTASGGEGF

SEQ ID NO: 96007 - protein, 119 aa, Homo sapiens; identical to SEQ ID NO: 96005
  Payload ID: 19165
  Gene Name: urotensin 2B
  Uniprot ID: Q765I0
  ENSP ID: ENSP00000398761

SEQ ID NO: 96008 - protein, 38 aa, Homo sapiens
  Payload ID: 19165
  Gene Name: urotensin 2B
  ENSP ID: ENSP00000401028
MNKILSSTVCFGLLTLLSVLSFLQSVHGRPYLTQGNEI

SEQ ID NO: 96009 - protein, 81 aa, Homo sapiens; identical to SEQ ID NO: 96006
  Payload ID: 19165
  Gene Name: urotensin 2B
  ENSP ID: ENSP00000404406

SEQ ID NO: 96010 - protein, 132 aa, Homo sapiens
  Payload ID: 19165
  Gene Name: urotensin 2B
  ENSP ID: ENSP00000415628
MNKILSSTVCFGLLTLLSVLSFLQSVHGRPYLTQGNEIFPDKKYTNREELLLALLNKNFDFQRPFNTDLALPNKLEELNQLEKLKEQLVEEKDSETSYAVDGLFSSHPSKRALSSRTLIQLNCLQHCQNRRG

SEQ ID NO: 96011 - protein, 899 aa, Homo sapiens
  Payload ID: 19166
  Gene Name: Usher syndrome 1C
  Uniprot ID: Q9Y6N9
  ENSP ID: ENSP00000005226
MDRKVAREFRHKVDFLIENDAEKDYLYDVLRMYHQTMDVAVLVGDLKLVINEPSRLPLFDAIRPLIPLKHQVEYDQLTPRRSRKLKEVRLDRLHPEGLGLSVRGGLEFGCGLFISHLIKGGQADSVGLQVGDEIVRINGYSISSCTHEEVINLIRTKKTVSIKVRHIGLIPVKSSPDEPLTWQYVDQFVSESGGVRGSLGSPGNRENKEKKVFISLVGSRGLGCSISSGPIQKPGIFISHVKPGSLSAEVGLEIGDQIVEVNGVDFSNLDHKEAVNVLKSSRSLTISIVAAAGRELFMTDRERLAEARQRELQRQELLMQKRLAMESNKILQEQQEMERQRRKEIAQKAAEENERYRKEMEQIVEEEEKFKKQWEEDWGSKEQLLLPKTITAEVHPVPLRKPKSFGWFYRYDGKFPTIRKKGKDKKKAKYGSLQDLRKNKKELEFEQKLYKEKEEMLEKEKQLKINRLAQEVSETEREDLEESEKIQYWVERLCQTRLEQISSADNEISEMTTGPPPPPPSVSPLAPPLRRFAGGLHLHTTDLDDIPLDMFYYPPKTPSALPVMPHPPPSNPPHKVPAPPVLPLSGHVSASSSPWVQRTPPPIPIPPPPSVPTQDLTPTRPLPSALEEALSNHPFRTGDTGNPVEDWEAKNHSGKPTNSPVPEQSFPPTPKTFCPSPQPPRGPGVSTISKPVMVHQEPNFIYRPAVKSEVLPQEMLKRMVVYQTAFRQDFRKYEEGFDPYSMFTPEQIMGKDVRLLRIKKEGSLDLALEGGVDSPIGKVVVSAVYERGAAERHGGIVKGDEIMAINGKIVTDYTLAEAEAALQKAWNQGGDWIDLVVAVCPPKEYDDELASLPSSVAESPQPVRKLLEDRAAVHRHGFLLQLEPTDLLLKSKRGNQIHR

SEQ ID NO: 96012 - protein, 552 aa, Homo sapiens
  Payload ID: 19166
  Gene Name: Usher syndrome 1C
  Uniprot ID: Q9Y6N9
  ENSP ID: ENSP00000317018
MDRKVAREFRHKVDFLIENDAEKDYLYDVLRMYHQTMDVAVLVGDLKLVINEPSRLPLFDAIRPLIPLKHQVEYDQLTPRRSRKLKEVRLDRLHPEGLGLSVRGGLEFGCGLFISHLIKGGQADSVGLQVGDEIVRINGYSISSCTHEEVINLIRTKKTVSIKVRHIGLIPVKSSPDEPLTWQYVDQFVSESGGVRGSLGSPGNRENKEKKVFISLVGSRGLGCSISSGPIQKPGIFISHVKPGSLSAEVGLEIGDQIVEVNGVDFSNLDHKEAVNVLKSSRSLTISIVAAAGRELFMTDRERLAEARQRELQRQELLMQKRLAMESNKILQEQQEMERQRRKEIAQKAAEENERYRKEMEQIVEEEEKFKKQWEEDWGSKEQLLLPKTITAEVHPVPLRKPKYDQGVEPELEPADDLDGGTEEQGEQDFRKYEEGFDPYSMFTPEQIMGKDVRLLRIKKEGSLDLALEGGVDSPIGKVVVSAVYERGAAERHGGIVKGDEIMAINGKIVTDYTLAEAEAALQKAWNQGGDWIDLVVAVCPPKEYDDELTFF

SEQ ID NO: 96013 - protein, 403 aa, Homo sapiens
  Payload ID: 19166
  Gene Name: Usher syndrome 1C
  Uniprot ID: Q9Y6N9
  ENSP ID: ENSP00000432236
MDRKVAREFRHKVDFLIENDAEKDYLYDVLRMYHQTMDVAVLVGDLKLVINEPSRLPLFDAIRPLIPLKHQVEYDQLTPRRSRKLKEVRLDRLHPEGLGLSVRGGLEFGCGLFISHLIKGGQADSVGLQVGDEIVRINGYSISSCTHEEVINLIRTKKTVSIKVRHIGLIPVKSSPDEPLTWQYVDQFVSESGGVRGSLGSPGNRENKEKKVFISLVGSRGLGCSISSGPIQKPGIFISHVKPGSLSAEVGLEIGDQIVEVNGVDFSNLDHKEAVNVLKSSRSLTISIVAAAGRELFMTDRERLAEARQRELQRQELLMQKRLAMESNKILQEQQEMERQRRKEIAQKAAEENERYRKEMEQIVEEEEKFKKQWEEDWGSKEQLLLPKTITAEVHPVPLRKPK

SEQ ID NO: 96014 - protein, 521 aa, Homo sapiens
  Payload ID: 19166
  Gene Name: Usher syndrome 1C
  Uniprot ID: Q9Y6N9
  ENSP ID: ENSP00000432944
MYHQTMDVAVLVGDLKLVINEPSRLPLFDAIRPLIPLKHQVEYDQLTPRRSRKLKEVRLDRLHPEGLGLSVRGGLEFGCGLFISHLIKGGQADSVGLQVGDEIVRINGYSISSCTHEEVINLIRTKKTVSIKVRHIGLIPVKSSPDEPLTWQYVDQFVSESGGVRGSLGSPGNRENKEKKVFISLVGSRGLGCSISSGPIQKPGIFISHVKPGSLSAEVGLEIGDQIVEVNGVDFSNLDHKEAVNVLKSSRSLTISIVAAAGRELFMTDRERLAEARQRELQRQELLMQKRLAMESNKILQEQQEMERQRRKEIAQKAAEENERYRKEMEQIVEEEEKFKKQWEEDWGSKEQLLLPKTITAEVHPVPLRKPKYDQGVEPELEPADDLDGGTEEQGEQDFRKYEEGFDPYSMFTPEQIMGKDVRLLRIKKEGSLDLALEGGVDSPIGKVVVSAVYERGAAERHGGIVKGDEIMAINGKIVTDYTLAEAEAALQKAWNQGGDWIDLVVAVCPPKEYDDELTFF

SEQ ID NO: 96015 - protein, 533 aa, Homo sapiens
  Payload ID: 19166
  Gene Name: Usher syndrome 1C
  Uniprot ID: Q9Y6N9
  ENSP ID: ENSP00000436934
MDRKVAREFRHKVDFLIENDAEKDYLYDVLRMYHQTMDVAVLVGDLKLVINEPSRLPLFDAIRPLIPLKHQVEYDQLTPRRSRKLKEVRLDRLHPEGLGLSVRGGLEFGCGLFISHLIKGGQADSVGLQVGDEIVRINGYSISSCTHEEVINLIRTKKTVSIKVRHIGLIPVKSSPDEPLTWQYVDQFVSESGGVRGSLGSPGNRENKEKKVFISLVGSRGLGCSISSGPIQKPGIFISHVKPGSLSAEVGLEIGDQIVEVNGVDFSNLDHKEGRELFMTDRERLAEARQRELQRQELLMQKRLAMESNKILQEQQEMERQRRKEIAQKAAEENERYRKEMEQIVEEEEKFKKQWEEDWGSKEQLLLPKTITAEVHPVPLRKPKYDQGVEPELEPADDLDGGTEEQGEQDFRKYEEGFDPYSMFTPEQIMGKDVRLLRIKKEGSLDLALEGGVDSPIGKVVVSAVYERGAAERHGGIVKGDEIMAINGKIVTDYTLAEAEAALQKAWNQGGDWIDLVVAVCPPKEYDDELTFF

SEQ ID NO: 96016 - protein, 317 aa, Homo sapiens
  Payload ID: 19166
  Gene Name: Usher syndrome 1C
  ENSP ID: ENSP00000437128
MCYLSEWPKSFLKAFIRHYSHHQVDFLIENDAEKDYLYDVLRMYHQTMDVAVLVGDLKLVINEPSRLPLFDAIRPLIPLKHQVEYDQLTPRRSRKLKEVRLDRLHPEGLGLSVRGGLEFGCGLFISHLIKGGQADSVGLQVGDEIVRINGYSISSCTHEEVINLIRTKKTVSIKVRHIGLIPVKSSPDEPLTWQYVDQFVSESGGVRGSLGSPGNRENKEKKVFISLVGSRGLGCSISSGPIQKPGIFISHVKPGSLSAEVGLEIGDQIVEVNGVDFSNLDHKEAVNVLKSSRSLTISIVAAAGRELFMTDRERLAE

SEQ ID NO: 96017 - protein, 703 aa, Homo sapiens
  Payload ID: 19167
  Gene Name: Usher syndrome 1C binding protein 1
  Uniprot ID: Q8N6Y0
  ENSP ID: ENSP00000252597
MSARATRPRSRRGRHAPPGELDPVAESSEEVEAASGSSKPSFAPPPVSSGLEQLGPMEEVSGQGLGSRTDKKMDGGSGRELASAPEVPHKPAVEAHQAPEAALQYKETVPPGNGAPDVFQTLQHTLSSLEAAAAAWRHQPPSHSGPMEFEGTSEGGAGSLGKQEGAGSCQREAARLAERNAWLRLALSSREDELVRTQASLEAIRAEKETLQKEVQELQDSLLRLEPCPHLSHNQAGGSGSGSSSSEADREPWETQDSFSLAHPLLRRLRSHSSTQILGSLPNQPLSPEMHIMEAQMEQLRGSIEKLKCFNRLLSAVLQGYKGRCEGLSMQLGQREAEATALHLALQYSEHCEEAYRVLLALREADSGAGDEAPMSDLQAAEKEAWRLLAQEEAAMDAGAQQNPQPSPEGSSVDKPTPQEVAFQLRSYVQRLQERRSLMKILSEPGPTLAPMPTVPRAEAMVQAILGTQAGPALPRLEKTQIQQDLVAAREALADLMLRLQLVRREKRGLELREAALRALGPAHVLLLEQLRWERAELQAGGANSSGGHSSGGGSSGDEEEWYQGLPAVPGGTSGIDGGQVGRAWDPEKLAQELAASLTRTLDLQEQLQSLRRELEQVAQKGRARRSQSAELNRDLCKAHSALVLAFRGAHRKQEEQRRKLEQQMALMEAQQAEEVAVLEATARALGKPRPPLPPPQLGDTFL

SEQ ID NO: 96018 - protein, 383 aa, Homo sapiens
  Payload ID: 19167
  Gene Name: Usher syndrome 1C binding protein 1
  ENSP ID: ENSP00000324174
MSARATRPRSRRGRHAPPGELDPVAESSEEVEAASGSSKPSFAPPPVSSGLEQLGPMEEVSGQGLGSRTDKKMDGGSGRELASAPEVPHKPAVEAHQAPEAALQYKETVPPGNGAPDVFQTLQHTLSSLEAAAAAWRHQPPSHSGPMEFEGTSEGGAGSLGKQEGAGSCQREAARLAERNAWLRLALSSREDELVRTQASLEAIRAEKETLQKEVQELQDSLLRLEPCPHLSHNQAGGSGSGSSSSEADREPWETQDSFSLAHPLLRRLRSHSSTQILGSLPNQPLSPEMHIMEAQMEQLRGSIEKLKCFNRLLSAVLQGYKGRCEGLSMQLGQREAEATALHLALQYRVLLCHPGWSAVVPSWLTATSASPVQVILLPQPPE

SEQ ID NO: 96019 - protein, 639 aa, Homo sapiens
  Payload ID: 19167
  Gene Name: Usher syndrome 1C binding protein 1
  ENSP ID: ENSP00000407902
MLHPTDKKMDGGSGRELASAPEVPHKPAVEAHQAPEAALQYKETVPPGNGAPDVFQTLQHTLSSLEAAAAAWRHQPPSHSGPMEFEGTSEGGAGSLGKQEGAGSCQREAARLAERNAWLRLALSSREDELVRTQASLEAIRAEKETLQKEVQELQDSLLRLEPCPHLSHNQAGGSGSGSSSSEADREPWETQDSFSLAHPLLRRLRSHSSTQILGSLPNQPLSPEMHIMEAQMEQLRGSIEKLKCFNRLLSAVLQGYKGRCEGLSMQLGQREAEATALHLALQYSEHCEEAYRVLLALREADSGAGDEAPMSDLQAAEKEAWRLLAQEEAAMDAGAQQNPQPSPEGSSVDKPTPQEVAFQLRSYVQRLQERRSLMKILSEPGPTLAPMPTVPRAEAMVQAILGTQAGPALPRLEKTQIQQDLVAAREALADLMLRLQLVRREKRGLELREAALRALGPAHVLLLEQLRWERAELQAGGANSSGGHSSGGGSSGDEEEWYQGLPAVPGGTSGIDGGQVGRAWDPEKLAQELAASLTRTLDLQEQLQSLRRELEQVAQKGRARRSQSAELNRDLCKAHSALVLAFRGAHRKQEEQRRKLEQQMALMEAQQAEEVAVLEATARALGKPRPPLPPPQLGDTFL

SEQ ID NO: 96020 - protein, 68 aa, Homo sapiens
  Payload ID: 19167
  Gene Name: Usher syndrome 1C binding protein 1
  Uniprot ID: Q8N6Y0
  ENSP ID: ENSP00000469562
MSARATRPRSRRGRHAPPGELDPVAESSEEVEAASGSSKPSFAPPPVSSGLEQLGPMEEVSGQGLGSR

SEQ ID NO: 96021 - protein, 32 aa, Homo sapiens
  Payload ID: 19167
  Gene Name: Usher syndrome 1C binding protein 1
  ENSP ID: ENSP00000471680
MSARATRPRSRRGRHAPPGELDPVAESSEEVE

SEQ ID NO: 96022 - protein, 121 aa, Homo sapiens
  Payload ID: 19167
  Gene Name: Usher syndrome 1C binding protein 1
  ENSP ID: ENSP00000473108
MSARATRPRSRRGRHAPPGELDPVAESSEEVEAASGSSKPSFAPPPVSSGLEQLGPMEEVSGQGLGSRTDKKMDGGSGRELASAPEVPHKPAVEAHQAPEAALQYKETVPPGNGAPDVFQT

SEQ ID NO: 96023 - protein, 115 aa, Homo sapiens
  Payload ID: 19168
  Gene Name: Usher syndrome 1G (autosomal recessive)
  ENSP ID: ENSP00000462568
MNDQYHRAARDGYLELLKEATRKELNAPDEDGMTPTLWAAYHGNLESLRLIVSRGFQWPLALPVLPGVLRSQHLVPRQRLPHAAGHGCHEGPHGMRALPGLHRGQAEQPQPQAGG

SEQ ID NO: 96024 - protein, 461 aa, Homo sapiens
  Payload ID: 19168
  Gene Name: Usher syndrome 1G (autosomal recessive)
  Uniprot ID: Q495M9
  ENSP ID: ENSP00000480279
MNDQYHRAARDGYLELLKEATRKELNAPDEDGMTPTLWAAYHGNLESLRLIVSRGGDPDKCDIWGNTPLHLAASNGHLHCLSFLVSFGANIWCLDNDYHTPLDMAAMKGHMECVRYLDSIAAKQSSLNPKLVGKLKDKAFREAERRIRECAKLQRRHHERMERRYRRELAERSDTLSFSSLTSSTLSRRLQHLALGSHLPYSQATLHGTARGKTKMQKKLERRKQGGEGTFKVSEDGRKSARSLSGLQLGSDVMFVRQGTYANPKEWGRAPLRDMFLSDEDSVSRATLAAEPAHSEVSTDSGHDSLFTRPGLGTMVFRRNYLSSGLHGLGREDGGLDGVGAPRGRLQSSPSLDDDSLGSANSLQDRSCGEELPWDELDLGLDEDLEPETSPLETFLASLHMEDFAALLRQEKIDLEALMLCSDLDLRSISVPLGPRKKILGAVRRRRQAMERPPALEDTEL

SEQ ID NO: 96025 - protein, 5202 aa, Homo sapiens
  Payload ID: 19169
  Gene Name: Usher syndrome 2A (autosomal recessive, mild)
  Uniprot ID: O75445
  ENSP ID: ENSP00000305941
MNCPVLSLGSGFLFQVIEMLIFAYFASISLTESRGLFPRLENVGAFKKVSIVPTQAVCGLPDRSTFCHSSAAAESIQFCTQRFCIQDCPYRSSHPTYTALFSAGLSSCITPDKNDLHPNAHSNSASFIFGNHKSCFSSPPSPKLMASFTLAVWLKPEQQGVMCVIEKTVDGQIVFKLTISEKETMFYYRTVNGLQPPIKVMTLGRILVKKWIHLSVQVHQTKISFFINGVEKDHTPFNARTLSGSITDFASGTVQIGQSLNGLEQFVGRMQDFRLYQVALTNREILEVFSGDLLRLHAQSHCRCPGSHPRVHPLAQRYCIPNDAGDTADNRVSRLNPEAHPLSFVNDNDVGTSWVSNVFTNITQLNQGVTISVDLENGQYQVFYIIIQFFSPQPTEIRIQRKKENSLDWEDWQYFARNCGAFGMKNNGDLEKPDSVNCLQLSNFTPYSRGNVTFSILTPGPNYRPGYNNFYNTPSLQEFVKATQIRFHFHGQYYTTETAVNLRHRYYAVDEITISGRCQCHGHADNCDTTSQPYRCLCSQESFTEGLHCDRCLPLYNDKPFRQGDQVYAFNCKPCQCNSHSKSCHYNISVDPFPFEHFRGGGGVCDDCEHNTTGRNCELCKDYFFRQVGADPSAIDVCKPCDCDTVGTRNGSILCDQIGGQCNCKRHVSGRQCNQCQNGFYNLQELDPDGCSPCNCNTSGTVDGDITCHQNSGQCKCKANVIGLRCDHCNFGFKFLRSFNDVGCEPCQCNLHGSVNKFCNPHSGQCECKKEAKGLQCDTCRENFYGLDVTNCKACDCDTAGSLPGTVCNAKTGQCICKPNVEGRQCNKCLEGNFYLRQNNSFLCLPCNCDKTGTINGSLLCNKSTGQCPCKLGVTGLRCNQCEPHRYNLTIDNFQHCQMCECDSLGTLPGTICDPISGQCLCVPNRQGRRCNQCQPGFYISPGNATGCLPCSCHTTGAVNHICNSLTGQCVCQDASIAGQRCDQCKDHYFGFDPQTGRCQPCNCHLSGALNETCHLVTGQCFCKQFVTGSKCDACVPSASHLDVNNLLGCSKTPFQQPPPRGQVQSSSAINLSWSPPDSPNAHWLTYSLLRDGFEIYTTEDQYPYSIQYFLDTDLLPYTKYSYYIETTNVHGSTRSVAVTYKTKPGVPEGNLTLSYIIPIGSDSVTLTWTTLSNQSGPIEKYILSCAPLAGGQPCVSYEGHETSATIWNLVPFAKYDFSVQACTSGGCLHSLPITVTTAQAPPQRLSPPKMQKISSTELHVEWSPPAELNGIIIRYELYMRRLRSTKETTSEESRVFQSSGWLSPHSFVESANENALKPPQTMTTITGLEPYTKYEFRVLAVNMAGSVSSAWVSERTGESAPVFMIPPSVFPLSSYSLNISWEKPADNVTRGKVVGYDINMLSEQSPQQSIPMAFSQLLHTAKSQELSYTVEGLKPYRIYEFTITLCNSVGCVTSASGAGQTLAAAPAQLRPPLVKGINSTTIHLRWFPPEELNGPSPIYQLERRESSLPALMTTMMKGIRFIGNGYCKFPSSTHPVNTDFTGIKASFRTKVPEGLIVFAASPGNQEEYFALQLKKGRLYFLFDPQGSPVEVTTTNDHGKQYSDGKWHEIIAIRHQAFGQITLDGIYTGSSAILNGSTVIGDNTGVFLGGLPRSYTILRKDPEIIQKGFVGCLKDVHFMKNYNPSAIWEPLDWQSSEEQINVYNSWEGCPASLNEGAQFLGAGFLELHPYMFHGGMNFEISFKFRTDQLNGLLLFVYNKDGPDFLAMELKSGILTFRLNTSLAFTQVDLLLGLSYCNGKWNKVIIKKEGSFISASVNGLMKHASESGDQPLVVNSPVYVGGIPQELLNSYQHLCLEQGFGGCMKDVKFTRGAVVNLASVSSGAVRVNLDGCLSTDSAVNCRGNDSILVYQGKEQSVYEGGLQPFTEYLYRVIASHEGGSVYSDWSRGRTTGAAPQSVPTPSRVRSLNGYSIEVTWDEPVVRGVIEKYILKAYSEDSTRPPRMPSASAEFVNTSNLTGILTGLLPFKNYAVTLTACTLAGCTESSHALNISTPQEAPQEVQPPVAKSLPSSLLLSWNPPKKANGIITQYCLYMDGRLIYSGSEENYIVTDLAVFTPHQFLLSACTHVGCTNSSWVLLYTAQLPPEHVDSPVLTVLDSRTIHIQWKQPRKISGILERYVLYMSNHTHDFTIWSVIYNSTELFQDHMLQYVLPGNKYLIKLGACTGGGCTVSEASEALTDEDIPEGVPAPKAHSYSPDSFNVSWTEPEYPNGVITSYGLYLDGILIHNSSELSYRAYGFAPWSLHSFRVQACTAKGCALGPLVENRTLEAPPEGTVNVFVKTQGSRKAHVRWEAPFRPNGLLTHSVLFTGIFYVDPVGNNYTLLNVTKVMYSGEETNLWVLIDGLVPFTNYTVQVNISNSQGSLITDPITIAMPPGAPDGVLPPRLSSATPTSLQVVWSTPARNNAPGSPRYQLQMRSGDSTHGFLELFSNPSASLSYEVSDLQPYTEYMFRLVASNGFGSAHSSWIPFMTAEDKPGPVVPPILLDVKSRMMLVTWQHPRKSNGVITHYNIYLHGRLYLRTPGNVTNCTVMHLHPYTAYKFQVEACTSKGCSLSPESQTVWTLPGAPEGIPSPELFSDTPTSVIISWQPPTHPNGLVENFTIERRVKGKEEVTTLVTLPRSHSMRFIDKTSALSPWTKYEYRVLMSTLHGGTNSSAWVEVTTRPSRPAGVQPPVVTVLEPDAVQVTWKPPLIQNGDILSYEIHMPDPHITLTNVTSAVLSQKVTHLIPFTNYSVTIVACSGGNGYLGGCTESLPTYVTTHPTVPQNVGPLSVIPLSESYVVISWQPPSKPNGPNLRYELLRRKIQQPLASNPPEDLNRWHNIYSGTQWLYEDKGLSRFTTYEYMLFVHNSVGFTPSREVTVTTLAGLPERGANLTASVLNHTAIDVRWAKPTVQDLQGEVEYYTLFWSSATSNDSLKILPDVNSHVIGHLKPNTEYWIFISVFNGVHSINSAGLHATTCDGEPQGMLPPEVVIINSTAVRVIWTSPSNPNGVVTEYSIYVNNKLYKTGMNVPGSFILRDLSPFTIYDIQVEVCTIYACVKSNGTQITTVEDTPSDIPTPTIRGITSRSLQIDWVSPRKPNGIILGYDLLWKTWYPCAKTQKLVQDQSDELCKAVRCQKPESICGHICYSSEAKVCCNGVLYNPKPGHRCCEEKYIPFVLNSTGVCCGGRIQEAQPNHQCCSGYYARILPGEVCCPDEQHNRVSVGIGDSCCGRMPYSTSGNQICCAGRLHDGHGQKCCGRQIVSNDLECCGGEEGVVYNRLPGMFCCGQDYVNMSDTICCSASSGESKAHIKKNDPVPVKCCETELIPKSQKCCNGVGYNPLKYVCSDKISTGMMMKETKECRILCPASMEATEHCGRCDFNFTSHICTVIRGSHNSTGKASIEEMCSSAEETIHTGSVNTYSYTDVNLKPYMTYEYRISAWNSYGRGLSKAVRARTKEDVPQGVSPPTWTKIDNLEDTIVLNWRKPIQSNGPIIYYILLRNGIERFRGTSLSFSDKEGIQPFQEYSYQLKACTVAGCATSSKVVAATTQGVPESILPPSITALSAVALHLSWSVPEKSNGVIKEYQIRQVGKGLIHTDTTDRRQHTVTGLQPYTNYSFTLTACTSAGCTSSEPFLGQTLQAAPEGVWVTPRHIIINSTTVELYWSLPEKPNGLVSQYQLSRNGNLLFLGGSEEQNFTDKNLEPNSRYTYKLEVKTGGGSSASDDYIVQTPMSTPEEIYPPYNITVIGPYSIFVAWIPPGILIPEIPVEYNVLLNDGSVTPLAFSVGHHQSTLLENLTPFTQYEIRIQACQNGSCGVSSRMFVKTPEAAPMDLNSPVLKALGSACIEIKWMPPEKPNGIIINYFIYRRPAGIEEESVLFVWSEGALEFMDEGDTLRPFTLYEYRVRACNSKGSVESLWSLTQTLEAPPQDFPAPWAQATSAHSVLLNWTKPESPNGIISHYRVVYQERPDDPTFNSPTVHAFTVKGTSHQAHLYGLEPFTTYRIGVVAANHAGEILSPWTLIQTLESSPSGLRNFIVEQKENGRALLLQWSEPMRTNGVIKTYNIFSDGFLEYSGLNRQFLFRRLDPFTLYTLTLEACTRAGCAHSAPQPLWTDEAPPDSQLAPTVHSVKSTSVELSWSEPVNPNGKIIRYEVIRRCFEGKAWGNQTIQADEKIVFTEYNTERNTFMYNDTGLQPWTQCEYKIYTWNSAGHTCSSWNVVRTLQAPPEGLSPPVISYVSMNPQKLLISWIPPEQSNGIIQSYRLQRNEMLYPFSFDPVTFNYTDEELLPFSTYSYALQACTSGGCSTSKPTSITTLEAAPSEVSPPDLWAVSATQMNVCWSPPTVQNGKITKYLVRYDNKESLAGQGLCLLVSHLQPYSQYNFSLVACTNGGCTASVSKSAWTMEALPENMDSPTLQVTGSESIEITWKPPRNPNGQIRSYELRRDGTIVYTGLETRYRDFTLTPGVEYSYTVTASNSQGGILSPLVKDRTSPSAPSGMEPPKLQARGPQEILVNWDPPVRTNGDIINYTLFIRELFERETKIIHINTTHNSFGMQSYIVNQLKPFHRYEIRIQACTTLGCASSDWTFIQTPEIAPLMQPPPHLEVQMAPGGFQPTVSLLWTGPLQPNGKVLYYELYRRQIATQPRKSNPVLIYNGSSTSFIDSELLPFTEYEYQVWAVNSAGKAPSSWTWCRTGPAPPEGLRAPTFHVISSTQAVVNISAPGKPNGIVSLYRLFSSSAHGAETVLSEGMATQQTLHGLQAFTNYSIGVEACTCFNCCSKGPTAELRTHPAPPSGLSSPQIGTLASRTASFRWSPPMFPNGVIHSYELQFHVACPPDSALPCTPSQIETKYTGLGQKASLGGLQPYTTYKLRVVAHNEVGSTASEWISFTTQKELPQYRAPFSVDSNLSVVCVNWSDTFLLNGQLKEYVLTDGGRRVYSGLDTTLYIPRTADKTFFFQVICTTDEGSVKTPLIQYDTSTGLGLVLTTPGKKKGSRSKSTEFYSELWFIVLMAMLGLILLAIFLSLILQRKIHKEPYIRERPPLVPLQKRMSPLNVYPPGENHMGLADTKIPRSGTPVSIRSNRSACVLRIPSQNQTSLTYSQGSLHRSVSQLMDIQDKKVLMDNSLWEAIMGHNSGLYVDEEDLMNAIKDFSSVTKERTTFTDTHL

SEQ ID NO: 96026 - protein, 1546 aa, Homo sapiens
  Payload ID: 19169
  Gene Name: Usher syndrome 2A (autosomal recessive, mild)
  Uniprot ID: O75445
  ENSP ID: ENSP00000355909
MNCPVLSLGSGFLFQVIEMLIFAYFASISLTESRGLFPRLENVGAFKKVSIVPTQAVCGLPDRSTFCHSSAAAESIQFCTQRFCIQDCPYRSSHPTYTALFSAGLSSCITPDKNDLHPNAHSNSASFIFGNHKSCFSSPPSPKLMASFTLAVWLKPEQQGVMCVIEKTVDGQIVFKLTISEKETMFYYRTVNGLQPPIKVMTLGRILVKKWIHLSVQVHQTKISFFINGVEKDHTPFNARTLSGSITDFASGTVQIGQSLNGLEQFVGRMQDFRLYQVALTNREILEVFSGDLLRLHAQSHCRCPGSHPRVHPLAQRYCIPNDAGDTADNRVSRLNPEAHPLSFVNDNDVGTSWVSNVFTNITQLNQGVTISVDLENGQYQVFYIIIQFFSPQPTEIRIQRKKENSLDWEDWQYFARNCGAFGMKNNGDLEKPDSVNCLQLSNFTPYSRGNVTFSILTPGPNYRPGYNNFYNTPSLQEFVKATQIRFHFHGQYYTTETAVNLRHRYYAVDEITISGRCQCHGHADNCDTTSQPYRCLCSQESFTEGLHCDRCLPLYNDKPFRQGDQVYAFNCKPCQCNSHSKSCHYNISVDPFPFEHFRGGGGVCDDCEHNTTGRNCELCKDYFFRQVGADPSAIDVCKPCDCDTVGTRNGSILCDQIGGQCNCKRHVSGRQCNQCQNGFYNLQELDPDGCSPCNCNTSGTVDGDITCHQNSGQCKCKANVIGLRCDHCNFGFKFLRSFNDVGCEPCQCNLHGSVNKFCNPHSGQCECKKEAKGLQCDTCRENFYGLDVTNCKACDCDTAGSLPGTVCNAKTGQCICKPNVEGRQCNKCLEGNFYLRQNNSFLCLPCNCDKTGTINGSLLCNKSTGQCPCKLGVTGLRCNQCEPHRYNLTIDNFQHCQMCECDSLGTLPGTICDPISGQCLCVPNRQGRRCNQCQPGFYISPGNATGCLPCSCHTTGAVNHICNSLTGQCVCQDASIAGQRCDQCKDHYFGFDPQTGRCQPCNCHLSGALNETCHLVTGQCFCKQFVTGSKCDACVPSASHLDVNNLLGCSKTPFQQPPPRGQVQSSSAINLSWSPPDSPNAHWLTYSLLRDGFEIYTTEDQYPYSIQYFLDTDLLPYTKYSYYIETTNVHGSTRSVAVTYKTKPGVPEGNLTLSYIIPIGSDSVTLTWTTLSNQSGPIEKYILSCAPLAGGQPCVSYEGHETSATIWNLVPFAKYDFSVQACTSGGCLHSLPITVTTAQAPPQRLSPPKMQKISSTELHVEWSPPAELNGIIIRYELYMRRLRSTKETTSEESRVFQSSGWLSPHSFVESANENALKPPQTMTTITGLEPYTKYEFRVLAVNMAGSVSSAWVSERTGESAPVFMIPPSVFPLSSYSLNISWEKPADNVTRGKVVGYDINMLSEQSPQQSIPMAFSQLLHTAKSQELSYTVEGLKPYRIYEFTITLCNSVGCVTSASGAGQTLAAAPAQLRPPLVKGINSTTIHLRWFPPEELNGPSPIYQLERRESSLPALMTTMMKGIRFIGNGYCKFPSSTHPVNTDFTGKCV

SEQ ID NO: 96027 - protein, 973 aa, Homo sapiens
  Payload ID: 19170
  Gene Name: USO1 vesicle transport factor
  Uniprot ID: O60763
  ENSP ID: ENSP00000264904
MNFLRGVMGGQSAGPQHTEAETIQKLCDRVASSTLLDDRRNAVRALKSLSKKYRLEVGIQAMEHLIHVLQTDRSDSEIIGYALDTLYNIISNEEEEEVDDVEEENSTRQSEDLGSQFTEIFIKQQENVTLLLSLLEEFDFHVRWPGVKLLTSLLKQLGPQVQQIILVSPMGVSRLMDLLADSREVIRNDGVLLLQALTRSNGAIQKIVAFENAFERLLDIISEEGNSDGGIVVEDCLILLQNLLKNNNSNQNFFKEGSYIQRMKPWFEVGDENSGWSAQKVTNLHLMLQLVRVLVSPTNPPGATSSCQKAMFQCGLLQQLCTILMATGVPADILTETINTVSEVIRGCQVNQDYFASVNAPSNPPRPAIVVLLMSMVNERQPFVLRCAVLYCFQCFLYKNQKGQGEIVSTLLPSTIDATGNSVSAGQLLCGGLFSTDSLSNWCAAVALAHALQENATQKEQLLRVQLATSIGNPPVSLLQQCTNILSQGDKIDRRGSKIQTRVGLLMLLCTWLSNCPIAVTHFLHNSANVPFLTGQIAENLGEEEQLVQGLCALLLGISIYFNDNSLESYMKEKLKQLIEKRIGKENFIEKLGFISKHELYSRASQKPQPNFPSPEYMIFDHEFTKLVKELEGVITKAIYKSSEEDKKEEEVKKTLEQHDNIVTHYKNMIREQDLQLEELRQQVSTLKCQNEQLQTAVTQQVSQIQQHKDQYNLLKIQLGKDNQHQGSYSEGAQMNGIQPEEIGRLREEIEELKRNQELLQSQLTEKDSMIENMKSSQTSGTNEQSSAIVSARDSEQVAELKQELATLKSQLNSQSVEITKLQTEKQELLQKTEAFAKSVEVQGETETIIATKTTDVEGRLSALLQETKELKNEIKALSEERTAIKEQLDSSNSTIAILQTEKDKLELEITDSKKEQDDLLVLLADQDQKILSLKNKLKDLGHPVEEEDELESGDQEDEDDESEDPGKDLDHI

SEQ ID NO: 96028 - protein, 962 aa, Homo sapiens
  Payload ID: 19170
  Gene Name: USO1 vesicle transport factor
  Uniprot ID: O60763
  ENSP ID: ENSP00000444850
MNFLRGVMGGQSAGPQHTEAETIQKLCDRVASSTLLDDRRNAVRALKSLSKKYRLEVGIQAMEHLIHVLQTDRSDSEIIGYALDTLYNIISNEEEEEVEENSTRQSEDLGSQFTEIFIKQQENVTLLLSLLEEFDFHVRWPGVKLLTSLLKQLGPQVQQIILVSPMGVSRLMDLLADSREVIRNDGVLLLQALTRSNGAIQKIVAFENAFERLLDIISEEGNSDGGIVVEDCLILLQNLLKNNNSNQNFFKEGSYIQRMKPWFEVGDENSGWSAQKVTNLHLMLQLVRVLVSPTNPPGATSSCQKAMFQCGLLQQLCTILMATGVPADILTETINTVSEVIRGCQVNQDYFASVNAPSNPPRPAIVVLLMSMVNERQPFVLRCAVLYCFQCFLYKNQKGQGEIVSTLLPSTIDATGNSVSAGQLLCGGLFSTDSLSNWCAAVALAHALQENATQKEQLLRVQLATSIGNPPVSLLQQCTNILSQGSKIQTRVGLLMLLCTWLSNCPIAVTHFLHNSANVPFLTGQIAENLGEEEQLVQGLCALLLGISIYFNDNSLESYMKEKLKQLIEKRIGKENFIEKLGFISKHELYSRASQKPQPNFPSPEYMIFDHEFTKLVKELEGVITKAIYKSSEEDKKEEEVKKTLEQHDNIVTHYKNMIREQDLQLEELRQQVSTLKCQNEQLQTAVTQQVSQIQQHKDQYNLLKIQLGKDNQHQGSYSEGAQMNGIQPEEIGRLREEIEELKRNQELLQSQLTEKDSMIENMKSSQTSGTNEQSSAIVSARDSEQVAELKQELATLKSQLNSQSVEITKLQTEKQELLQKTEAFAKSVEVQGETETIIATKTTDVEGRLSALLQETKELKNEIKALSEERTAIKEQLDSSNSTIAILQTEKDKLELEITDSKKEQDDLLVLLADQDQKILSLKNKLKDLGHPVEEEDELESGDQEDEDDESEDPGKDLDHI

SEQ ID NO: 96029 - protein, 845 aa, Homo sapiens
  Payload ID: 19171
  Gene Name: USP6 N-terminal like
  Uniprot ID: Q92738
  ENSP ID: ENSP00000277575
MRTEAVVNSQGQTDYLTKDSDQDVALKLAQERAEIVAKYDRGREGAEIEPWEDADYLVYKVTDRFGFLHEEELPDHNVAVERQKHLEIERTTKWLKMLKGWEKYKNTEKFHRRIYKGIPLQLRGEVWALLLEIPKMKEETRDLYSKLKHRARGCSPDIRQIDLDVNRTFRDHIMFRDRYGVKQQSLFHVLAAYSIYNTEVGYCQGMSQITALLLMYMNEEDAFWALVKLFSGPKHAMHGFFVQGFPKLLRFQEHHEKILNKFLSKLKQHLDSQEIYTSFYTMKWFFQCFLDRTPFTLNLRIWDIYIFEGERVLTAMSYTILKLHKKHLMKLSMEELVEFFQETLAKDFFFEDDFVIEQLQISMTELKRAKLDLPEPGKEDEYPKKPLGQLPPELQSWGVHHLSNGQRSVGRPSPLASGRRESGAPHRRHEHSPHPQSRTGTPERAQPPRRKSVEEESKKLKDEADFQRKLPSGPQDSSRQYNHAAANQNSNATSNIRKEFVPKWNKPSDVSATERTAKYTMEGKGRAAHPALAVTVPGPAEVRVSNVRPKMKALDAEDGKRGSTASQYDNVPGPELDSGASVEEALERAYSQSPRHALYPPSPRKHAEPSSSPSKVSNKFTFKVQPPSHARYPSQLDGEARGLAHPPSYSNPPVYHGNSPKHFPTANSSFASPQFSPGTQLNPSRRPHGSTLSVSASPEKSYSRPSPLVLPSSRIEVLPVDTGAGGYSGNSGSPKNGKLIIPPVDYLPDNRTWSEVSYTYRPETQGQSWTRDASRGNLPKYSAFQLAPFQDHGLPAVSVDSPVRYKASPAAEDASPSGYPYSGPPPPAYHYRNRDGLSIQESVLL

SEQ ID NO: 96030 - protein, 851 aa, Homo sapiens
  Payload ID: 19171
  Gene Name: USP6 N-terminal like
  ENSP ID: ENSP00000368539
MIQVLQIVKELVTPSRQKAATVKEDSDQDVALKLAQERAEIVAKYDRGREGAEIEPWEDADYLVYKVTDRFGFLHEEELPDHNVAVERQKHLEIERTTKWLKMLKGWEKYKNTEKFHRRIYKGIPLQLRGEVWALLLEIPKMKEETRDLYSKLKHRARGCSPDIRQIDLDVNRTFRDHIMFRDRYGVKQQSLFHVLAAYSIYNTEVGYCQGMSQITALLLMYMNEEDAFWALVKLFSGPKHAMHGFFVQGFPKLLRFQEHHEKILNKFLSKLKQHLDSQEIYTSFYTMKWFFQCFLDRTPFTLNLRIWDIYIFEGERVLTAMSYTILKLHKKHLMKLSMEELVEFFQETLAKDFFFEDDFVIEQLQISMTELKRAKLDLPEPGKEDEYPKKPLGQLPPELQSWGVHHLSNGQRSVGRPSPLASGRRESGAPHRRHEHSPHPQSRTGTPERAQPPRRKSVEEESKKLKDEADFQRKLPSGPQDSSRQYNHAAANQNSNATSNIRKEFVPKWNKPSDVSATERTAKYTMEGKGRAAHPALAVTVPGPAEVRVSNVRPKMKALDAEDGKRGSTASQYDNVPGPELDSGASVEEALERAYSQSPRHALYPPSPRKHAEPSSSPSKVSNKFTFKVQPPSHARYPSQLDGEARGLAHPPSYSNPPVYHGNSPKHFPTANSSFASPQFSPGTQLNPSRRPHGSTLSVSASPEKSYSRPSPLVLPSSRIEVLPVDTGAGGYSGNSGSPKNGKLIIPPVDYLPDNRTWSEVSYTYRPETQGQSWTRDASRGNLPKYSAFQLAPFQDHGLPAVSVDSPVRYKASPAAEDASPSGYPYSGPPPPAYHYRNRDGLSIQESVLL

SEQ ID NO: 96031 - protein, 828 aa, Homo sapiens
  Payload ID: 19171
  Gene Name: USP6 N-terminal like
  Uniprot ID: Q92738
  ENSP ID: ENSP00000476462
MNSDQDVALKLAQERAEIVAKYDRGREGAEIEPWEDADYLVYKVTDRFGFLHEEELPDHNVAVERQKHLEIERTTKWLKMLKGWEKYKNTEKFHRRIYKGIPLQLRGEVWALLLEIPKMKEETRDLYSKLKHRARGCSPDIRQIDLDVNRTFRDHIMFRDRYGVKQQSLFHVLAAYSIYNTEVGYCQGMSQITALLLMYMNEEDAFWALVKLFSGPKHAMHGFFVQGFPKLLRFQEHHEKILNKFLSKLKQHLDSQEIYTSFYTMKWFFQCFLDRTPFTLNLRIWDIYIFEGERVLTAMSYTILKLHKKHLMKLSMEELVEFFQETLAKDFFFEDDFVIEQLQISMTELKRAKLDLPEPGKEDEYPKKPLGQLPPELQSWGVHHLSNGQRSVGRPSPLASGRRESGAPHRRHEHSPHPQSRTGTPERAQPPRRKSVEEESKKLKDEADFQRKLPSGPQDSSRQYNHAAANQNSNATSNIRKEFVPKWNKPSDVSATERTAKYTMEGKGRAAHPALAVTVPGPAEVRVSNVRPKMKALDAEDGKRGSTASQYDNVPGPELDSGASVEEALERAYSQSPRHALYPPSPRKHAEPSSSPSKVSNKFTFKVQPPSHARYPSQLDGEARGLAHPPSYSNPPVYHGNSPKHFPTANSSFASPQFSPGTQLNPSRRPHGSTLSVSASPEKSYSRPSPLVLPSSRIEVLPVDTGAGGYSGNSGSPKNGKLIIPPVDYLPDNRTWSEVSYTYRPETQGQSWTRDASRGNLPKYSAFQLAPFQDHGLPAVSVDSPVRYKASPAAEDASPSGYPYSGPPPPAYHYRNRDGLSIQESVLL

SEQ ID NO: 96032 - protein, 48 aa, Homo sapiens
  Payload ID: 19171
  Gene Name: USP6 N-terminal like
  ENSP ID: ENSP00000476748
MIQVLQIVKELVTPSRQKAATVKEDGVLPCHPGWSAVAQSRLTASSAS

SEQ ID NO: 96033 - protein, 253 aa, Homo sapiens
  Payload ID: 19172
  Gene Name: UTP11-like, U3 small nucleolar ribonucleoprotein (yeast)
  Uniprot ID: Q9Y3A2
  ENSP ID: ENSP00000362105
MAAAFRKAAKSRQREHRERSQPGFRKHLGLLEKKKDYKLRADDYRKKQEYLKALRKKALEKNPDEFYYKMTRVKLQDGVHIIKETKEEVTPEQLKLMRTQDVKYIEMKRVAEAKKIERLKSELHLLDFQGKQQNKHVFFFDTKKEVEQFDVATHLQTAPELVDRVFNRPRIETLQKEKVKGVTNQTGLKRIAKERQKQYNCLTQRIEREKKLFVIAQKIQTRKDLMDKTQKVKVKKETVNSPAIYKFQSRRKR

SEQ ID NO: 96034 - protein, 766 aa, Homo sapiens
  Payload ID: 19173
  Gene Name: UTP14, U3 small nucleolar ribonucleoprotein, homolog C (yeast)
  Uniprot ID: Q5TAP6
  ENSP ID: ENSP00000428619
MNVNQVAENLALSHQEELVDLPKNYPLSENEDEGDSDGERKHQKLLEAIISLDGKNRRKLAERSEASLKVSEFSVSSEGSGEKLGLADLLEPVKTSSSLATVKKQLNRVKSKKVVELPLNKEKIEQIHREVAFSKTSQVLSKWDPIILKNQQAEQLVFPLGKEQPAIAPIEHALSGWKARTPLEQEIFNLLHKNKQPVTDPLLTPMEKASLQAMSLEEAKMHRAELQRARALQSYYEAKARKEKKIKSKKYHKVVKKGKAKKALKEFEQLQKVNPTVALEEMEKIENARMMERMSLKHQNSGKWAKSKAIMAKYDLEARQAMQEQLAKNKELTQKLQVASESEEEEGGTEVEELLVPHVANEVQMNVDGPNPWMFRSCTSDTKEAATQEDPEQVPELAAHEVSASEAEERPVAEEEILLREFEERQSLRKRSELNQDAEPASSQETKDSSSQEVLSELRALSQKLKEKHQSRKQKASSEGTVPQVQREEPAPEEAEPLLLQRSERVQTLEELEELGKEDCFQNKELPRPVLEGQQSERTPNNRPDAPKEKKEKEQLINLQNFLTTQSPSVRSLAVPTIIEELEDEEERDQRQMIKEAFAGDDVIRDFLKEKREAVEASKPKDVDLTLPGWGEWGGVGLKPSAKKRRQFLIKAPEGPPRKDKNLPNVIISEKRNIHAAAHQVQVLPYPFTHHRQFERTIQTPIGSTWNTQRAFQKLTTPKVVTKPGHIIKPIKAEDVGYQSSSRSDLPVIQRNPKRITTRHNKEEKL

SEQ ID NO: 96035 - protein, 771 aa, Homo sapiens
  Payload ID: 19174
  Gene Name: UTP14A small subunit (SSU) processome component
  Uniprot ID: Q9BVJ6
  ENSP ID: ENSP00000377944
MTANRLAESLLALSQQEELADLPKDYLLSESEDEGDNDGERKHQKLLEAISSLDGKNRRKLAERSEASLKVSEFNVSSEGSGEKLVLADLLEPVKTSSSLATVKKQLSRVKSKKTVELPLNKEEIERIHREVAFNKTAQVLSKWDPVVLKNRQAEQLVFPLEKEEPAIAPIEHVLSGWKARTPLEQEIFNLLHKNKQPVTDPLLTPVEKASLRAMSLEEAKMRRAELQRARALQSYYEAKARREKKIKSKKYHKVVKKGKAKKALKEFEQLRKVNPAAALEELEKIEKARMMERMSLKHQNSGKWAKSKAIMAKYDLEARQAMQEQLSKNKELTQKLQVASESEEEEGGTEDVEELLVPDVVNEVQMNADGPNPWMLRSCTSDTKEAATQEDPEQLPELEAHGVSESEGEERPVAEEEILLREFEERRSLRKRSELSQDAEPAGSQETKDSGSQEVLSELRVLSQKLKENHQSRKQKASSEGTIPQVQREEPAPEEEEPLLLQRPERVQTLEELEELGKEECFQNKELPRPVLEGQQSERTPNNRPDAPKEKKKKEQMIDLQNLLTTQSPSVKSLAVPTIEELEDEEERNHRQMIKEAFAGDDVIRDFLKEKREAVEASKPKDVDLTLPGWGEWGGVGLKPSAKKRRRFLIKAPEGPPRKDKNLPNVIINEKRNIHAAAHQVRVLPYPFTHHWQFERTIQTPIGSTWNTQRAFQKLTTPKVVTKPGHIINPIKAEDVGYRSSSRSDLSVIQRNPKRITTRHKKQLKKCSVD

SEQ ID NO: 96036 - protein, 719 aa, Homo sapiens
  Payload ID: 19174
  Gene Name: UTP14A small subunit (SSU) processome component
  Uniprot ID: Q9BVJ6
  ENSP ID: ENSP00000388669
MTANRLAESLLALSQQEELADLPKDYLLSESEDEGDNDGERKHQKLLEAISSLDGKNRRKLAERSEASLKVSEFNVSSEGSGEKLVLADLLEPVKTSSSLATVKKQLSRVKSKKTVELPLNKEEIERARTPLEQEIFNLLHKNKQPVTDPLLTPVEKASLRAMSLEEAKMRRAELQRARALQSYYEAKARREKKIKSKKYHKVVKKGKAKKALKEFEQLRKVNPAAALEELEKIEKARMMERMSLKHQNSGKWAKSKAIMAKYDLEARQAMQEQLSKNKELTQKLQVASESEEEEGGTEDVEELLVPDVVNEVQMNADGPNPWMLRSCTSDTKEAATQEDPEQLPELEAHGVSESEGEERPVAEEEILLREFEERRSLRKRSELSQDAEPAGSQETKDSGSQEVLSELRVLSQKLKENHQSRKQKASSEGTIPQVQREEPAPEEEEPLLLQRPERVQTLEELEELGKEECFQNKELPRPVLEGQQSERTPNNRPDAPKEKKKKEQMIDLQNLLTTQSPSVKSLAVPTIEELEDEEERNHRQMIKEAFAGDDVIRDFLKEKREAVEASKPKDVDLTLPGWGEWGGVGLKPSAKKRRRFLIKAPEGPPRKDKNLPNVIINEKRNIHAAAHQVRVLPYPFTHHWQFERTIQTPIGSTWNTQRAFQKLTTPKVVTKPGHIINPIKAEDVGYRSSSRSDLSVIQRNPKRITTRHKKQLKKCSVD

SEQ ID NO: 96037 - protein, 320 aa, Homo sapiens
  Payload ID: 19174
  Gene Name: UTP14A small subunit (SSU) processome component
  ENSP ID: ENSP00000413187
MKGDFRKKKSEARTPLEQEIFNLLHKNKQPVTDPLLTPVEKASLRAMSLEEAKMRRAELQRARALQSYYEAKARREKKIKSKKYHKVVKKGKAKKALKEFEQLRKVNPAAALEELEKIEKARMMERMSLKHQNSGKWAKSKAIMAKYDLEARQAMQEQLSKNKELTQKLQVASESEEEEGGTEDVEELLVPDVVNEVQMNADGPNPWMLRSCTSDTKEAATQEDPEQLPELEAHGVSESEGEERPVAEEEILLREFEERRSLRKRSELSQDAEPAGSQETKDSGSQEVLSELRVLSQKLKENHQSRKQKASSEGTIPQVQ

SEQ ID NO: 96038 - protein, 518 aa, Homo sapiens
  Payload ID: 19175
  Gene Name: UTP15, U3 small nucleolar ribonucleoprotein, homolog (S. cerevisiae)
  Uniprot ID: Q8TED0
  ENSP ID: ENSP00000296792
MAGYKPVAIQTYPILGEKITQDTLYWNNYKTPVQIKEFGAVSKVDFSPQPPYNYAVTASSRIHIYGRYSQEPIKTFSRFKDTAYCATFRQDGRLLVAGSEDGGVQLFDISGRAPLRQFEGHTKAVHTVDFTADKYHVVSGADDYTVKLWDIPNSKEILTFKEHSDYVRCGCASKLNPDLFITGSYDHTVKMFDARTSESVLSVEHGQPVESVLLFPSGGLLVSAGGRYVKVWDMLKGGQLLVSLKNHHKTVTCLCLSSSGQRLLSGSLDRKVKVYSTTSYKVVHSFDYAASILSLALAHEDETIVVGMTNGILSVKHRKSEAKKESLPRRRRPAYRTFIKGKNYMKQRDDILINRPAKKHLELYDRDLKHFRISKALDRVLDPTCTIKTPEITVSIIKELNRRGVLANALAGRDEKEISHVLNFLIRNLSQPRFAPVLINAAEIIIDIYLPVIGQSPVVDKKFLLLQGLVEKEIDYQRELLETLGMMDMLFATMRRKEGTSVLEHTSDGFPENKKIES

SEQ ID NO: 96039 - protein, 545 aa, Homo sapiens
  Payload ID: 19175
  Gene Name: UTP15, U3 small nucleolar ribonucleoprotein, homolog (S. cerevisiae)
  ENSP ID: ENSP00000421669
  MOD_RES (1)..(1): Any amino acid
XVIFARRSVRCVCRRLLEGPCDFYASAAELCRVGSWHSPINCPWVEVSRRTLWGSVETPVQIKEFGAVSKVDFSPQPPYNYAVTASSRIHIYGRYSQEPIKTFSRFKDTAYCATFRQDGRLLVAGSEDGGVQLFDISGRAPLRQFEGHTKAVHTVDFTADKYHVVSGADDYTVKLWDIPNSKEILTFKEHSDYVRCGCASKLNPDLFITGSYDHTVKMFDARTSESVLSVEHGQPVESVLLFPSGGLLVSAGGRYVKVWDMLKGGQLLVSLKNHHKTVTCLCLSSSGQRLLSGSLDRKVKVYSTTSYKVVHSFDYAASILSLALAHEDETIVVGMTNGILSVKHRKSEAKKESLPRRRRPAYRTFIKGKNYMKQRDDILINRPAKKHLELYDRDLKHFRISKALDRVLDPTCTIKTPEITVSIIKELNRRGVLANALAGRDEKEISHVLNFLIRNLSQPRFAPVLINAAEIIIDIYLPVIGQSPVVDKKFLLLQGLVEKEIDYQRELLETLGMMDMLFATMRRKEGTSVLEHTSDGFPENKKIES

SEQ ID NO: 96040 - protein, 7 aa, Homo sapiens
  Payload ID: 19175
  Gene Name: UTP15, U3 small nucleolar ribonucleoprotein, homolog (S. cerevisiae)
  ENSP ID: ENSP00000424334
MAGYKPV

SEQ ID NO: 96041 - protein, 499 aa, Homo sapiens
  Payload ID: 19175
  Gene Name: UTP15, U3 small nucleolar ribonucleoprotein, homolog (S. cerevisiae)
  Uniprot ID: Q8TED0
  ENSP ID: ENSP00000424609
MAGYKPVAIQTYPILGEKITQDTLYWNNYKPPYNYAVTASSRIHIYGRYSQEPIKTFSRFKDTAYCATFRQDGRLLVAGSEDGGVQLFDISGRAPLRQFEGHTKAVHTVDFTADKYHVVSGADDYTVKLWDIPNSKEILTFKEHSDYVRCGCASKLNPDLFITGSYDHTVKMFDARTSESVLSVEHGQPVESVLLFPSGGLLVSAGGRYVKVWDMLKGGQLLVSLKNHHKTVTCLCLSSSGQRLLSGSLDRKVKVYSTTSYKVVHSFDYAASILSLALAHEDETIVVGMTNGILSVKHRKSEAKKESLPRRRRPAYRTFIKGKNYMKQRDDILINRPAKKHLELYDRDLKHFRISKALDRVLDPTCTIKTPEITVSIIKELNRRGVLANALAGRDEKEISHVLNFLIRNLSQPRFAPVLINAAEIIIDIYLPVIGQSPVVDKKFLLLQGLVEKEIDYQRELLETLGMMDMLFATMRRKEGTSVLEHTSDGFPENKKIES

SEQ ID NO: 96042 - protein, 65 aa, Homo sapiens
  Payload ID: 19175
  Gene Name: UTP15, U3 small nucleolar ribonucleoprotein, homolog (S. cerevisiae)
  ENSP ID: ENSP00000424902
MAGYKPVAIQTYPILGEKITQDTLYWNNYKTPVQIKEFGAVSKVDFSPQPPYNYAVTASSRIHIY

SEQ ID NO: 96043 - protein, 328 aa, Homo sapiens
  Payload ID: 19175
  Gene Name: UTP15, U3 small nucleolar ribonucleoprotein, homolog (S. cerevisiae)
  Uniprot ID: Q8TED0
  ENSP ID: ENSP00000440796
MFDARTSESVLSVEHGQPVESVLLFPSGGLLVSAGGRYVKVWDMLKGGQLLVSLKNHHKTVTCLCLSSSGQRLLSGSLDRKVKVYSTTSYKVVHSFDYAASILSLALAHEDETIVVGMTNGILSVKHRKSEAKKESLPRRRRPAYRTFIKGKNYMKQRDDILINRPAKKHLELYDRDLKHFRISKALDRVLDPTCTIKTPEITVSIIKELNRRGVLANALAGRDEKEISHVLNFLIRNLSQPRFAPVLINAAEIIIDIYLPVIGQSPVVDKKFLLLQGLVEKEIDYQRELLETLGMMDMLFATMRRKEGTSVLEHTSDGFPENKKIES

SEQ ID NO: 96044 - protein, 556 aa, Homo sapiens
  Payload ID: 19176
  Gene Name: UTP18 small subunit (SSU) processome component
  Uniprot ID: Q9Y5J1
  ENSP ID: ENSP00000225298
MPPERRRRMKLDRRTGAKPKRKPGMRPDWKAGAGPGGPPQKPAPSSQRKPPARPSAAAAAIAVAAAEEERRLRQRNRLRLEEDKPAVERCLEELVFGDVENDEDALLRRLRGPRVQEHEDSGDSEVENEAKGNFPPQKKPVWVDEEDEDEEMVDMMNNRFRKDMMKNASESKLSKDNLKKRLKEEFQHAMGGVPAWAETTKRKTSSDDESEEDEDDLLQRTGNFISTSTSLPRGILKMKNCQHANAERPTVARISSVQFHPGAQIVMVAGLDNAVSLFQVDGKTNPKIQSIYLERFPIFKACFSANGEEVLATSTHSKVLYVYDMLAGKLIPVHQVRGLKEKIVRSFEVSPDGSFLLINGIAGYLHLLAMKTKELIGSMKINGRVAASTFSSDSKKVYASSGDGEVYVWDVNSRKCLNRFVDEGSLYGLSIATSRNGQYVACGSNCGVVNIYNQDSCLQETNPKPIKAIMNLVTGVTSLTFNPTTEILAIASEKMKEAVRLVHLPSCTVFSNFPVIKNKNISHVHTMDFSPRSGYFALGNEKGKALMYRLHHYSDF

SEQ ID NO: 96045 - protein, 43 aa, Homo sapiens
  Payload ID: 19176
  Gene Name: UTP18 small subunit (SSU) processome component
  ENSP ID: ENSP00000441335
  MOD_RES (1)..(1): Any amino acid
XKNCQHANAERPTVARISSVQFHPGAQIVMVAGLDNAVSLFQV

SEQ ID NO: 96046 - protein, 177 aa, Homo sapiens
  Payload ID: 19176
  Gene Name: UTP18 small subunit (SSU) processome component
  ENSP ID: ENSP00000462614
IYLERFPIFKACFSANGEEVLATSTHSKVLYVYDMLAGKLIPVHQVRGLKEKIVRSFEVSPDGSFLLINGIAGYLHLLAMKTKELIGSMKINGRVAASTFSSDSKKVYASSGDGEVYVWDVNSRKCLNRFVDEGSLYGLSIATSRNGQYVACGLKLGKLLVYISLPPFANWSLGGKF

SEQ ID NO: 96047 - protein, 115 aa, Homo sapiens
  Payload ID: 19176
  Gene Name: UTP18 small subunit (SSU) processome component
  ENSP ID: ENSP00000463499
DVNSRKCLNRFVDEGSLYGLSIATSRNGQYVACGSNCGVVNIYNQDSCLQETNPKPIKAIMNLVTGVTSLTFNPTTEILAIASEKMKEAVRLVAPLLRLLKRLFEVQLSHKRSLS

SEQ ID NO: 96048 - protein, 143 aa, Homo sapiens
  Payload ID: 19176
  Gene Name: UTP18 small subunit (SSU) processome component
  ENSP ID: ENSP00000464095
KIVRSFEVSPDGSFLLINGIAGYLHLLAMKTKELIGSMKINGRVAASTFSSDSKKVYASSGDGEVYVWDVNSRKCLNRFVDEGSLYGLSIATSRNGQYVACGCYFSDLQSYYRNLGNCFRKNERSSQIGSSSFLYSIFKLPSH

SEQ ID NO: 96049 - protein, 123 aa, Homo sapiens
  Payload ID: 19176
  Gene Name: UTP18 small subunit (SSU) processome component
  ENSP ID: ENSP00000464194
  MOD_RES (1)..(1): Any amino acid
XDSKKVYASSGDGEVYVWDVNSRKCLNRFVDEGSLYGLSIATSRNGQYVACGSNCGVVNIYNQDSCLQETNPKPIKAIMNLVTGVTSLTFNPTTEILAIASEKMKEAVRLACCLNRTEAILGF

SEQ ID NO: 96050 - protein, 2785 aa, Homo sapiens
  Payload ID: 19177
  Gene Name: UTP20 small subunit (SSU) processome component
  Uniprot ID: O75691
  ENSP ID: ENSP00000261637
MKTKPVSHKTENTYRFLTFAERLGNVNIDIIHRIDRTASYEEEVETYFFEGLLKWRELNLTEHFGKFYKEVIDKCQSFNQLVYHQNEIVQSLKTHLQVKNSFAYQPLLDLVVQLARDLQMDFYPHFPEFFLTITSILETQDTELLEWAFTSLSYLYKYLWRLMVKDMSSIYSMYSTLLAHKKLHIRNFAAESFTFLMRKVSDKNALFNLMFLDLDKHPEKVEGVGQLLFEMCKGVRNMFHSCTGQAVKLILRKLGPVTETETQLPWMLIGETLKNMVKSTVSYISKEHFGTFFECLQESLLDLHTKVTKTNCCESSEQIKRLLETYLILVKHGSGTKIPTPADVCKVLSQTLQVASLSTSCWETLLDVISALILGENVSLPETLIKETIEKIFESRFEKRLIFSFSEVMFAMKQFEQLFLPSFLSYIVNCFLIDDAVVKDEALAILAKLILNKAAPPTAGSMAIEKYPLVFSPQMVGFYIKQKKTRSKGRNEQFPVLDHLLSIIKLPPNKDTTYLSQSWAALVVLPHIRPLEKEKVIPLVTGFIEALFMTVDKGSFGKGNLFVLCQAVNTLLSLEESSELLHLVPVERVKNLVLTFPLEPSVLLLTDLYYQRLALCGCKGPLSQEALMELFPKLQANISTGVSKIRLLTIRILNHFDVQLPESMEDDGLSERQSVFAILRQAELVPATVNDYREKLLHLRKLRHDVVQTAVPDGPLQEVPLRYLLGMLYINFSALWDPVIELISSHAHEMENKQFWKVYYEHLEKAATHAEKELQNDMTDEKSVGDESWEQTQEGDVGALYHEQLALKTDCQERLDHTNFRFLLWRALTKFPERVEPRSRELSPLFLRFINNEYYPADLQVAPTQDLRRKGKGMVAEEIEEEPAAGDDEELEEEAVPQDESSQKKKTRRAAAKQLIAHLQVFSKFSNPRALYLESKLYELYLQLLLHQDQMVQKITLDCIMTYKHPHVLPYRENLQRLLEDRSFKEEIVHFSISEDNAVVKTAHRADLFPILMRILYGRMKNKTGSKTQGKSASGTRMAIVLRFLAGTQPEEIQIFLDLLFEPVRHFKNGECHSAVIQAVEDLDLSKVLPLGRQHGILNSLEIVLKNISHLISAYLPKILQILLCMTATVSHILDQREKIQLRFINPLKNLRRLGIKMVTDIFLDWESYQFRTEEIDAVFHGAVWPQISRLGSESQYSPTPLLKLISIWSRNARYFPLLAKQKPGHPECDILTNVFAILSAKNLSDATASIVMDIVDDLLNLPDFEPTETVLNLLVTGCVYPGIAENIGESITIGGRLILPHVPAILQYLSKTTISAEKVKKKKNRAQVSKELGILSKISKFMKDKEQSSVLITLLLPFLHRGNIAEDTEVDILVTVQNLLKHCVDPTSFLKPIAKLFSVIKNKLSRKLLCTVFETLSDFESGLKYITDVVKLNAFDQRHLDDINFDVRFETFQTITSYIKEMQIVDVNYLIPVMHNCFYNLELGDMSLSDNASMCLMSIIKKLAALNVTEKDYREIIHRSLLEKLRKGLKSQTESIQQDYTTILSCLIQTFPNQLEFKDLVQLTHYHDPEMDFFENMKHIQIHRRARALKKLAKQLMEGKVVLSSKSLQNYIMPYAMTPIFDEKMLKHENITTAATEIIGAICKHLSWSAYMYYLKHFIHVLQTGQINQKLGVSLLVIVLEAFHFDHKTLEEQMGKIENEENAIEAIELPEPEAMELERVDEEEKEYTCKSLSDNGQPGTPDPADSGGTSAKESECITKPVSFLPQNKEEIERTIKNIQGTITGDILPRLHKCLASTTKREEEHKLVKSKVVNDEEVVRVPLAFAMVKLMQSLPQEVMEANLPSILLKVCALLKNRAQEIRDIARSTLAKIIEDLGVHFLLYVLKELQTTLVRGYQVHVLTFTVHMLLQGLTNKLQVGDLDSCLDIMIEIFNHELFGAVAEEKEVKQILSKVMEARRSKSYDSYEILGKFVGKDQVTKLILPLKEILQNTTSLKLARKVHETLRRITVGLIVNQEMTAESILLLSYGLISENLPLLTEKEKNPVAPAPDPRLPPQSCLLLPPTPVRGGQKAVVSRKTNMHIFIESGLRLLHLSLKTSKIKSSGECVLEMLDPFVSLLIDCLGSMDVKVITGALQCLIWVLRFPLPSIETKAEQLTKHLFLLLKDYAKLGAARGQNFHLVVNCFKCVTILVKKVKSYQITEKQLQVLLAYAEEDIYDTSRQATAFGLLKAILSRKLLVPEIDEVMRKVSKLAVSAQSEPARVQCRQVFLKYILDYPLGDKLRPNLEFMLAQLNYEHETGRESTLEMIAYLFDTFPQGLLHENCGMFFIPLCLMTINDDSATCKKMASMTIKSLLGKISLEKKDWLFDMVTTWFGAKKRLNRQLAALICGLFVESEGVDFEKRLGTVLPVIEKEIDPENFKDIMEETEEKAADRLLFSFLTLITKLIKECNIIQFTKPAETLSKIWSHVHSHLRHPHNWVWLTAAQIFGLLFASCQPEELIQKWNTKKTKKHLPEPVAIKFLASDLDQKMKSISLASCHQLHSKFLDQSLGEQVVKNLLFAAKVLYLLELYCEDKQSKIKEDLEEQEALEDGVACADEKAESDGEEKEEVKEELGRPATLLWLIQKLSRIAKLEAAYSPRNPLKRTCIFKFLGAVAMDLGIDKVKPYLPMIIAPLFRELNSTYSEQDPLLKNLSQEIIELLKKLVGLESFSLAFASVQKQANEKRALRKKRKALEFVTNPDIAAKKKMKKHKNKSEAKKRKIEFLRPGYKAKRQKSHSLKDLAMVE

SEQ ID NO: 96051 - protein, 249 aa, Homo sapiens
  Payload ID: 19178
  Gene Name: UTP23, small subunit (SSU) processome component, homolog (yeast)
  Uniprot ID: Q9BRU9
  ENSP ID: ENSP00000308332
MKITRQKHAKKHLGFFRNNFGVREPYQILLDGTFCQAALRGRIQLREQLPRYLMGETQLCTTRCVLKELETLGKDLYGAKLIAQKCQVRNCPHFKNAVSGSECLLSMVEEGNPHHYFVATQDQNLSVKVKKKPGVPLMFIIQNTMVLDKPSPKTIAFVKAVESGQLVSVHEKESIKHLKEEQGLVKNTEQSRRKKRKKISGPNPLSCLKKKKKAPDTQSSASEKKRKRKRIRNRSNPKVLSEKQNAEGE

SEQ ID NO: 96052 - protein, 105 aa, Homo sapiens
  Payload ID: 19178
  Gene Name: UTP23, small subunit (SSU) processome component, homolog (yeast)
  ENSP ID: ENSP00000427767
MKITRQKHAKKHLGFFRNNFGVREPYQILLDGTFCQAALRGRIQLREQLPRYLMGETQLCTTREQWQKPLMKHFPLRQQRQYLKTMKHLLSPFVPSSFFLILIAP

SEQ ID NO: 96053 - protein, 80 aa, Homo sapiens
  Payload ID: 19178
  Gene Name: UTP23, small subunit (SSU) processome component, homolog (yeast)
  ENSP ID: ENSP00000428455
MKITRQKHAKKHLGFFRNNFGVREPYQILLDGTFCQAALRGRIQLREQLPRYLMGETQLCTTSISQECTHSAPIMEDNSM

SEQ ID NO: 96054 - protein, 64 aa, Homo sapiens
  Payload ID: 19178
  Gene Name: UTP23, small subunit (SSU) processome component, homolog (yeast)
  ENSP ID: ENSP00000429384
MVEEGNPHHYFVATQGTMAKAFDEAFSSETTAAIPEDHEASAESFCSIFFLPDLDRPLMHLHPE

SEQ ID NO: 96055 - protein, 155 aa, Homo sapiens
  Payload ID: 19178
  Gene Name: UTP23, small subunit (SSU) processome component, homolog (yeast)
  ENSP ID: ENSP00000429962
MKITRQKHAKKHLGFFRNNFGVREPYQILLDGTFCQAALRGRIQLREQLPRYLMGETQLCTTRCVLKELETLGKDLYGAKLIAQKCQVRNCPHFKNAVSGSECLLSMVEEGNPHHYFVATQWISASLLMLTVHHLMQSERCHLFSSAAKVSQVTH

SEQ ID NO: 96056 - protein, 69 aa, Homo sapiens
  Payload ID: 19178
  Gene Name: UTP23, small subunit (SSU) processome component, homolog (yeast)
  ENSP ID: ENSP00000430029
MKITRQKHAKKHLGFFRNNFGVREPYQILLDGTFCQAALRGRIQLREQLPRYLMGETQLCTTSGSLLAY

SEQ ID NO: 96057 - protein, 67 aa, Homo sapiens
  Payload ID: 19178
  Gene Name: UTP23, small subunit (SSU) processome component, homolog (yeast)
  ENSP ID: ENSP00000430309
MVEEGNPHHYFVATQWISASLLMLTVHHLMQSERCHLFSSAAKVSQVTHSISQECTHSAPIMEDNSM

SEQ ID NO: 96058 - protein, 479 aa, Homo sapiens
  Payload ID: 19179
  Gene Name: UTP3, small subunit (SSU) processome component, homolog (S. cerevisiae)
  Uniprot ID: Q9NQZ2
  ENSP ID: ENSP00000254803
MVGRSRRRGAAKWAAVRAKAGPTLTDENGDDLGLPPSPGDTSYYQDQVDDFHEARSRAALAKGWNEVQSGDEEDGEEEEEEVLALDMDDEDDEDGGNAGEEEEEENADDDGGSSVQSEAEASVDPSLSWGQRKKLYYDTDYGSKSRGRQSQQEAEEEEREEEEEAQIIQRRLAQALQEDDFGVAWVEAFAKPVPQVDEAETRVVKDLAKVSVKEKLKMLRKESPELLELIEDLKVKLTEVKDELEPLLELVEQGIIPPGKGSQYLRTKYNLYLNYCSNISFYLILKARRVPAHGHPVIERLVTYRNLINKLSVVDQKLSSEIRHLLTLKDDAVKKELIPKAKSTKPKPKSVSKTSAAACAVTDLSDDSDFDEKAKLKYYKEIEDRQKLKRKKEENSTEEQALEDQNAKRAITYQIAKNRGLTPRRKKIDRNPRVKHREKFRRAKIRRRGQVREVRKEEQRYSGELSGIRAGVKKSIKLK

SEQ ID NO: 96059 - protein, 597 aa, Homo sapiens
  Payload ID: 19180
  Gene Name: UTP6, small subunit (SSU) processome component, homolog (yeast)
  Uniprot ID: Q9NYH9
  ENSP ID: ENSP00000261708
MAEIIQERIEDRLPELEQLERIGLFSHAEIKAIIKKASDLEYKIQRRTLFKEDFINYVQYEINLLELIQRRRTRIGYSFKKDEIENSIVHRVQGVFQRASAKWKDDVQLWLSYVAFCKKWATKTRLSKVFSAMLAIHSNKPALWIMAAKWEMEDRLSSESARQLFLRALRFHPECPKLYKEYFRMELMHAEKLRKEKEEFEKASMDVENPDYSEEILKGELAWIIYKNSVSIIKGAEFHVSLLSIAQLFDFAKDLQKEIYDDLQALHTDDPLTWDYVARRELEIESQTEEQPTTKQAKAVEVGRKEERCCAVYEEAVKTLPTEAMWKCYITFCLERFTKKSNSGFLRGKRLERTMTVFRKAHELKLLSECQYKQLSVSLLCYNFLREALEVAVAGTELFRDSGTMWQLKLQVLIESKSPDIAMLFEEAFVHLKPQVCLPLWISWAEWSEGAKSQEDTEAVFKKALLAVIGADSVTLKNKYLDWAYRSGGYKKARAVFKSLQESRPFSVDFFRKMIQFEKEQESCNMANIREYYERALREFGSADSDLWMDYMKEELNHPLGRPENCGQIYWRAMKMLQGESAEAFVAKHAMHQTGHL

SEQ ID NO: 96060 - protein, 61 aa, Homo sapiens
  Payload ID: 19180
  Gene Name: UTP6, small subunit (SSU) processome component, homolog (yeast)
  ENSP ID: ENSP00000462135
  MOD_RES (1)..(1): Any amino acid
XRAVFKSLQESRPFSVDFFRKMIQFEKEQTESLSVAQAGLLAHCNLCFPGILQYGEHKRIL

SEQ ID NO: 96061 - protein, 29 aa, Homo sapiens
  Payload ID: 19180
  Gene Name: UTP6, small subunit (SSU) processome component, homolog (yeast)
  ENSP ID: ENSP00000464599
  MOD_RES (1)..(1): Any amino acid
XLQESRPFSVDFFRKMIQFEKEQIFGWII

SEQ ID NO: 96062 - protein, 251 aa, Homo sapiens
  Payload ID: 19181
  Gene Name: utrophin
  ENSP ID: ENSP00000356494
  MOD_RES (1)..(1): Any amino acid
XIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPSQSPQLFHDDTHSRIEQYATRLAQMERTNGSFLTDSSSTTG

SEQ ID NO: 96063 - protein, 66 aa, Homo sapiens
  Payload ID: 19181
  Gene Name: utrophin
  ENSP ID: ENSP00000356495
MIGLNFNLRELLTKFEKDIQAEIDAHNDIFKSIDGNRQKMVKALGNSEEATMLQHRLDDMNQRWND

SEQ ID NO: 96064 - protein, 988 aa, Homo sapiens
  Payload ID: 19181
  Gene Name: utrophin
  ENSP ID: ENSP00000356496
MQILRCLQKCGKLKMMAVVRTSLQKVVVLLHRLQRMAVSSPRYQKLCKDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 96065 - protein, 3433 aa, Homo sapiens
  Payload ID: 19181
  Gene Name: utrophin
  Uniprot ID: P46939
  ENSP ID: ENSP00000356515
MAKYGEHEASPDNGQNEFSDIIKSRSDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVQLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDQLSEIGQDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTLAQNLKNKASSSDMRTAITEKLERVKNQWDGTQHGVELRQQQLEDMIIDSLQWDDHREETEELMRKYEARLYILQQARRDPLTKQISDNQILLQELGPGDGIVMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 96066 - protein, 186 aa, Homo sapiens
  Payload ID: 19181
  Gene Name: utrophin
  ENSP ID: ENSP00000387927
MLEEEEWYRSLKHFNYDVCQSCFFSGRTAKGHKLHYPMVEYCIPTTSGEDVRDFTKVLKNKFRSKKYFAKHPRLGYLPVQTVLEGDNLETPSQSPQLFHDDTHSRIEQYATRLAQMERTNGSFLTDSSSTTGSVEDEHALIQQYCQTLGGESPVSQPQSPAQILKSVEREERGELERIIADLEEEQ

SEQ ID NO: 96067 - protein, 47 aa, Homo sapiens
  Payload ID: 19181
  Gene Name: utrophin
  ENSP ID: ENSP00000390879
MAKYGEHEASPDNGQNEFSDIIKSRSDEHNDVQKKTFTKWINARFSK

SEQ ID NO: 96068 - protein, 154 aa, Homo sapiens
  Payload ID: 19181
  Gene Name: utrophin
  ENSP ID: ENSP00000396276
MSGLAATTFHWKKCRLDLPGHVALQACKRLPDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQ

SEQ ID NO: 96069 - protein, 180 aa, Homo sapiens
  Payload ID: 19181
  Gene Name: utrophin
  ENSP ID: ENSP00000398923
MHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGS

SEQ ID NO: 96070 - protein, 184 aa, Homo sapiens
  Payload ID: 19181
  Gene Name: utrophin
  ENSP ID: ENSP00000404205
MHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPSQSPQLFHDDTHSRIEQYATRLAQMERTNGSFLTDSSSTTGSVEDEHALIQQYCQTLGG

SEQ ID NO: 96071 - protein, 150 aa, Homo sapiens
  Payload ID: 19181
  Gene Name: utrophin
  ENSP ID: ENSP00000487153
MEVRSESTNGDGRQSQADEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSW

SEQ ID NO: 96072 - protein, 699 aa, Homo sapiens
  Payload ID: 19182
  Gene Name: UV radiation resistance associated
  Uniprot ID: Q9P2Y5
  ENSP ID: ENSP00000348455
MSASASVGGPVPQPPPGPAAALPPGSAARALHVELPSQQRRLRHLRNIAARNIVNRNGHQLLDTYFTLHLCSTEKIYKEFYRSEVIKNSLNPTWRSLDFGIMPDRLDTSVSCFVVKIWGGKENIYQLLIEWKVCLDGLKYLGQQIHARNQNEIIFGLNDGYYGAPFEHKGYSNAQKTILLQVDQNCVRNSYDVFSLLRLHRAQCAIKQTQVTVQKIGKEIEEKLRLTSTSNELKKKSECLQLKILVLQNELERQKKALGREVALLHKQQIALQDKGSAFSAEHLKLQLQKESLNELRKECTAKRELFLKTNAQLTIRCRQLLSELSYIYPIDLNEHKDYFVCGVKLPNSEDFQAKDDGSIAVALGYTAHLVSMISFFLQVPLRYPIIHKGSRSTIKDNINDKLTEKEREFPLYPKGGEKLQFDYGVYLLNKNIAQLRYQHGLGTPDLRQTLPNLKNFMEHGLMVRCDRHHTSSAIPVPKRQSSIFGGADVGFSGGIPSPDKGHRKRASSENERLQYKTPPPSYNSALAQPVTTVPSMGETERKITSLSSSLDTSLDFSKENKKKGEDLVGSLNGGHANVHPSQEQGEALSGHRATVNGTLLPSEQAGSASVQLPGEFHPVSEAELCCTVEQAEEIIGLEATGFASGDQLEAFNCIPVDSAVAVECDEQVLGEFEEFSRRIYALNENVSSFRRPRRSSDK

SEQ ID NO: 96073 - protein, 327 aa, Homo sapiens
  Payload ID: 19182
  Gene Name: UV radiation resistance associated
  Uniprot ID: Q9P2Y5
  ENSP ID: ENSP00000431256
MISFFLQVPLRYPIIHKGSRSTIKDNINDKLTEKEREFPLYPKGGEKLQFDYGVYLLNKNIAQLRYQHGLGTPDLRQTLPNLKNFMEHGLMVRCDRHHTSSAIPVPKRQSSIFGGADVGFSGGIPSPDKGHRKRASSENERLQYKTPPPSYNSALAQPVTTVPSMGETERKITSLSSSLDTSLDFSKENKKKGEDLVGSLNGGHANVHPSQEQGEALSGHRATVNGTLLPSEQAGSASVQLPGEFHPVSEAELCCTVEQAEEIIGLEATGFASGDQLEAFNCIPVDSAVAVECDEQVLGEFEEFSRRIYALNENVSSFRRPRRSSDK

SEQ ID NO: 96074 - protein, 90 aa, Homo sapiens
  Payload ID: 19182
  Gene Name: UV radiation resistance associated
  ENSP ID: ENSP00000433414
NSIFSPSQLRYQHGLGTPDLRQTLPNLKNFMEHGLMVRWTSALQEHSKLRKGIVATAGRGTDSTTHSARGDSKNPRQAYLQTCVLQNRHH

SEQ ID NO: 96075 - protein, 132 aa, Homo sapiens
  Payload ID: 19182
  Gene Name: UV radiation resistance associated
  ENSP ID: ENSP00000433613
MPDRLDTSVSCFVVKIWGGKENIYQLLIEWKVCLDGLKYLGQQIHARNQNEIIFGLNDGYYGAPFEHKGYSNAQKTILLQVDQNCVRNSYDVFSLLRLHRAQCAIKQTQVTVQKIGKEIEEKLRLTSTSNEL

SEQ ID NO: 96076 - protein, 327 aa, Homo sapiens; identical to SEQ ID NO: 96073
  Payload ID: 19182
  Gene Name: UV radiation resistance associated
  Uniprot ID: Q9P2Y5
  ENSP ID: ENSP00000434082

SEQ ID NO: 96077 - protein, 598 aa, Homo sapiens
  Payload ID: 19182
  Gene Name: UV radiation resistance associated
  ENSP ID: ENSP00000436039
MPDRLDTSVSCFVVKIWGGKENIYQLLIEWKVCLDGLKYLGQQIHARNQNEIIFGLNDGYYGAPFEHKGYSNAQKTILLQVDQNCVRNSYDVFSLLRLHRAQCAIKQTQVTVQKIGKEIEEKLRLTSTSNELKKKSECLQLKILVLQNELERQKKALGREVALLHKQQIALQDKGSAFSAEHLKLQLQKESLNELRKECTAKRELFLKTNAQLTIRCRQLLSELSYIYPIDLNEHKDYFVCGVKLPNSEDFQAKDDGSIAVALGYTAHLVSMISFFLQVPLRYPIIHKGSRSTIKDNINDKLTEKEREFPLYPKGGEKLQFDYGVYLLNKNIAQLRYQHGLGTPDLRQTLPNLKNFMEHGLMVRCDRHHTSSAIPVPKRQSSIFGGADVGFSGGIPSPDKGHRKRASSENERLQYKTPPPSYNSALAQPVTTVPSMGETERKITSLSSSLDTSLDFSKENKKKGEDLVGSLNGGHANVHPSQEQGEALSGHRATVNGTLLPSEQAGSASVQLPGEFHPVSEAELCCTVEQAEEIIGLEATGFASGDQLEAFNCIPVDSAVAVECDEQVLGEFEEFSRRIYALNENVSSFRRPRRSSDK

SEQ ID NO: 96078 - protein, 327 aa, Homo sapiens; identical to SEQ ID NO: 96073
  Payload ID: 19182
  Gene Name: UV radiation resistance associated
  Uniprot ID: Q9P2Y5
  ENSP ID: ENSP00000436270

SEQ ID NO: 96079 - protein, 1416 aa, Homo sapiens
  Payload ID: 19183
  Gene Name: uveal autoantigen with coiled-coil domains and ankyrin repeats
  Uniprot ID: Q9BZF9
  ENSP ID: ENSP00000314556
MKSLKSRLRRQDVPGPASSGAAAASAHAADWNKYDDRLMKAAERGDVEKVTSILAKKGVNPGKLDVEGRSVFHVVTSKGNLECLNAILIHGVDITTSDTAGRNALHLAAKYGHALCLQKLLQYNCPTEHADLQGRTALHDAAMADCPSSIQLLCDHGASVNAKDVDGRTPLVLATQMSRPTICQLLIDRGADVNSRDKQNRTALMLGCEYGCRDAVEVLIKNGADISLLDALGHDSSYYARIGDNLDILTLLKTASENTNKGRELWKKGPSLQQRNLTHMQDEVNVKSHQREHQNIQDLEIENEDLKERLRKIQQEQRILLDKVNGLQLQLNEEVMVADDLESEREKLKSLLAAKEKQHEESLRTIEALKNRFKYFESDHLGSGSHFSNRKEDMLLKQGQMYMADSQCTSPGIPAHMQSRSMLRPLELSLPSQTSYSENEILKKELEAMRTFCESAKQDRLKLQNELAHKVAECKALALECERVKEDSDEQIKQLEDALKDVQKRMYESEGKVKQMQTHFLALKEHLTSEAASGNHRLTEELKDQLKDLKVKYEGASAEVGKLRNQIKQNEMIVEEFKRDEGKLIEENKRLQKELSMCEMEREKKGRKVTEMEGQAKELSAKLALSIPAEKFENMKSSLSNEVNEKAKKLVEMEREHEKSLSEIRQLKRELENVKAKLAQHVKPEEHEQVKSRLEQKSGELGKKITELTLKNQTLQKEIEKVYLDNKLLKEQAHNLTIEMKNHYVPLKVSEDMKKSHDAIIDDLNRKLLDVTQKYTEKKLEMEKLLLENDSLSKDVSRLETVFVPPEKHEKEIIALKSNIVELKKQLSELKKKCGEDQEKIHALTSENTNLKKMMSNQYVPVKTHEEVKMTLNDTLAKTNRELLDVKKKFEDINQEFVKIKDKNEILKRNLENTQNQIKAEYISLAEHEAKMSSLSQSMRKVQDSNAEILANYRKGQEEIVTLHAEIKAQKKELDTIQECIKVKYAPIVSFEECERKFKATEKELKDQLSEQTQKYSVSEEEVKKNKQENDKLKKEIFTLQKDLRDKTVLIEKSHEMERALSRKTDELNKQLKDLSQKYTEVKNVKEKLVEENAKQTSEILAVQNLLQKQHVPLEQVEALKKSLNGTIENLKEELKSMQRCYEKEQQTVTKLHQLLENQKNSSVPLAEHLQIKEAFEKEVGIIKASLREKEEESQNKMEEVSKLQSEVQNTKQALKKLETREVVDLSKYKATKSDLETQISSLNEKLANLNRKYEEVCEEVLHAKKKEISAKDEKELLHFSIEQEIKDQKERCDKSLTTITELQRRIQESAKQIEAKDNKITELLNDVERLKQALNGLSQLTYTSGNPTKRQSQLIDTLQHQVKSLEQQLADADRQHQEVIAIYRTHLLSAAQGHMDEDVQEALLQIIQMRQGLVC

SEQ ID NO: 96080 - protein, 1403 aa, Homo sapiens
  Payload ID: 19183
  Gene Name: uveal autoantigen with coiled-coil domains and ankyrin repeats
  Uniprot ID: Q9BZF9
  ENSP ID: ENSP00000369319
MMNCWFSCTPKNRHAADWNKYDDRLMKAAERGDVEKVTSILAKKGVNPGKLDVEGRSVFHVVTSKGNLECLNAILIHGVDITTSDTAGRNALHLAAKYGHALCLQKLLQYNCPTEHADLQGRTALHDAAMADCPSSIQLLCDHGASVNAKDVDGRTPLVLATQMSRPTICQLLIDRGADVNSRDKQNRTALMLGCEYGCRDAVEVLIKNGADISLLDALGHDSSYYARIGDNLDILTLLKTASENTNKGRELWKKGPSLQQRNLTHMQDEVNVKSHQREHQNIQDLEIENEDLKERLRKIQQEQRILLDKVNGLQLQLNEEVMVADDLESEREKLKSLLAAKEKQHEESLRTIEALKNRFKYFESDHLGSGSHFSNRKEDMLLKQGQMYMADSQCTSPGIPAHMQSRSMLRPLELSLPSQTSYSENEILKKELEAMRTFCESAKQDRLKLQNELAHKVAECKALALECERVKEDSDEQIKQLEDALKDVQKRMYESEGKVKQMQTHFLALKEHLTSEAASGNHRLTEELKDQLKDLKVKYEGASAEVGKLRNQIKQNEMIVEEFKRDEGKLIEENKRLQKELSMCEMEREKKGRKVTEMEGQAKELSAKLALSIPAEKFENMKSSLSNEVNEKAKKLVEMEREHEKSLSEIRQLKRELENVKAKLAQHVKPEEHEQVKSRLEQKSGELGKKITELTLKNQTLQKEIEKVYLDNKLLKEQAHNLTIEMKNHYVPLKVSEDMKKSHDAIIDDLNRKLLDVTQKYTEKKLEMEKLLLENDSLSKDVSRLETVFVPPEKHEKEIIALKSNIVELKKQLSELKKKCGEDQEKIHALTSENTNLKKMMSNQYVPVKTHEEVKMTLNDTLAKTNRELLDVKKKFEDINQEFVKIKDKNEILKRNLENTQNQIKAEYISLAEHEAKMSSLSQSMRKVQDSNAEILANYRKGQEEIVTLHAEIKAQKKELDTIQECIKVKYAPIVSFEECERKFKATEKELKDQLSEQTQKYSVSEEEVKKNKQENDKLKKEIFTLQKDLRDKTVLIEKSHEMERALSRKTDELNKQLKDLSQKYTEVKNVKEKLVEENAKQTSEILAVQNLLQKQHVPLEQVEALKKSLNGTIENLKEELKSMQRCYEKEQQTVTKLHQLLENQKNSSVPLAEHLQIKEAFEKEVGIIKASLREKEEESQNKMEEVSKLQSEVQNTKQALKKLETREVVDLSKYKATKSDLETQISSLNEKLANLNRKYEEVCEEVLHAKKKEISAKDEKELLHFSIEQEIKDQKERCDKSLTTITELQRRIQESAKQIEAKDNKITELLNDVERLKQALNGLSQLTYTSGNPTKRQSQLIDTLQHQVKSLEQQLADADRQHQEVIAIYRTHLLSAAQGHMDEDVQEALLQIIQMRQGLVC

SEQ ID NO: 96081 - protein, 1307 aa, Homo sapiens
  Payload ID: 19183
  Gene Name: uveal autoantigen with coiled-coil domains and ankyrin repeats
  ENSP ID: ENSP00000438667
MKSLKSRLRRQDVPGPASSGAAAASAHAADWNKYDDRLMKAAERGDVEKVTSILAKKGVNPGKLDVEGRSVFHVVTSKGNLECLNAILIHGVDITTSDTAGRNALHLAAKYGHALCLQKLLQYNCPTEHADLQGRTALHDAAMADCPSSIQLLCDHGASVNAKDVRNLTHMQDEVNVKSHQREHQNIQDLEIENEDLKERLRKIQQEQRILLDKVNGLQLQLNEEVMVADDLESEREKLKSLLAAKEKQHEESLRTIEALKNRFKYFESDHLGSGSHFSNRKEDMLLKQGQMYMADSQCTSPGIPAHMQSRSMLRPLELSLPSQTSYSENEILKKELEAMRTFCESAKQDRLKLQNELAHKVAECKALALECERVKEDSDEQIKQLEDALKDVQKRMYESEGKVKQMQTHFLALKEHLTSEAASGNHRLTEELKDQLKDLKVKYEGASAEVGKLRNQIKQNEMIVEEFKRDEGKLIEENKRLQKELSMCEMEREKKGRKVTEMEGQAKELSAKLALSIPAEKFENMKSSLSNEVNEKAKKLVEMEREHEKSLSEIRQLKRELENVKAKLAQHVKPEEHEQVKSRLEQKSGELGKKITELTLKNQTLQKEIEKVYLDNKLLKEQAHNLTIEMKNHYVPLKVSEDMKKSHDAIIDDLNRKLLDVTQKYTEKKLEMEKLLLENDSLSKDVSRLETVFVPPEKHEKEIIALKSNIVELKKQLSELKKKCGEDQEKIHALTSENTNLKKMMSNQYVPVKTHEEVKMTLNDTLAKTNRELLDVKKKFEDINQEFVKIKDKNEILKRNLENTQNQIKAEYISLAEHEAKMSSLSQSMRKVQDSNAEILANYRKGQEEIVTLHAEIKAQKKELDTIQECIKVKYAPIVSFEECERKFKATEKELKDQLSEQTQKYSVSEEEVKKNKQENDKLKKEIFTLQKDLRDKTVLIEKSHEMERALSRKTDELNKQLKDLSQKYTEVKNVKEKLVEENAKQTSEILAVQNLLQKQHVPLEQVEALKKSLNGTIENLKEELKSMQRCYEKEQQTVTKLHQLLENQKNSSVPLAEHLQIKEAFEKEVGIIKASLREKEEESQNKMEEVSKLQSEVQNTKQALKKLETREVVDLSKYKATKSDLETQISSLNEKLANLNRKYEEVCEEVLHAKKKEISAKDEKELLHFSIEQEIKDQKERCDKSLTTITELQRRIQESAKQIEAKDNKITELLNDVERLKQALNGLSQLTYTSGNPTKRQSQLIDTLQHQVKSLEQQLADADRQHQEVIAIYRTHLLSAAQGHMDEDVQEALLQIIQMRQGLVC

SEQ ID NO: 96082 - protein, 225 aa, Homo sapiens
  Payload ID: 19183
  Gene Name: uveal autoantigen with coiled-coil domains and ankyrin repeats
  ENSP ID: ENSP00000453616
MVKKQQQQPPQKNHPEFAPALHAADWNKYDDRLMKAAERGDVEKVTSILAKKGVNPGKLDVEGRSVFHVVTSKGNLECLNAILIHGVDITTSDTAGRNALHLAAKYGHALCLQKLLQYNCPTEHADLQGRTALHDAAMADCPSSIQLLCDHGASVNAKDVDGRTPLVLATQMSRPTICQLLIDRGADVNSRDKQNRTALMLGCEYGCRDAVEVLIKNGADISLLD

SEQ ID NO: 96083 - protein, 564 aa, Homo sapiens
  Payload ID: 19183
  Gene Name: uveal autoantigen with coiled-coil domains and ankyrin repeats
  ENSP ID: ENSP00000453865
MMNCWFSCTPKNRHAADWNKYDDRLMKAAERGDVEKVTSILAKKGVNPGKLDVEGRSVFHVVTSKGNLECLNAILIHGVDITTSDTAGRNALHLAAKYGHALCLQKLLQYNCPTEHADLQGRTALHDAAMADCPSSIQLLCDHGASVNAKDVDGRTPLVLATQMSRPTICQLLIDRGADVNSRDKQNRTALMLGCEYGCRDAVEVLIKNGADISLLDALGHDSSYYARIGDNLDILTLLKTASENTNKGRELWKKGPSLQQRNLTHMQDEVNVKSHQREHQNIQDLEIENEDLKERLRKIQQEQRILLDKVNGLQLQLNEREKLKSLLAAKEKQHEESLRTIEALKNRFKYFESDHLGSGSHFSNRKEDMLLKQGQMYMADSQCTSPGIPAHMQSRSMLRPLELSLPSQTSYSENEILKKELEAMRTFCESAKQDRLKLQNELAHKVAECKALALECERVKEDSDEQIKQLEDALKDVQKRMYESEGKVKQMQTHFLALKEHLTSEAASGNHRLTEELKDQLKDLKVKYEGASAEVGKLRNQIKQNEMIVEEFKRDEGKLIEEN

SEQ ID NO: 96084 - protein, 1401 aa, Homo sapiens
  Payload ID: 19183
  Gene Name: uveal autoantigen with coiled-coil domains and ankyrin repeats
  ENSP ID: ENSP00000454018
MMNCWFSCTPKNRHAADWNKYDDRLMKAAERGDVEKVTSILAKKGVNPGKLDVEGRSVFHVVTSKGNLECLNAILIHGVDITTSDTAGRNALHLAAKYGHALCLQKLLQYNCPTEHADLQGRTALHDAAMADCPSSIQLLCDHGASVNAKDVDGRTPLVLATQMSRPTICQLLIDRGADVNSRDKQNRTALMLGCEYGCRDAVEVLIKNGADISLLDALGHDSSYYARIGDNLDILTLLKTASENTNKGRELWKKGPSLQQRNLTHMQDEVNVKSHQREHQNIQDLEIENEDLKERLRKIQQEQRILLDKVNGLQLQLNEEVMVADDLESEREKLKSLLAAKEKQHEESLRTIEALKNRFKYFESDHLGSGSHFRKEDMLLKQGQMYMADSQCTSPGIPAHMQSRSMLRPLELSLPSQTSYSENEILKKELEAMRTFCESAKQDRLKLQNELAHKVAECKALALECERVKEDSDEQIKQLEDALKDVQKRMYESEGKVKQMQTHFLALKEHLTSEAASGNHRLTEELKDQLKDLKVKYEGASAEVGKLRNQIKQNEMIVEEFKRDEGKLIEENKRLQKELSMCEMEREKKGRKVTEMEGQAKELSAKLALSIPAEKFENMKSSLSNEVNEKAKKLVEMEREHEKSLSEIRQLKRELENVKAKLAQHVKPEEHEQVKSRLEQKSGELGKKITELTLKNQTLQKEIEKVYLDNKLLKEQAHNLTIEMKNHYVPLKVSEDMKKSHDAIIDDLNRKLLDVTQKYTEKKLEMEKLLLENDSLSKDVSRLETVFVPPEKHEKEIIALKSNIVELKKQLSELKKKCGEDQEKIHALTSENTNLKKMMSNQYVPVKTHEEVKMTLNDTLAKTNRELLDVKKKFEDINQEFVKIKDKNEILKRNLENTQNQIKAEYISLAEHEAKMSSLSQSMRKVQDSNAEILANYRKGQEEIVTLHAEIKAQKKELDTIQECIKVKYAPIVSFEECERKFKATEKELKDQLSEQTQKYSVSEEEVKKNKQENDKLKKEIFTLQKDLRDKTVLIEKSHEMERALSRKTDELNKQLKDLSQKYTEVKNVKEKLVEENAKQTSEILAVQNLLQKQHVPLEQVEALKKSLNGTIENLKEELKSMQRCYEKEQQTVTKLHQLLENQKNSSVPLAEHLQIKEAFEKEVGIIKASLREKEEESQNKMEEVSKLQSEVQNTKQALKKLETREVVDLSKYKATKSDLETQISSLNEKLANLNRKYEEVCEEVLHAKKKEISAKDEKELLHFSIEQEIKDQKERCDKSLTTITELQRRIQESAKQIEAKDNKITELLNDVERLKQALNGLSQLTYTSGNPTKRQSQLIDTLQHQVKSLEQQLADADRQHQEVIAIYRTHLLSAAQGHMDEDVQEALLQIIQMRQGLVC

SEQ ID NO: 96085 - protein, 709 aa, Homo sapiens
  Payload ID: 19184
  Gene Name: UV-stimulated scaffold protein A
  Uniprot ID: Q2YD98
  ENSP ID: ENSP00000374501
MDQKLSKLVEELTTSGEPRLNPEKMKELKKICKSSEEQLSRAYRLLIAQLTQEHAEIRLSAFQIVEELFVRSHQFRMLVVSNFQEFLELTLGTDPAQPLPPPREAAQRLRQATTRAVEGWNEKFGEAYKKLALGYHFLRHNKKVDFQDTNARSLAERKREEEKQKHLDKIYQERASQAEREMQEMSGEIESCLTEVESCFRLLVPFDFDPNPETESLGMASGMSDALRSSCAGQVGPCRSGTPDPRDGEQPCCSRDLPASAGHPRAGGGAQPSQTATGDPSDEDEDSDLEEFVRSHGLGSHKYTLDVELCSEGLKVQENEDNLALIHAARDTLKLIRNKFLPAVCSWIQRFTRVGTHGGCLKRAIDLKAELELVLRKYKELDIEPEGGERRRTEALGDAEEDEDDEDFVEVPEKEGYEPHIPDHLRPEYGLEAAPEKDTVVRCLRTRTRMDEEVSDPTSAAAQLRQLRDHLPPPSSASPSRALPEPQEAQKLAAERARAPVVPYGVDLHYWGQELPTAGKIVKSDSQHRFWKPSEVEEEVVNADISEMLRSRHITFAGKFEPVQHWCRAPRPDGRLCERQDRLKCPFHGKIVPRDDEGRPLDPEDRAREQRRQLQKQERPEWQDPELMRDVEAATGQDLGSSRYSGKGRGKKRRYPSLTNLKAQADTARARIGRKVFAKAAVRRVVAAMNRMDQKKHEKFSNQFNYALN

SEQ ID NO: 96086 - protein, 709 aa, Homo sapiens; identical to SEQ ID NO: 96085
  Payload ID: 19184
  Gene Name: UV-stimulated scaffold protein A
  Uniprot ID: Q2YD98
  ENSP ID: ENSP00000421741

SEQ ID NO: 96087 - protein, 136 aa, Homo sapiens
  Payload ID: 19184
  Gene Name: UV-stimulated scaffold protein A
  ENSP ID: ENSP00000422795
  MOD_RES (1)..(1): Any amino acid
XPSRALPEPQEAQKLAAERARAPVVPYGVDLHYWGQELPTAGKIVKSDSQHRFWKPSEVEEEVVNADISEMLRSRHITFAGKFEPVQHWCRAPRPDGRLCERQDRLKTFHSCPRPSGSRGGTEPSPRPCGSQDALL

SEQ ID NO: 96088 - protein, 260 aa, Homo sapiens
  Payload ID: 19184
  Gene Name: UV-stimulated scaffold protein A
  Uniprot ID: Q2YD98
  ENSP ID: ENSP00000423340
MDEEVSDPTSAAAQLRQLRDHLPPPSSASPSRALPEPQEAQKLAAERARAPVVPYGVDLHYWGQELPTAGKIVKSDSQHRFWKPSEVEEEVVNADISEMLRSRHITFAGKFEPVQHWCRAPRPDGRLCERQDRLKCPFHGKIVPRDDEGRPLDPEDRAREQRRQLQKQERPEWQDPELMRDVEAATGQDLGSSRYSGKGRGKKRRYPSLTNLKAQADTARARIGRKVFAKAAVRRVVAAMNRMDQKKHEKFSNQFNYALN

SEQ ID NO: 96089 - protein, 709 aa, Homo sapiens; identical to SEQ ID NO: 96085
  Payload ID: 19184
  Gene Name: UV-stimulated scaffold protein A
  Uniprot ID: Q2YD98
  ENSP ID: ENSP00000425130

SEQ ID NO: 96090 - protein, 260 aa, Homo sapiens; identical to SEQ ID NO: 96088
  Payload ID: 19184
  Gene Name: UV-stimulated scaffold protein A
  Uniprot ID: Q2YD98
  ENSP ID: ENSP00000427701

SEQ ID NO: 96091 - protein, 782 aa, Homo sapiens
  Payload ID: 19185
  Gene Name: Vac14 homolog (S. cerevisiae)
  Uniprot ID: Q08AM6
  ENSP ID: ENSP00000261776
MNPEKDFAPLTPNIVRALNDKLYEKRKVAALEIEKLVREFVAQNNTVQIKHVIQTLSQEFALSQHPHSRKGGLIGLAACSIALGKDSGLYLKELIEPVLTCFNDADSRLRYYACEALYNIVKVARGAVLPHFNVLFDGLSKLAADPDPNVKSGSELLDRLLKDIVTESNKFDLVSFIPLLRERIYSNNQYARQFIISWILVLESVPDINLLDYLPEILDGLFQILGDNGKEIRKMCEVVLGEFLKEIKKNPSSVKFAEMANILVIHCQTTDDLIQLTAMCWMREFIQLAGRVMLPYSSGILTAVLPCLAYDDRKKSIKEVANVCNQSLMKLVTPEDDELDELRPGQRQAEPTPDDALPKQEGTASGGPDGSCDSSFSSGISVFTAASTERAPVTLHLDGIVQVLNCHLSDTAIGMMTRIAVLKWLYHLYIKTPRKMFRHTDSLFPILLQTLSDESDEVILKDLEVLAEIASSPAGQTDDPGPLDGPDLQASHSELQVPTPGRAGLLNTSGTKGLECSPSTPTMNSYFYKFMINLLKRFSSERKLLEVRGPFIIRQLCLLLNAENIFHSMADILLREEDLKFASTMVHALNTILLTSTELFQLRNQLKDLKTLESQNLFCCLYRSWCHNPVTTVSLCFLTQNYRHAYDLIQKFGDLEVTVDFLAEVDKLVQLIECPIFTYLRLQLLDVKNNPYLIKALYGLLMLLPQSSAFQLLSHRLQCVPNPELLQTEDSLKAAPKSQKADSPSIDYAELLQHFEKVQNKHLEVRHQRSGRGDHLDRRVVL

SEQ ID NO: 96092 - protein, 214 aa, Homo sapiens
  Payload ID: 19185
  Gene Name: Vac14 homolog (S. cerevisiae)
  Uniprot ID: Q08AM6
  ENSP ID: ENSP00000439284
MADILLREEDLKFASTMVHALNTILLTSTELFQLRNQLKDLKTLESQNLFCCLYRSWCHNPVTTVSLCFLTQNYRHAYDLIQKFGDLEVTVDFLAEVDKLVQLIECPIFTYLRLQLLDVKNNPYLIKALYGLLMLLPQSSAFQLLSHRLQCVPNPELLQTEDSLKAAPKSQKADSPSIDYAELLQHFEKVQNKHLEVRHQRSGRGDHLDRRVVL

SEQ ID NO: 96093 - protein, 40 aa, Homo sapiens
  Payload ID: 19185
  Gene Name: Vac14 homolog (S. cerevisiae)
  ENSP ID: ENSP00000454650
MNPEKDFAPLTPNIVRALNDKLYEKRKVAALEIEKTQGST

SEQ ID NO: 96094 - protein, 260 aa, Homo sapiens
  Payload ID: 19185
  Gene Name: Vac14 homolog (S. cerevisiae)
  ENSP ID: ENSP00000455731
  MOD_RES (1)..(1): Any amino acid
XVILKDLEVLAEIASSPAGQTDDPGPLDGPDLQASHSELQVPTPGRAGLLNTSGTKGLECSPSTPTMNSYFYKFMINLLKRFSSERKLLEVRGPFIIRQLCLLLNAENIFHSMADILLREEDLKFASTMVHALNTILLTSTELFQLRNQLKDLKTLNYRHAYDLIQKFGDLEVTVDFLAEVDKLVQLIECPIFTYLRLQLLDVKNNPYLIKALYGLLMLLPQSSAFQLLSHRLQCVPNPELLQTEDSLKAAPKSQKADSP

SEQ ID NO: 96095 - protein, 201 aa, Homo sapiens
  Payload ID: 19185
  Gene Name: Vac14 homolog (S. cerevisiae)
  ENSP ID: ENSP00000457809
MNPEKDFAPLTPNIVRALNDKLYEKRKVAALEIEKLVREFVAQNNTVQIKHVIQTLSQEFALSQHPHSRKGGLIGLAACSIALGKDSGLYLKELIEPVLTCFNDADSRLRYYACEALYNIVKVARGAVLPHFNVLFDGLSKLAADPDPNVKSGSELLDRLLKVFFSSGSTTSTSKLLGRCSGTRTASFPSYCRRYRMNRMR

SEQ ID NO: 96096 - protein, 17 aa, Homo sapiens
  Payload ID: 19185
  Gene Name: Vac14 homolog (S. cerevisiae)
  ENSP ID: ENSP00000463485
  MOD_RES (1)..(1): Any amino acid
XAEVDKLVQLIECPIFT

SEQ ID NO: 96097 - protein, 185 aa, Homo sapiens
  Payload ID: 19185
  Gene Name: Vac14 homolog (S. cerevisiae)
  ENSP ID: ENSP00000477536
  MOD_RES (1)..(1): Any amino acid
XPRKMFRHTDSLFPILLQTLSDESDEVILKDLEVLAEIASSPAGQTDDPGPLDGPDLQASHSELQVPTPGRAGLLNTSGTKGLECSPSTPTMNSYFYKFMINLLKRFSSERKLLEVRGPFIIRSALAARFLLFLPRPRLFTFTPFKCQSSHLLFPFSLLLFLTFGSVRNEEGCPFILVADASDMK

SEQ ID NO: 96098 - protein, 396 aa, Homo sapiens
  Payload ID: 19186
  Gene Name: vaccinia related kinase 1
  Uniprot ID: Q99986
  ENSP ID: ENSP00000216639
MPRVKAAQAGRQSSAKRHLAEQFAVGEIITDMAKKEWKVGLPIGQGGFGCIYLADMNSSESVGSDAPCVVKVEPSDNGPLFTELKFYQRAAKPEQIQKWIRTRKLKYLGVPKYWGSGLHDKNGKSYRFMIMDRFGSDLQKIYEANAKRFSRKTVLQLSLRILDILEYIHEHEYVHGDIKASNLLLNYKNPDQVYLVDYGLAYRYCPEGVHKEYKEDPKRCHDGTIEFTSIDAHNGVAPSRRGDLEILGYCMIQWLTGHLPWEDNLKDPKYVRDSKIRYRENIASLMDKCFPEKNKPGEIAKYMETVKLLDYTEKPLYENLRDILLQGLKAIGSKDDGKLDLSVVENGGLKAKTITKKRKKEIEESKEPGVEDTEWSNTQTEEAIQTRSRTRKRVQK

SEQ ID NO: 96099 - protein, 232 aa, Homo sapiens
  Payload ID: 19186
  Gene Name: vaccinia related kinase 1
  ENSP ID: ENSP00000450820
  MOD_RES (1)..(1): Any amino acid
XNAKRFSRKTVLQLSLRILDILEYIHEHEYVHGDIKASNLLLNYKNPDQVYLVDYGLAYRYCPEGVHKEYKEDPKRCHDGTIEFTSIDAHNGVAPSRRGDLEILGYCMIQWLTGHLPWEDNLKDPKYVRDSKIRYRENIASLMDKCFPEKNKPGEIAKYMETVKLLDYTEKPLYENLRDILLQGLKAIGSKDDGKLDLSVVENGGLKAKTITKVGLMRDVESSSRGCLVIME

SEQ ID NO: 96100 - protein, 65 aa, Homo sapiens
  Payload ID: 19186
  Gene Name: vaccinia related kinase 1
  ENSP ID: ENSP00000451412
  MOD_RES (1)..(1): Any amino acid
XKRKKEIEESKEPGVEDTEWSNTQTEEAIQTRSEESQGAIHRSMSQPEASSSSYDSSRTRKRVQK

SEQ ID NO: 96101 - protein, 176 aa, Homo sapiens
  Payload ID: 19186
  Gene Name: vaccinia related kinase 1
  ENSP ID: ENSP00000451682
  MOD_RES (1)..(1): Any amino acid
XCHDGTIEFTSIDAHNGVAPSRRGDLEILGYCMIQWLTGHLPWEDNLKDPKYVRDSKIRYRENIASLMDKCFPEKNKPGEIAKYMETVKLLDYTEKPLYENLRDILLQGLKAIGSKDDGKLDLSVVENGGLKAKTITKVNFVIKLFFGLLVFIIAINTKRKYSSSSMKNNNRLHGN

SEQ ID NO: 96102 - protein, 508 aa, Homo sapiens
  Payload ID: 19187
  Gene Name: vaccinia related kinase 2
  Uniprot ID: Q86Y07
  ENSP ID: ENSP00000342381
MPPKRNEKYKLPIPFPEGKVLDDMEGNQWVLGKKIGSGGFGLIYLAFPTNKPEKDARHVVKVEYQENGPLFSELKFYQRVAKKDCIKKWIERKQLDYLGIPLFYGSGLTEFKGRSYRFMVMERLGIDLQKISGQNGTFKKSTVLQLGIRMLDVLEYIHENEYVHGDIKAANLLLGYKNPDQVYLADYGLSYRYCPNGNHKQYQENPRKGHNGTIEFTSLDAHKGVALSRRSDVEILGYCMLRWLCGKLPWEQNLKDPVAVQTAKTNLLDELPQSVLKWAPSGSSCCEIAQFLVCAHSLAYDEKPNYQALKKILNPHGIPLGPLDFSTKGQSINVHTPNSQKVDSQKAATKQVNKAHNRLIEKKVHSERSAESCATWKVQKEEKLIGLMNNEAAQESTRRRQKYQESQEPLNEVNSFPQKISYTQFPNSFYEPHQDFTSPDIFKKSRSPSWYKYTSTVSTGITDLESSTGLWPTISQFTLSEETNADVYYYRIIIPVLLMLVFLALFFL

SEQ ID NO: 96103 - protein, 485 aa, Homo sapiens
  Payload ID: 19187
  Gene Name: vaccinia related kinase 2
  Uniprot ID: Q86Y07
  ENSP ID: ENSP00000398323
MEGNQWVLGKKIGSGGFGLIYLAFPTNKPEKDARHVVKVEYQENGPLFSELKFYQRVAKKDCIKKWIERKQLDYLGIPLFYGSGLTEFKGRSYRFMVMERLGIDLQKISGQNGTFKKSTVLQLGIRMLDVLEYIHENEYVHGDIKAANLLLGYKNPDQVYLADYGLSYRYCPNGNHKQYQENPRKGHNGTIEFTSLDAHKGVALSRRSDVEILGYCMLRWLCGKLPWEQNLKDPVAVQTAKTNLLDELPQSVLKWAPSGSSCCEIAQFLVCAHSLAYDEKPNYQALKKILNPHGIPLGPLDFSTKGQSINVHTPNSQKVDSQKAATKQVNKAHNRLIEKKVHSERSAESCATWKVQKEEKLIGLMNNEAAQESTRRRQKYQESQEPLNEVNSFPQKISYTQFPNSFYEPHQDFTSPDIFKKSRSPSWYKYTSTVSTGITDLESSTGLWPTISQFTLSEETNADVYYYRIIIPVLLMLVFLALFFL

SEQ ID NO: 96104 - protein, 59 aa, Homo sapiens
  Payload ID: 19187
  Gene Name: vaccinia related kinase 2
  ENSP ID: ENSP00000400006
MPPKRNEKYKLPIPFPEGKVLDDMEGNQWVLGKKIGSGGFGLIYLETLAIFLSPMLSVE

SEQ ID NO: 96105 - protein, 396 aa, Homo sapiens
  Payload ID: 19187
  Gene Name: vaccinia related kinase 2
  Uniprot ID: Q86Y07
  ENSP ID: ENSP00000402375
MPPKRNEKYKLPIPFPEGKVLDDMEGNQWVLGKKIGSGGFGLIYLAFPTNKPEKDARHVVKVEYQENGPLFSELKFYQRVAKKDCIKKWIERKQLDYLGIPLFYGSGLTEFKGRSYRFMVMERLGIDLQKISGQNGTFKKSTVLQLGIRMLDVLEYIHENEYVHGDIKAANLLLGYKNPDQVYLADYGLSYRYCPNGNHKQYQENPRKGHNGTIEFTSLDAHKGVALSRRSDVEILGYCMLRWLCGKLPWEQNLKDPVAVQTAKTNLLDELPQSVLKWAPSGSSCCEIAQFLVCAHSLAYDEKPNYQALKKILNPHGIPLGPLDFSTKGQSINVHTPNSQKVDSQKAATKQVNKAHNRLIEKKVHSERSAESCATWKVQKEEKLIGLMNNEAAQFR

SEQ ID NO: 96106 - protein, 390 aa, Homo sapiens
  Payload ID: 19187
  Gene Name: vaccinia related kinase 2
  Uniprot ID: Q86Y07
  ENSP ID: ENSP00000404156
MVMERLGIDLQKISGQNGTFKKSTVLQLGIRMLDVLEYIHENEYVHGDIKAANLLLGYKNPDQVYLADYGLSYRYCPNGNHKQYQENPRKGHNGTIEFTSLDAHKGVALSRRSDVEILGYCMLRWLCGKLPWEQNLKDPVAVQTAKTNLLDELPQSVLKWAPSGSSCCEIAQFLVCAHSLAYDEKPNYQALKKILNPHGIPLGPLDFSTKGQSINVHTPNSQKVDSQKAATKQVNKAHNRLIEKKVHSERSAESCATWKVQKEEKLIGLMNNEAAQESTRRRQKYQESQEPLNEVNSFPQKISYTQFPNSFYEPHQDFTSPDIFKKSRSPSWYKYTSTVSTGITDLESSTGLWPTISQFTLSEETNADVYYYRIIIPVLLMLVFLALFFL

SEQ ID NO: 96107 - protein, 82 aa, Homo sapiens
  Payload ID: 19187
  Gene Name: vaccinia related kinase 2
  ENSP ID: ENSP00000404961
MKFEVMPPKRNEKYKLPIPFPEGKVLDDMEGNQWVLGKKIGSGGFGLIYLAFPTNKPEKDARHVVKVEYQENGPLFSELKFY

SEQ ID NO: 96108 - protein, 508 aa, Homo sapiens; identical to SEQ ID NO: 96102
  Payload ID: 19187
  Gene Name: vaccinia related kinase 2
  Uniprot ID: Q86Y07
  ENSP ID: ENSP00000408002

SEQ ID NO: 96109 - protein, 474 aa, Homo sapiens
  Payload ID: 19188
  Gene Name: vaccinia related kinase 3
  Uniprot ID: Q8IV63
  ENSP ID: ENSP00000324636
MISFCPDCGKSIQAAFKFCPYCGNSLPVEEHVGSQTFVNPHVSSFQGSKRGLNSSFETSPKKVKWSSTVTSPRLSLFSDGDSSESEDTLSSSERSKGSGSRPPTPKSSPQKTRKSPQVTRGSPQKTSCSPQKTRQSPQTLKRSRVTTSLEALPTGTVLTDKSGRQWKLKSFQTRDNQGILYEAAPTSTLTCDSGPQKQKFSLKLDAKDGRLFNEQNFFQRAAKPLQVNKWKKLYSTPLLAIPTCMGFGVHQDKYRFLVLPSLGRSLQSALDVSPKHVLSERSVLQVACRLLDALEFLHENEYVHGNVTAENIFVDPEDQSQVTLAGYGFAFRYCPSGKHVAYVEGSRSPHEGDLEFISMDLHKGCGPSRRSDLQSLGYCMLKWLYGFLPWTNCLPNTEDIMKQKQKFVDKPGPFVGPCGHWIRPSETLQKYLKVVMALTYEEKPPYAMLRNNLEALLQDLRVSPYDPIGLPMVP

SEQ ID NO: 96110 - protein, 424 aa, Homo sapiens
  Payload ID: 19188
  Gene Name: vaccinia related kinase 3
  Uniprot ID: Q8IV63
  ENSP ID: ENSP00000366210
MISFCPDCGKSIQAAFKFCPYCGNSLPVEEHVGSQTFVNPHVSSFQGSGSRPPTPKSSPQKTRKSPQVTRGSPQKTSCSPQKTRQSPQTLKRSRVTTSLEALPTGTVLTDKSGRQWKLKSFQTRDNQGILYEAAPTSTLTCDSGPQKQKFSLKLDAKDGRLFNEQNFFQRAAKPLQVNKWKKLYSTPLLAIPTCMGFGVHQDKYRFLVLPSLGRSLQSALDVSPKHVLSERSVLQVACRLLDALEFLHENEYVHGNVTAENIFVDPEDQSQVTLAGYGFAFRYCPSGKHVAYVEGSRSPHEGDLEFISMDLHKGCGPSRRSDLQSLGYCMLKWLYGFLPWTNCLPNTEDIMKQKQKFVDKPGPFVGPCGHWIRPSETLQKYLKVVMALTYEEKPPYAMLRNNLEALLQDLRVSPYDPIGLPMVP

SEQ ID NO: 96111 - protein, 177 aa, Homo sapiens
  Payload ID: 19188
  Gene Name: vaccinia related kinase 3
  ENSP ID: ENSP00000468979
MISFCPDCGKSIQAAFKFCPYCGNSLPVEEHVGSQTFVNPHVSSFQGSGSRPPTPKSSPQKTRKSPQVTRGSPQKTSCSPQKTRQSPQTLKRSRVTTSLEALPTGTVLTDKSGRQWKLKSFQTRDNQGILYEAAPTSTLTCDSGPQKQKFSLKLSTSGRSCTRPHCWPSLPAWVSVF

SEQ ID NO: 96112 - protein, 169 aa, Homo sapiens
  Payload ID: 19188
  Gene Name: vaccinia related kinase 3
  ENSP ID: ENSP00000469092
MISFCPDCGKSIQAAFKFCPYCGNSLPVEEHVGSQTFVNPHVSSFQGSKRGLNSSFETSPKKVKWSSTVTSPRLSLFSDGDSSESEDTLSSSERSKGSGSRPPTPKSSPQKTRKSPQVTRGSPQKTSCSPQKTRQSPQTLKRSRVTTSLEALPTGTVLTDKSGRQWKLK

SEQ ID NO: 96113 - protein, 72 aa, Homo sapiens
  Payload ID: 19188
  Gene Name: vaccinia related kinase 3
  ENSP ID: ENSP00000469325
MISFCPDCGKSIQAAFKFCPYCGNSLPVEEHVGSQTFVNPHVSSFQASLDSPAWRRYMCSLPAWHLQAQREG

SEQ ID NO: 96114 - protein, 150 aa, Homo sapiens
  Payload ID: 19188
  Gene Name: vaccinia related kinase 3
  ENSP ID: ENSP00000469400
MISFCPDCGKSIQAAFKFCPYCGNSLPVEEHVGSQTFVNPHVSSFQDGDSSESEDTLSSSERSKGSGSRPPTPKSSPQKTRKSPQVTRGSPQKTSCSPQKTRQSPQTLKRSRVTTSLEALPTGTVLTDKSGRQWKLKSFQTRDNQGILYE

SEQ ID NO: 96115 - protein, 406 aa, Homo sapiens
  Payload ID: 19188
  Gene Name: vaccinia related kinase 3
  ENSP ID: ENSP00000469710
MISFCPDCGKSIQAAFKFCPYCGNSLPVEEHVGSQTFVNPHVSSFQGSKRGLNSSFETSPKKVKWSSTVTSPRLSLFSDGDSSESEDTLSSSERSKGSGSRPPTPKSSPQKTRKSPQVTRGSPQKTSCSPQKTRQSPQTLKRSRVTTSLEALPTGTVLTDKSGRQWKLKSFQTRDNQGILYEAAPTSTLTCDSGPQKQKFSLKLDAKDGRLFNEQNFFQRAAKPLQVNKWKKLYSTPLLAIPTCMGFGVHQDKYRFLVLPSLGRSLQSALDVSPKHVLSERSVLQVACRLLDALEFLHENEYVHGNVTAENIFVDPEDQSQVTLAGYGFAFRYCPSGKHVAYVEGSRSPHEGDLEFISMDLHKGCGPSRRSDLQSLGYCMLKWLYGFLPWTNCLPNTEDIMKQKQK

SEQ ID NO: 96116 - protein, 247 aa, Homo sapiens
  Payload ID: 19188
  Gene Name: vaccinia related kinase 3
  ENSP ID: ENSP00000469802
MISFCPDCGKSIQAAFKFCPYCGNSLPVEEHVGSQTFVNPHVSSFQGSKRGLNSSFETSPKKVKWSSTVTSPRLSLFSDGDSSESEDTLSSSERSKGSGSRPPTPKSSPQKTRKSPQVTRGSPQKTSCSPQKTRQSPQTLKRSRVTTSLEALPTGTVLTDKSGRQWKLKSFQTRDNQGILYEAAPTSTLTCDSGPQKQKFSLKLVLGVTQPGEEPSVGPGCQPKACAVREVCAAGGLPAAGCPGVPP

SEQ ID NO: 96117 - protein, 474 aa, Homo sapiens; identical to SEQ ID NO: 96109
  Payload ID: 19188
  Gene Name: vaccinia related kinase 3
  Uniprot ID: Q8IV63
  ENSP ID: ENSP00000469880

SEQ ID NO: 96118 - protein, 424 aa, Homo sapiens; identical to SEQ ID NO: 96110
  Payload ID: 19188
  Gene Name: vaccinia related kinase 3
  Uniprot ID: Q8IV63
  ENSP ID: ENSP00000470156

SEQ ID NO: 96119 - protein, 112 aa, Homo sapiens
  Payload ID: 19188
  Gene Name: vaccinia related kinase 3
  ENSP ID: ENSP00000470359
MISFCPDCGKSIQAAFKFCPYCGNSLPVEEHVGSQTFVNPHVSSFQGSKRGLNSSFETSPKKVKWSSTVTSPRLSLFSDGDSSESEDTLSSSERSKGSGSRPPTPKSSPQKT

SEQ ID NO: 96120 - protein, 182 aa, Homo sapiens
  Payload ID: 19188
  Gene Name: vaccinia related kinase 3
  ENSP ID: ENSP00000470940
MISFCPDCGKSIQAAFKFCPYCGNSLPVEEHVGSQTFVNPHVSSFQGSKRGLNSSFETSPKKVKWSSTVTSPRLSLFSDGDSSESEDTLSSSERSKGSGSRPPTPKSSPQKTRKSPQVTRGSPQKTSCSPQKTRQSPQTLKRSRVTTSLEALPTGTVLTDKSGRQWKLKSFQTRDNQGILYE

SEQ ID NO: 96121 - protein, 362 aa, Homo sapiens
  Payload ID: 19188
  Gene Name: vaccinia related kinase 3
  ENSP ID: ENSP00000471061
MISFCPDCGKSIQAAFKFCPYCGNSLPVEEHVGSQTFVNPHVSSFQGSGSRPPTPKSSPQKTRKSPQVTRGSPQKTSCSPQKTRQSPQTLKRSRVTTSLEALPTGTVLTDKSGRQWKLKSFQTRDNQGILYEAAPTSTLTCDSGPQKQKFSLKLDAKDGRLFNEQNFFQRAAKPLQVNKWKKLYSTPLLAIPTCMGFGVHQDKYRFLVLPSLGRSLQSALDVSPKHVLSERSVLQVACRLLDALEFLHENEYVHGNVTAENIFVDPEDQSQVTLAGYGFAFRYCPSGKHVAYVEGSRSPHEGDLEFISMDLHKGCGPSRRSDLQSLGYCMLKWLYGFLPWTNCLPNTEDIMKQKQKLPWDSF

SEQ ID NO: 96122 - protein, 72 aa, Homo sapiens; identical to SEQ ID NO: 96113
  Payload ID: 19188
  Gene Name: vaccinia related kinase 3
  ENSP ID: ENSP00000471661

SEQ ID NO: 96123 - protein, 197 aa, Homo sapiens
  Payload ID: 19188
  Gene Name: vaccinia related kinase 3
  ENSP ID: ENSP00000472217
MISFCPDCGKSIQAAFKFCPYCGNSLPVEEHVGSQTFVNPHVSSFQGSGSRPPTPKSSPQKTRKSPQVTRGSPQKTSCSPQKTRQSPQTLKRSRVTTSLEALPTGTVLTDKSGRQWKLKSFQTRDNQGILYEAAPTSTLTCDSGPQKQKFSLKLVLGVTQPGEEPSVGPGCQPKACAVREVCAAGGLPAAGCPGVPP

SEQ ID NO: 96124 - protein, 412 aa, Homo sapiens
  Payload ID: 19188
  Gene Name: vaccinia related kinase 3
  Uniprot ID: Q8IV63
  ENSP ID: ENSP00000472541
MISFCPDCGKSIQAAFKFCPYCGNSLPVEEHVGSQTFVNPHVSSFQGSKRGLNSSFETSPKKVKWSSTVTSPRLSLFSDGDSSESEDTLSSSERSKGSGSRPPTPKSSPQKTRKSPQVTRGSPQKTSCSPQKTRQSPQTLKRSRVTTSLEALPTGTVLTDKSGRQWKLKSFQTRDNQGILYEAAPTSTLTCDSGPQKQKFSLKLDAKDGRLFNEQNFFQRAAKPLQVNKWKKLYSTPLLAIPTCMGFGVHQDKYRFLVLPSLGRSLQSALDVSPKHVLSERSVLQVACRLLDALEFLHENEYVHGNVTAENIFVDPEDQSQVTLAGYGFAFRYCPSGKHVAYVEGSRSPHEGDLEFISMDLHKGCGPSRRSDLQSLGYCMLKWLYGFLPWTNCLPNTEDIMKQKQKLPWDSF

SEQ ID NO: 96125 - protein, 474 aa, Homo sapiens; identical to SEQ ID NO: 96109
  Payload ID: 19188
  Gene Name: vaccinia related kinase 3
  Uniprot ID: Q8IV63
  ENSP ID: ENSP00000473171

SEQ ID NO: 96126 - protein, 117 aa, Homo sapiens
  Payload ID: 19188
  Gene Name: vaccinia related kinase 3
  ENSP ID: ENSP00000473222
GNVTAENIFVDPEDQSQVTLAGYGFAFRYCPSGKHVAYVEGSRSPHEGDLEFISMDLHKGCGPSRRSDLQSLGYCMLKWLYGFLPWTNCLPNTEDIMKQKQKCICTLKIACWPWCCV

SEQ ID NO: 96127 - protein, 484 aa, Homo sapiens
  Payload ID: 19189
  Gene Name: vacuolar protein sorting 11 homolog (S. cerevisiae)
  Uniprot ID: Q9H270
  ENSP ID: ENSP00000479680
MKRYGKILMHHIPEQTTQLLKGLCTDYRPSLEGRSDREAPGCRANSEEFIPIFANNPRELKAFLEHMSEVQPDSPQGIYDTLLELRLQNWAHEKDPQVKEKLHAEAISLLKSGRFCDVFDKALVLCQMHDFQDGVLYLYEQGKLFQQIMHYHMQHEQYRQVISVCERHGEQDPSLWEQALSYFARKEEDCKEYVAAVLKHIENKNLMPPLLVVQTLAHNSTATLSVIRDYLVQKLQKQSQQIAQDELRVRRYREETTRIRQEIQELKASPKIFQKTKCSICNSALELPSVHFLCGHSFHQHCFESYSESDADCPTCLPENRKVMDMIRAQEQKRDLHDQFQHQLKCSNDSFSVIADYFGRGVFNKLTLLTDPPTARLTSAWRLGCNATYSCTPGGALKQPGGRCGQQWRTKRTDTMGPGRALHRRLADMPRAPLSSNVTALRTKADFLSLPSYLVSLPSLLFTSSVDHSRSVGEGTSATSECGQ

SEQ ID NO: 96128 - protein, 941 aa, Homo sapiens
  Payload ID: 19189
  Gene Name: vacuolar protein sorting 11 homolog (S. cerevisiae)
  ENSP ID: ENSP00000481126
MAAYLQWRRFVFFDKELVKEPLSNDGAAPGATPASGSAASKFLCLPPGITVCDSGRGSLVFGDMEGQIWFLPRSLQLTGFQAYKLRVTHLYQLKQHNILASVGEDEEGINPLVKIWNLEKRDGGNPLCTRIFPAIPGTEPTVVSCLTVHENLNFMAIGFTDGSVTLNKGDITRDRHSKTQILHKGNYPVTGLAFRQAGKTTHLFVVTTENVQSYIVSGKDYPRVELDTHGCGLRCSALSDPSQDLQFIVAGDECVYLYQPDERGPCFAFEGHKLIAHWFRGYLIIVSRDRKVSPKSEFTSRDSQSSDKQILNIYDLCNKFIAYSTVFEDVVDVLAEWGSLYVLTRDGRVHALQEKDTQTKLEMLFKKNLFEMAINLAKSQHLDSDGLAQIFMQYGDHLYSKGNHDGAVQQYIRTIGKLEPSYVIRKFLDAQRIHNLTAYLQTLHRQSLANADHTTLLLNCYTKLKDSSKLEEFIKKKSESEVHFDVETAIKVLRQAGYYSHALYLAENHAHHEWYLKIQLEDIKNYQEALRYIGKLPFEQAESNMKRYGKILMHHIPEQTTQLLKGLCTDYRPSLEGRSDREAPGCRANSEEFIPIFANNPRELKAFLEHMSEVQPDSPQGIYDTLLELRLQNWAHEKDPQVKEKLHAEAISLLKSGRFCDVFDKALVLCQMHDFQDGVLYLYEQGKLFQQIMHYHMQHEQYRQVISVCERHGEQDPSLWEQALSYFARKEEDCKEYVAAVLKHIENKNLMPPLLVVQTLAHNSTATLSVIRDYLVQKLQKQSQQIAQDELRVRRYREETTRIRQEIQELKASPKIFQKTKCSICNSALELPSVHFLCGHSFHQHCFESYSESDADCPTCLPENRKVMDMIRAQEQKRDLHDQFQHQLKCSNDSFSVIADYFGRGVFNKLTLLTDPPTARLTSSLEAGLQRDLLMHSRRGT

SEQ ID NO: 96129 - protein, 931 aa, Homo sapiens
  Payload ID: 19189
  Gene Name: vacuolar protein sorting 11 homolog (S. cerevisiae)
  ENSP ID: ENSP00000481807
MKSVCRRGPCRAPLWFSWSSRVVLWSTGRKKEVHLLTCYQLSNPGRLLDYPAHMEGQIWFLPRSLQLTGFQAYKLRVTHLYQLKQHNILASVGEDEEGINPLVKIWNLEKRDGGNPLCTRIFPAIPGTEPTVVSCLTVHENLNFMAIGFTDGSVTLNKGDITRDRHSKTQILHKGNYPVTGLAFRQAGKTTHLFVVTTENVQSYIVSGKDYPRVELDTHGCGLRCSALSDPSQDLQFIVAGDECVYLYQPDERGPCFAFEGHKLIAHWFRGYLIIVSRDRKVSPKSEFTSRDSQSSDKQILNIYDLCNKFIAYSTVFEDVVDVLAEWGSLYVLTRDGRVHALQEKDTQTKLEMLFKKNLFEMAINLAKSQHLDSDGLAQIFMQYGDHLYSKGNHDGAVQQYIRTIGKLEPSYVIRKFLDAQRIHNLTAYLQTLHRQSLANADHTTLLLNCYTKLKDSSKLEEFIKKKSESEVHFDVETAIKVLRQAGYYSHALYLAENHAHHEWYLKIQLEDIKNYQEALRYIGKLPFEQAESNMKRYGKILMHHIPEQTTQLLKGLCTDYRPSLEGRSDREAPGCRANSEEFIPIFANNPRELKAFLEHMSEVQPDSPQGIYDTLLELRLQNWAHEKDPQVKEKLHAEAISLLKSGRFCDVFDKALVLCQMHDFQDGVLYLYEQGKLFQQIMHYHMQHEQYRQVISVCERHGEQDPSLWEQALSYFARKEEDCKEYVAAVLKHIENKNLMPPLLVVQTLAHNSTATLSVIRDYLVQKLQKQSQQIAQDELRVRRYREETTRIRQEIQELKASPKIFQKTKCSICNSALELPSVHFLCGHSFHQHCFESYSESDADCPTCLPENRKVMDMIRAQEQKRDLHDQFQHQLKCSNDSFSVIADYFGRGVFNKLTLLTDPPTARLTSSLEAGLQRDLLMHSRRGT

SEQ ID NO: 96130 - protein, 181 aa, Homo sapiens
  Payload ID: 19189
  Gene Name: vacuolar protein sorting 11 homolog (S. cerevisiae)
  ENSP ID: ENSP00000485025
  MOD_RES (1)..(1): Any amino acid
XEMAINLAKSQHLDSDGLAQIFMQYGDHLYSKGNHDGAVQQYIRSASDSCVHELEKYTDSDAIGCTCLPRTIGKLEPSYVIRKFLDAQRIHNLTAYLQTLHRQSLANADHTTLLLNCYTKLKDSSKLEEFIKKKSESEVHFDVETAIKVLRQAGYYSHALYLAENHAHHEWYLKIQLEDIK

SEQ ID NO: 96131 - protein, 3095 aa, Homo sapiens
  Payload ID: 19190
  Gene Name: vacuolar protein sorting 13 homolog A (S. cerevisiae)
  Uniprot ID: Q96RL7
  ENSP ID: ENSP00000349985
MVFESVVVDVLNRFLGDYVVDLDTSQLSLGIWKGAVALKNLQIKENALSQLDVPFKVKVGHIGNLKLIIPWKNLYTQPVEAVLEEIYLLIVPSSRIKYDPLKEEKQLMEAKQQELKRIEEAKQKVVDQEQHLPEKQDTFAEKLVTQIIKNLQVKISSIHIRYEDDITNRDKPLSFGISLQNLSMQTTDQYWVPCLHDETEKLVRKLIRLDNLFAYWNVKSQMFYLSDYDNSLDDLKNGIVNENIVPEGYDFVFRPISANAKLVMNRRSDFDFSAPKINLEIELHNIAIEFNKPQYFSIMELLESVDMMAQNLPYRKFKPDVPLHHHAREWWAYAIHGVLEVNVCPRLWMWSWKHIRKHRQKVKQYKELYKKKLTSKKPPGELLVSLEELEKTLDVFNITIARQTAEVEVKKAGYKIYKEGVKDPEDNKGWFSWLWSWSEQNTNEQQPDVQPETLEEMLTPEEKALLYEAIGYSETAVDPTLLKTFEALKFFVHLKSMSIVLRENHQKPELVDIVIEEFSTLIVQRPGAQAIKFETKIDSFHITGLPDNSEKPRLLSSLDDAMSLFQITFEINPLDETVSQRCIIEAEPLEIIYDARTVNSIVEFFRPPKEVHLAQLTAATLTKLEEFRSKTATGLLYIIETQKVLDLKINLKASYIIVPQDGIFSPTSNLLLLDLGHLKVTSKSRSELPDVKQGEANLKEIMDRAYDSFDIQLTSVQLLYSRVGDNWREARKLSVSTQHILVPMHFNLELSKAMVFMDVRMPKFKIYGKLPLISLRISDKKLQGIMELIESIPKPEPVTEVSAPVKSFQIQTSTSLGTSQISQKIIPLLELPSVSEDDSEEEFFDAPCSPLEEPLQFPTGVKSIRTRKLQKQDCSVNMTTFKIRFEVPKVLIEFYHLVGDCELSVVEILVLGLGAEIEIRTYDLKANAFLKEFCLKCPEYLDENKKPVYLVTTLDNTMEDLLTLEYVKAEKNVPDLKSTYNNVLQLIKVNFSSLDIHLHTEALLNTINYLHNILPQSEEKSAPVSTTETEDKGDVIKKLALKLSTNEDIITLQILAELSCLQIFIQDQKCNISEIKIEGLDSEMIMRPSETEINAKLRNIIVLDSDITAIYKKAVYITGKEVFSFKMVSYMDATAGSAYTDMNVVDIQVNLIVGCIEVVFVTKFLYSILAFIDNFQAAKQALAEATVQAAGMAATGVKELAQRSSRMALDINIKAPVVVIPQSPVSENVFVADFGLITMTNTFHMITESQSSPPPVIDLITIKLSEMRLYRSRFINDAYQEVLDLLLPLNLEVVVERNLCWEWYQEVPCFNVNAQLKPMEFILSQEDITTIFKTLHGNIWYEKDGSASPAVTKDQYSATSGVTTNASHHSGGATVVTAAVVEVHSRALLVKTTLNISFKTDDLTMVLYSPGPKQASFTDVRDPSLKLAEFKLENIISTLKMYTDGSTFSSFSLKNCILDDKRPHVKKATPRMIGLTVGFDKKDMMDIKYRKVRDGCVTDAVFQEMYICASVEFLQTVANVFLEAYTTGTAVETSVQTWTAKEEVPTQESVKWEINVIIKNPEIVFVADMTKNDAPALVITTQCEICYKGNLENSTMTAAIKDLQVRACPFLPVKRKGKITTVLQPCDLFYQTTQKGTDPQVIDMSVKSLTLKVSPVIINTMITITSALYTTKETIPEETASSTAHLWEKKDTKTLKMWFLEESNETEKIAPTTELVPKGEMIKMNIDSIFIVLEAGIGHRTVPMLLAKSRFSGEGKNWSSLINLHCQLELEVHYYNEMFGVWEPLLEPLEIDQTEDFRPWNLGIKMKKKAKMAIVESDPEEENYKVPEYKTVISFHSKDQLNITLSKCGLVMLNNLVKAFTEAATGSSADFVKDLAPFMILNSLGLTISVSPSDSFSVLNIPMAKSYVLKNGESLSMDYIRTKDNDHFNAMTSLSSKLFFILLTPVNHSTADKIPLTKVGRRLYTVRHRESGVERSIVCQIDTVEGSKKVTIRSPVQIRNHFSVPLSVYEGDTLLGTASPENEFNIPLGSYRSFIFLKPEDENYQMCEGIDFEEIIKNDGALLKKKCRSKNPSKESFLINIVPEKDNLTSLSVYSEDGWDLPYIMHLWPPILLRNLLPYKIAYYIEGIENSVFTLSEGHSAQICTAQLGKARLHLKLLDYLNHDWKSEYHIKPNQQDISFVSFTCVTEMEKTDLDIAVHMTYNTGQTVVAFHSPYWMVNKTGRMLQYKADGIHRKHPPNYKKPVLFSFQPNHFFNNNKVQLMVTDSELSNQFSIDTVGSHGAVKCKGLKMDYQVGVTIDLSSFNITRIVTFTPFYMIKNKSKYHISVAEEGNDKWLSLDLEQCIPFWPEYASSKLLIQVERSEDPPKRIYFNKQENCILLRLDNELGGIIAEVNLAEHSTVITFLDYHDGAATFLLINHTKNELVQYNQSSLSEIEDSLPPGKAVFYTWADPVGSRRLKWRCRKSHGEVTQKDDMMMPIDLGEKTIYLVSFFEGLQRIILFTEDPRVFKVTYESEKAELAEQEIAVALQDVGISLVNNYTKQEVAYIGITSSDVVWETKPKKKARWKPMSVKHTEKLEREFKEYTESSPSEDKVIQLDTNVPVRLTPTGHNMKILQPHVIALRRNYLPALKVEYNTSAHQSSFRIQIYRIQIQNQIHGAVFPFVFYPVKPPKSVTMDSAPKPFTDVSIVMRSAGHSQISRIKYFKVLIQEMDLRLDLGFIYALTDLMTEAEVTENTEVELFHKDIEAFKEEYKTASLVDQSQVSLYEYFHISPIKLHLSVSLSSGREEAKDSKQNGGLIPVHSLNLLLKSIGATLTDVQDVVFKLAFFELNYQFHTTSDLQSEVIRHYSKQAIKQMYVLILGLDVLGNPFGLIREFSEGVEAFFYEPYQGAIQGPEEFVEGMALGLKALVGGAVGGLAGAASKITGAMAKGVAAMTMDEDYQQKRREAMNKQPAGFREGITRGGKGLVSGFVSGITGIVTKPIKGAQKGGAAGFFKGVGKGLVGAVARPTGGIIDMASSTFQGIKRATETSEVESLRPPRFFNEDGVIRPYRLRDGTGNQMLQKIQFYREWIMTHSSSSDDDDDDDDDDESDLNH

SEQ ID NO: 96132 - protein, 3174 aa, Homo sapiens
  Payload ID: 19190
  Gene Name: vacuolar protein sorting 13 homolog A (S. cerevisiae)
  Uniprot ID: Q96RL7
  ENSP ID: ENSP00000353422
MVFESVVVDVLNRFLGDYVVDLDTSQLSLGIWKGAVALKNLQIKENALSQLDVPFKVKVGHIGNLKLIIPWKNLYTQPVEAVLEEIYLLIVPSSRIKYDPLKEEKQLMEAKQQELKRIEEAKQKVVDQEQHLPEKQDTFAEKLVTQIIKNLQVKISSIHIRYEDDITNRDKPLSFGISLQNLSMQTTDQYWVPCLHDETEKLVRKLIRLDNLFAYWNVKSQMFYLSDYDNSLDDLKNGIVNENIVPEGYDFVFRPISANAKLVMNRRSDFDFSAPKINLEIELHNIAIEFNKPQYFSIMELLESVDMMAQNLPYRKFKPDVPLHHHAREWWAYAIHGVLEVNVCPRLWMWSWKHIRKHRQKVKQYKELYKKKLTSKKPPGELLVSLEELEKTLDVFNITIARQTAEVEVKKAGYKIYKEGVKDPEDNKGWFSWLWSWSEQNTNEQQPDVQPETLEEMLTPEEKALLYEAIGYSETAVDPTLLKTFEALKFFVHLKSMSIVLRENHQKPELVDIVIEEFSTLIVQRPGAQAIKFETKIDSFHITGLPDNSEKPRLLSSLDDAMSLFQITFEINPLDETVSQRCIIEAEPLEIIYDARTVNSIVEFFRPPKEVHLAQLTAATLTKLEEFRSKTATGLLYIIETQKVLDLKINLKASYIIVPQDGIFSPTSNLLLLDLGHLKVTSKSRSELPDVKQGEANLKEIMDRAYDSFDIQLTSVQLLYSRVGDNWREARKLSVSTQHILVPMHFNLELSKAMVFMDVRMPKFKIYGKLPLISLRISDKKLQGIMELIESIPKPEPVTEVSAPVKSFQIQTSTSLGTSQISQKIIPLLELPSVSEDDSEEEFFDAPCSPLEEPLQFPTGVKSIRTRKLQKQDCSVNMTTFKIRFEVPKVLIEFYHLVGDCELSVVEILVLGLGAEIEIRTYDLKANAFLKEFCLKCPEYLDENKKPVYLVTTLDNTMEDLLTLEYVKAEKNVPDLKSTYNNVLQLIKVNFSSLDIHLHTEALLNTINYLHNILPQSEEKSAPVSTTETEDKGDVIKKLALKLSTNEDIITLQILAELSCLQIFIQDQKCNISEIKIEGLDSEMIMRPSETEINAKLRNIIVLDSDITAIYKKAVYITGKEVFSFKMVSYMDATAGSAYTDMNVVDIQVNLIVGCIEVVFVTKFLYSILAFIDNFQAAKQALAEATVQAAGMAATGVKELAQRSSRMALDINIKAPVVVIPQSPVSENVFVADFGLITMTNTFHMITESQSSPPPVIDLITIKLSEMRLYRSRFINDAYQEVLDLLLPLNLEVVVERNLCWEWYQEVPCFNVNAQLKPMEFILSQEDITTIFKTLHGNIWYEKDGSASPAVTKDQYSATSGVTTNASHHSGGATVVTAAVVEVHSRALLVKTTLNISFKTDDLTMVLYSPGPKQASFTDVRDPSLKLAEFKLENIISTLKMYTDGSTFSSFSLKNCILDDKRPHVKKATPRMIGLTVGFDKKDMMDIKYRKVRDGCVTDAVFQEMYICASVEFLQTVANVFLEAYTTGTAVETSVQTWTAKEEVPTQESVKWEINVIIKNPEIVFVADMTKNDAPALVITTQCEICYKGNLENSTMTAAIKDLQVRACPFLPVKRKGKITTVLQPCDLFYQTTQKGTDPQVIDMSVKSLTLKVSPVIINTMITITSALYTTKETIPEETASSTAHLWEKKDTKTLKMWFLEESNETEKIAPTTELVPKGEMIKMNIDSIFIVLEAGIGHRTVPMLLAKSRFSGEGKNWSSLINLHCQLELEVHYYNEMFGVWEPLLEPLEIDQTEDFRPWNLGIKMKKKAKMAIVESDPEEENYKVPEYKTVISFHSKDQLNITLSKCGLVMLNNLVKAFTEAATGSSADFVKDLAPFMILNSLGLTISVSPSDSFSVLNIPMAKSYVLKNGESLSMDYIRTKDNDHFNAMTSLSSKLFFILLTPVNHSTADKIPLTKVGRRLYTVRHRESGVERSIVCQIDTVEGSKKVTIRSPVQIRNHFSVPLSVYEGDTLLGTASPENEFNIPLGSYRSFIFLKPEDENYQMCEGIDFEEIIKNDGALLKKKCRSKNPSKESFLINIVPEKDNLTSLSVYSEDGWDLPYIMHLWPPILLRNLLPYKIAYYIEGIENSVFTLSEGHSAQICTAQLGKARLHLKLLDYLNHDWKSEYHIKPNQQDISFVSFTCVTEMEKTDLDIAVHMTYNTGQTVVAFHSPYWMVNKTGRMLQYKADGIHRKHPPNYKKPVLFSFQPNHFFNNNKVQLMVTDSELSNQFSIDTVGSHGAVKCKGLKMDYQVGVTIDLSSFNITRIVTFTPFYMIKNKSKYHISVAEEGNDKWLSLDLEQCIPFWPEYASSKLLIQVERSEDPPKRIYFNKQENCILLRLDNELGGIIAEVNLAEHSTVITFLDYHDGAATFLLINHTKNELVQYNQSSLSEIEDSLPPGKAVFYTWADPVGSRRLKWRCRKSHGEVTQKDDMMMPIDLGEKTIYLVSFFEGLQRIILFTEDPRVFKVTYESEKAELAEQEIAVALQDVGISLVNNYTKQEVAYIGITSSDVVWETKPKKKARWKPMSVKHTEKLEREFKEYTESSPSEDKVIQLDTNVPVRLTPTGHNMKILQPHVIALRRNYLPALKVEYNTSAHQSSFRIQIYRIQIQNQIHGAVFPFVFYPVKPPKSVTMDSAPKPFTDVSIVMRSAGHSQISRIKYFKVLIQEMDLRLDLGFIYALTDLMTEAEVTENTEVELFHKDIEAFKEEYKTASLVDQSQVSLYEYFHISPIKLHLSVSLSSGREEAKDSKQNGGLIPVHSLNLLLKSIGATLTDVQDVVFKLAFFELNYQFHTTSDLQSEVIRHYSKQAIKQMYVLILGLDVLGNPFGLIREFSEGVEAFFYEPYQGAIQGPEEFVEGMALGLKALVGGAVGGLAGAASKITGAMAKGVAAMTMDEDYQQKRREAMNKQPAGFREGITRGGKGLVSGFVSGITGIVTKPIKGAQKGGAAGFFKGVGKGLVGAVARPTGGIIDMASSTFQGIKRATETSEVESLRPPRFFNEDGVIRPYRLRDGTGNQMLQVMENGRFAKYKYFTHVMINKTDMLMITRRGVLFVTKGTFGQLTCEWQYSFDEFTKEPFIVHGRRLRIEAKERVKSVFHAREFGKIINFKTPEDARWILTKLQEAREPSPSL

SEQ ID NO: 96133 - protein, 3069 aa, Homo sapiens
  Payload ID: 19190
  Gene Name: vacuolar protein sorting 13 homolog A (S. cerevisiae)
  Uniprot ID: Q96RL7
  ENSP ID: ENSP00000365821
MVFESVVVDVLNRFLGDYVVDLDTSQLSLGIWKGAVALKNLQIKENALSQLDVPFKVKVGHIGNLKLIIPWKNLYTQPVEAVLEEIYLLIVPSSRIKYDPLKEEKQLMEAKQQELKRIEEAKQKVVDQEQHLPEKQDTFAEKLVTQIIKNLQVKISSIHIRYEDDITNRDKPLSFGISLQNLSMQTTDQYWVPCLHDETEKLVRKLIRLDNLFAYWNVKSQMFYLSDYDNSLDDLKNGIVNENIVPEGYDFVFRPISANAKLVMNRRSDFDFSAPKINLEIELHNIAIEFNKPQYFSIMELLESVDMMAQNLPYRKFKPDVPLHHHAREWWAYAIHGVLEVNVCPRLWMWSWKHIRKHRQKVKQYKELYKKKLTSKKPPGELLVSLEELEKTLDVFNITIARQTAEVEVKKAGYKIYKEGVKDPEDNKGWFSWLWSWSEQNTNEQQPDVQPETLEEMLTPEEKALLYEAIGYSETAVDPTLLKTFEALKFFVHLKSMSIVLRENHQKPELVDIVIEEFSTLIVQRPGAQAIKFETKIDSFHITGLPDNSEKPRLLSSLDDAMSLFQITFEINPLDETVSQRCIIEAEPLEIIYDARTVNSIVEFFRPPKEVHLAQLTAATLTKLEEFRSKTATGLLYIIETQKVLDLKINLKASYIIVPQDGIFSPTSNLLLLDLGHLKVTSKSRSELPDVKQGEANLKEIMDRAYDSFDIQLTSVQLLYSRVGDNWREARKLSVSTQHILVPMHFNLELSKAMVFMDVRMPKFKIYGKLPLISLRISDKKLQGIMELIESIPKPEPVTEVSAPVKSFQIQTSTSLGTSQISQKIIPLLELPSVSEDDSEEEFFDAPCSPLEEPLQFPTGVKSIRTRKLQKQDCSVNMTTFKIRFEVPKVLIEFYHLVGDCELSVVEILVLGLGAEIEIRTYDLKANAFLKEFCLKCPEYLDENKKPVYLVTTLDNTMEDLLTLEYVKAEKNVPDLKSTYNNVLQLIKVNFSSLDIHLHTEALLNTINYLHNILPQSEEKSAPVSTTETEDKGDVIKKLALKLSTNEDIITLQILAELSCLQIFIQDQKCNISEIKIEGLDSEMIMRPSETEINAKLRNIIVLDSDITAIYKKAVYITGKEVFSFKMVSYMDATAGSAYTDMNVVDIQVNLIVGCIEVVFVTKFLYSILAFIDNFQAAKQALAEATVQAAGMAATGVKELAQRSSRMALDINIKAPVVVIPQSPVSENVFVADFGLITMTNTFHMITESQSSPPPVIDLITIKLSEMRLYRSRFINDAYQEVLDLLLPLNLEVVVERNLCWEWYQEVPCFNVNAQLKPMEFILSQEDITTIFKTLHGNIWYEKDGSASPAVTKDQYSATSGVTTNASHHSGGATVVTAAVVEVHSRALLVKTTLNISFKTDDLTMVLYSPGPKQASFTDVRDPSLKLAEFKLENIISTLKMYTDGSTFSSFSLKNCILDDKRPHVKKATPRMIGLTVGFDKKDMMDIKYRKVRDGCVTDAVFQEMYICASVEFLQTVANVFLEAYTTGTAVETSVQTWTAKEEVPTQESVKWEINVIIKNPEIVFVADMTKNDAPALVITTQCEICYKGNLENSTMTAAIKDLQVRACPFLPVKRKGKITTVLQPCDLFYQTTQKGTDPQVIDMSVKSLTLKVSPVIINTMITITSALYTTKETIPEETASSTAHLWEKKDTKTLKMWFLEESNETEKIAPTTELVPKGEMIKMNIDSIFIVLEAGIGHRTVPMLLAKSRFSGEGKNWSSLINLHCQLELEVHYYNEMFGVWEPLLEPLEIDQTEDFRPWNLGIKMKKKAKMAIVESDPEEENYKVPEYKTVISFHSKDQLNITLSKCGLVMLNNLVKAFTEAATGSSADFVKDLAPFMILNSLGLTISVSPSDSFSVLNIPMAKSYVLKNGESLSMDYIRTKDNDHFNAMTSLSSKLFFILLTPVNHSTADKIPLTKVGRRLYTVRHRESGVERSIVCQIDTVEGSKKVTIRSPVQIRNHFSVPLSVYEGDTLLGTASPENEFNIPLGSYRSFIFLKPEDENYQMCEGIDFEEIIKNDGALLKKKCRSKNPSKESFLINIVPEKDNLTSLSVYSEDGWDLPYIMHLWPPILLRNLLPYKIAYYIEGIENSVFTLSEGHSAQICTAQLGKARLHLKLLDYLNHDWKSEYHIKPNQQDISFVSFTCVTEMEKTDLDIAVHMTYNTGQTVVAFHSPYWMVNKTGRMLQYKADGIHRKHPPNYKKPVLFSFQPNHFFNNNKVQLMVTDSELSNQFSIDTVGSHGAVKCKGLKMDYQVGVTIDLSSFNITRIVTFTPFYMIKNKSKYHISVAEEGNDKWLSLDLEQCIPFWPEYASSKLLIQVERSEDPPKRIYFNKQENCILLRLDNELGGIIAEVNLAEHSTVITFLDYHDGAATFLLINHTKNELVQYNQSSLSEIEDSLPPGKAVFYTWADPVGSRRLKWRCRKSHGEVTQKDDMMMPIDLGEKTIYLVSFFEGLQRIILFTEDPRVFKVTYESEKAELAEQEIAVALQDVGISLVNNYTKQEVAYIGITSSDVVWETKPKKKARWKPMSVKHTEKLEREFKEYTESSPSEDKVIQLDTNVPVRLTPTGHNMKILQPHVIALRRNYLPALKVEYNTSAHQSSFRIQIYRIQIQNQIHGAVFPFVFYPVKPPKSVTMDSAPKPFTDVSIVMRSAGHSQISRIKYFKVLIQEMDLRLDLGFIYALTDLMTEAEVTENTEVELFHKDIEAFKEEYKTASLVDQSQVSLYEYFHISPIKLHLSVSLSSGREEAKDSKQNGGLIPVHSLNLLLKSIGATLTDVQDVVFKLAFFELNYQFHTTSDLQSEVIRHYSKQAIKQMYVLILGLDVLGNPFGLIREFSEGVEAFFYEPYQGAIQGPEEFVEGMALGLKALVGGAVGGLAGAASKITGAMAKGVAAMTMDEDYQQKRREAMNKQPAGFREGITRGGKGLVSGFVSGITGIVTKPIKGAQKGGAAGFFKGVGKGLVGAVARPTGGIIDMASSTFQGIKRATETSEVESLRPPRFFNEDGVIRPYRLRDGTGNQMLQASKSLI

SEQ ID NO: 96134 - protein, 3135 aa, Homo sapiens
  Payload ID: 19190
  Gene Name: vacuolar protein sorting 13 homolog A (S. cerevisiae)
  Uniprot ID: Q96RL7
  ENSP ID: ENSP00000365823
MVFESVVVDVLNRFLGDYVVDLDTSQLSLGIWKGAVALKNLQIKENALSQLDVPFKVKVGHIGNLKLIIPWKNLYTQPVEAVLEEIYLLIVPSSRIKYDPLKEEKQLMEAKQQELKRIEEAKQKVVDQEQHLPEKQDTFAEKLVTQIIKNLQVKISSIHIRYEDDITNRDKPLSFGISLQNLSMQTTDQYWVPCLHDETEKLVRKLIRLDNLFAYWNVKSQMFYLSDYDNSLDDLKNGIVNENIVPEGYDFVFRPISANAKLVMNRRSDFDFSAPKINLEIELHNIAIEFNKPQYFSIMELLESVDMMAQNLPYRKFKPDVPLHHHAREWWAYAIHGVLEVNVCPRLWMWSWKHIRKHRQKVKQYKELYKKKLTSKKPPGELLVSLEELEKTLDVFNITIARQTAEVEVKKAGYKIYKEGVKDPEDNKGWFSWLWSWSEQNTNEQQPDVQPETLEEMLTPEEKALLYEAIGYSETAVDPTLLKTFEALKFFVHLKSMSIVLRENHQKPELVDIVIEEFSTLIVQRPGAQAIKFETKIDSFHITGLPDNSEKPRLLSSLDDAMSLFQITFEINPLDETVSQRCIIEAEPLEIIYDARTVNSIVEFFRPPKEVHLAQLTAATLTKLEEFRSKTATGLLYIIETQKVLDLKINLKASYIIVPQDGIFSPTSNLLLLDLGHLKVTSKSRSELPDVKQGEANLKEIMDRAYDSFDIQLTSVQLLYSRVGDNWREARKLSVSTQHILVPMHFNLELSKAMVFMDVRMPKFKIYGKLPLISLRISDKKLQGIMELIESIPKPEPVTEVSAPVKSFQIQTSTSLGTSQISQKIIPLLELPSVSEDDSEEEFFDAPCSPLEEPLQFPTGVKSIRTRKLQKQDCSVNMTTFKIRFEVPKVLIEFYHLVGDCELSVVEILVLGLGAEIEIRTYDLKANAFLKEFCLKCPEYLDENKKPVYLVTTLDNTMEDLLTLEYVKAEKNVPDLKSTYNNVLQLIKVNFSSLDIHLHTEALLNTINYLHNILPQSEEKSAPVSTTETEDKGDVIKKLGLDSEMIMRPSETEINAKLRNIIVLDSDITAIYKKAVYITGKEVFSFKMVSYMDATAGSAYTDMNVVDIQVNLIVGCIEVVFVTKFLYSILAFIDNFQAAKQALAEATVQAAGMAATGVKELAQRSSRMALDINIKAPVVVIPQSPVSENVFVADFGLITMTNTFHMITESQSSPPPVIDLITIKLSEMRLYRSRFINDAYQEVLDLLLPLNLEVVVERNLCWEWYQEVPCFNVNAQLKPMEFILSQEDITTIFKTLHGNIWYEKDGSASPAVTKDQYSATSGVTTNASHHSGGATVVTAAVVEVHSRALLVKTTLNISFKTDDLTMVLYSPGPKQASFTDVRDPSLKLAEFKLENIISTLKMYTDGSTFSSFSLKNCILDDKRPHVKKATPRMIGLTVGFDKKDMMDIKYRKVRDGCVTDAVFQEMYICASVEFLQTVANVFLEAYTTGTAVETSVQTWTAKEEVPTQESVKWEINVIIKNPEIVFVADMTKNDAPALVITTQCEICYKGNLENSTMTAAIKDLQVRACPFLPVKRKGKITTVLQPCDLFYQTTQKGTDPQVIDMSVKSLTLKVSPVIINTMITITSALYTTKETIPEETASSTAHLWEKKDTKTLKMWFLEESNETEKIAPTTELVPKGEMIKMNIDSIFIVLEAGIGHRTVPMLLAKSRFSGEGKNWSSLINLHCQLELEVHYYNEMFGVWEPLLEPLEIDQTEDFRPWNLGIKMKKKAKMAIVESDPEEENYKVPEYKTVISFHSKDQLNITLSKCGLVMLNNLVKAFTEAATGSSADFVKDLAPFMILNSLGLTISVSPSDSFSVLNIPMAKSYVLKNGESLSMDYIRTKDNDHFNAMTSLSSKLFFILLTPVNHSTADKIPLTKVGRRLYTVRHRESGVERSIVCQIDTVEGSKKVTIRSPVQIRNHFSVPLSVYEGDTLLGTASPENEFNIPLGSYRSFIFLKPEDENYQMCEGIDFEEIIKNDGALLKKKCRSKNPSKESFLINIVPEKDNLTSLSVYSEDGWDLPYIMHLWPPILLRNLLPYKIAYYIEGIENSVFTLSEGHSAQICTAQLGKARLHLKLLDYLNHDWKSEYHIKPNQQDISFVSFTCVTEMEKTDLDIAVHMTYNTGQTVVAFHSPYWMVNKTGRMLQYKADGIHRKHPPNYKKPVLFSFQPNHFFNNNKVQLMVTDSELSNQFSIDTVGSHGAVKCKGLKMDYQVGVTIDLSSFNITRIVTFTPFYMIKNKSKYHISVAEEGNDKWLSLDLEQCIPFWPEYASSKLLIQVERSEDPPKRIYFNKQENCILLRLDNELGGIIAEVNLAEHSTVITFLDYHDGAATFLLINHTKNELVQYNQSSLSEIEDSLPPGKAVFYTWADPVGSRRLKWRCRKSHGEVTQKDDMMMPIDLGEKTIYLVSFFEGLQRIILFTEDPRVFKVTYESEKAELAEQEIAVALQDVGISLVNNYTKQEVAYIGITSSDVVWETKPKKKARWKPMSVKHTEKLEREFKEYTESSPSEDKVIQLDTNVPVRLTPTGHNMKILQPHVIALRRNYLPALKVEYNTSAHQSSFRIQIYRIQIQNQIHGAVFPFVFYPVKPPKSVTMDSAPKPFTDVSIVMRSAGHSQISRIKYFKVLIQEMDLRLDLGFIYALTDLMTEAEVTENTEVELFHKDIEAFKEEYKTASLVDQSQVSLYEYFHISPIKLHLSVSLSSGREEAKDSKQNGGLIPVHSLNLLLKSIGATLTDVQDVVFKLAFFELNYQFHTTSDLQSEVIRHYSKQAIKQMYVLILGLDVLGNPFGLIREFSEGVEAFFYEPYQGAIQGPEEFVEGMALGLKALVGGAVGGLAGAASKITGAMAKGVAAMTMDEDYQQKRREAMNKQPAGFREGITRGGKGLVSGFVSGITGIVTKPIKGAQKGGAAGFFKGVGKGLVGAVARPTGGIIDMASSTFQGIKRATETSEVESLRPPRFFNEDGVIRPYRLRDGTGNQMLQVMENGRFAKYKYFTHVMINKTDMLMITRRGVLFVTKGTFGQLTCEWQYSFDEFTKEPFIVHGRRLRIEAKERVKSVFHAREFGKIINFKTPEDARWILTKLQEAREPSPSL

SEQ ID NO: 96135 - protein, 110 aa, Homo sapiens
  Payload ID: 19190
  Gene Name: vacuolar protein sorting 13 homolog A (S. cerevisiae)
  ENSP ID: ENSP00000365834
MENGRFAKYKYFTHVMINKTDMLMITRRGVLFVTKGTFGQLTCEWQYSFDEFTKEPFIVHGRRLRIEAKERVKSVFHAREFGKIINFKTPEDARWILTKLQEAREPSPSL

SEQ ID NO: 96136 - protein, 383 aa, Homo sapiens
  Payload ID: 19190
  Gene Name: vacuolar protein sorting 13 homolog A (S. cerevisiae)
  ENSP ID: ENSP00000414410
  MOD_RES (1)..(1): Any amino acid
XSRFSGEGKNWSSLINLHCQLELEVHYYNEMFGVWEPLLEPLEIDQTEDFRPWNLGIKMKKKAKMAIVESDPEEENYKVPEYKTVISFHSKDQLNITLSKCGLVMLNNLVKAFTEAATGSSADFVKDLAPFMILNSLGLTISVSPSDSFSVLNIPMAKSYVLKNGESLSMDYIRTKDNDHFNAMTSLSSKLFFILLTPVNHSTADKIPLTKVGRRLYTVRHRESGVERSIVCQIDTVEGSKKVTIRSPVQIRNHFSVPLSVYEGDTLLGTASPENEFNIPLGSYRSFIFLKPEDENYQMCEGIDFEEIIKNDGALLKKKCRSKNPSKESFLINIVPEKDNLTSLSVYSEDGWDLPYIMHLWPPILLRNLLPYKIAYYIEVSAN

SEQ ID NO: 96137 - protein, 177 aa, Homo sapiens
  Payload ID: 19190
  Gene Name: vacuolar protein sorting 13 homolog A (S. cerevisiae)
  ENSP ID: ENSP00000437478
LYSILAFIDNFQAAKQALAEATVQAAGMAATGVKELAQRSSRMALDINIKAPVVVIPQSPVSENVFVADFGLITMTNTFHMITESQSSPPPVIDLITIKLSEMRLYRSRFINDAYQEVLDLLLPLNLEVVVERNLCWEWYQEVPCFNVNAQLKPMEVESIQNVLVMLPTICKCPAAF

SEQ ID NO: 96138 - protein, 41 aa, Homo sapiens
  Payload ID: 19190
  Gene Name: vacuolar protein sorting 13 homolog A (S. cerevisiae)
  ENSP ID: ENSP00000441840
  MOD_RES (1)..(1): Any amino acid
XLRIEAKERVKSVFHAREFGKIINFKTPEDARVNIINLLFK

SEQ ID NO: 96139 - protein, 110 aa, Homo sapiens; identical to SEQ ID NO: 96135
  Payload ID: 19190
  Gene Name: vacuolar protein sorting 13 homolog A (S. cerevisiae)
  ENSP ID: ENSP00000446020

SEQ ID NO: 96140 - protein, 863 aa, Homo sapiens
  Payload ID: 19191
  Gene Name: vacuolar protein sorting 13 homolog B (yeast)
  Uniprot ID: Q7Z7G8
  ENSP ID: ENSP00000347281
MLESYVTPILMSYVNRYIKNLKPSDLQLSLWGGDVVLSKLELKLDVLEQELKLPFTFLSGHIHELRIHVPWTKLGSEPVVITINTMECILKLKDGIQDDHESCGSNSTNRSTAESTKSSIKPRRMQQAAPTDPDLPPGYVQSLIRRVVNNVNIVINNLILKYVEDDIVLSVNITSAECYTVGELWDRAFMDISATDLVLRKVINFSDCTVCLDKRNASGKIEFYQDPLLYKCSFRTRLHFTYENLNSKMPSVIKIHTLVESLKLSITDQQLPMFIRIMQLGIALYYGEIGNFKEGEIEDLTCHNKDMLGNITGSEDETRIDMQYPAQHKGQELYSQQDEEQPQGWVSWAWSFVPAIVSYDDGEEDFVGNDPASTMHQQKAQTLKDPIVSIGFYCTKATVTFKLTEMQVESSYYSPQKVKSKEVLCWEQEGTTVEALMMGEPFFDCQIGFVGCRAMCLKGIMGVKDFEENMNRSETEACFFICGDNLSTKGFTYLTNSLFDYRSPENNGTRAEFILDSTHHKETYTEIAGMQRFGAFYMDYLYTMENTSGKGSTNQQDFSSGKSEDLGTVQEKSTKSLVIGPLDFRLDSSAVHRILKMIVCALEHEYEPYSRLKSDIKDENETILNPEEVALLEEYIPTRHTSVTLLKCTCTISMAEFNLLDHLLPVIMGEKNSSNFMNTTNFQSLRPLPSIRILVDKINLEHSVPMYAEQLVHVVSSLTQPSDNLLHYCYVHCYLKIFGFQAGLTSLDCSGSYCLPVPVIPSFSTALYGKLLKLPTCWTKRSQIAITEGIFELPNLTIQATRAQTLLLQAIYQSWSHLGNVSSSAVIEALINEIFLSIEIGSCYVAQVDLELLASNDPPTSTS

SEQ ID NO: 96141 - protein, 3997 aa, Homo sapiens
  Payload ID: 19191
  Gene Name: vacuolar protein sorting 13 homolog B (yeast)
  Uniprot ID: Q7Z7G8
  ENSP ID: ENSP00000349685
MLESYVTPILMSYVNRYIKNLKPSDLQLSLWGGDVVLSKLELKLDVLEQELKLPFTFLSGHIHELRIHVPWTKLGSEPVVITINTMECILKLKDGIQDDHESCGSNSTNRSTAESTKSSIKPRRMQQAAPTDPDLPPGYVQSLIRRVVNNVNIVINNLILKYVEDDIVLSVNITSAECYTVGELWDRAFMDISATDLVLRKVINFSDCTVCLDKRNASGKIEFYQDPLLYKCSFRTRLHFTYENLNSKMPSVIKIHTLVESLKLSITDQQLPMFIRIMQLGIALYYGEIGNFKEGEIEDLTCHNKDMLGNITGSEDETRIDMQYPAQHKGQELYSQQDEEQPQGWVSWAWSFVPAIVSYDDGEEDFVGNDPASTMHQQKAQTLKDPIVSIGFYCTKATVTFKLTEMQVESSYYSPQKVKSKEVLCWEQEGTTVEALMMGEPFFDCQIGFVGCRAMCLKGIMGVKDFEENMNRSETEACFFICGDNLSTKGFTYLTNSLFDYRSPENNGTRAEFILDSTHHKETYTEIAGMQRFGAFYMDYLYTMENTSGKGSTNQQDFSSGKSEDLGTVQEKSTKSLVIGPLDFRLDSSAVHRILKMIVCALEHEYEPYSRLKSDIKDENETILNPEEVALLEEYIPTRHTSVTLLKCTCTISMAEFNLLDHLLPVIMGEKNSSNFMNTTNFQSLRPLPSIRILVDKINLEHSVPMYAEQLVHVVSSLTQPSDNLLHYCYVHCYLKIFGFQAGLTSLDCSGSYCLPVPVIPSFSTALYGKLLKLPTCWTKRSQIAITEGIFELPNLTIQATRAQTLLLQAIYQSWSHLGNVSSSAVIEALINEIFLSIGVKSKNPLPTLEGSIQNVELKYCSTSLVKCASGTMGSIKICAKAPVDSGKEKLIPLLQGPSDTKDLHSTKWLNESRKPESLLAPDLMAFTIQVPQYIDYCHNSGAVLLCSIQGLAVNIDPILYTWLIYQPQKRTSRHMQQQPVVAVPLVMPVCRRKEDEVSIGSAPLAKQQSYQASEYASSPVKTKTVTESRPLSVPVKAMLNISESCRSPEERMKEFIGIVWNAVKHLTLQLEVQSCCVFIPNDSLPSPSTIVSGDIPGTVRSWYHGQTSMPGTLVLCLPQIKIISAGHKYMEPLQEIPFVIPRPILEEGDAFPWTISLHNFSIYTLLGKQVTLCLVEPMGCTSTLAVTSQKLLATGPDTRHSFVVCLHVDLESLEIKCSNPQVQLFYELTDIMNKVWNKIQKRGNLNLSPTSPETMAGPVPTSPVRSSIGTAPPDTSTCSPSADIGTTTEGDSIQAGEESPFSDSVTLEQTTSNIGGTSGRVSLWMQWVLPKITIKLFAPDPENKGTEVCMVSELEDLSASIDVQDVYTKVKCKIESFNIDHYRSRPGEGWQSGHFEGVFLQCKEKSVTTTKLLDGTHQQHGFLSLTYTKAVTKNVRHKLTSRNERRSFHKLSEGLMDGSPHFLHEILLSAQAFDIVLYFPLLNAIASIFQAKLPKTQKEKRKSPGQPMRTHTLTSRNLPLIYVNTSVIRIFIPKTEEMQPTVEANQAAKEDTVVLKIGSVAMAPQADNPLGRSVLRKDIYQRALNLGILRDPGSEIEDRQYQIDLQSINIGTAQWHQLKPEKESVSGGVVTETERNSQNPALEWNMASSIRRHQERRAILTPVLTDFSVRITGAPAVIFTKVVSPENLHTEEILVCGHSLEVNITTNLDFFLSVAQVQLLHQLIVANMTGLEPSNKAAEISKQEQKKVDIFDGGMAETSSRYSGAQDSGIGSDSVKIRIVQIEQHSGASQHRIARPSRQSSIVKNLNFIPFDIFITASRISLMTYSCMALSKSKSQEQKNNEKTDKSSLNLPEVDSDVAKPNQACISTVTAEDLLRSSISFPSGKKIGVLSLESLHASTRSSARQALGITIVRQPGRRGTGDLQLEPFLYFIVSQPSLLLSCHHRKQRVEVSIFDAVLKGVASDYKCIDPGKTLPEALDYCTVWLQTVPGEIDSKSGIPPSFITLQIKDFLNGPADVNLDISKPLKANLSFTKLDQINLFLKKIKNAHSLAHSEETSAMSNTMVNKDDLPVSKYYRGKLSKPKIHGDGVQKISAQENMWRAVSCFQKISVQTTQIVISMETVPHTSKPCLLASLSNLNGSLSVKATQKVPGIILGSSFLLSINDFLLKTSLKERSRILIGPCCATANLEAKWCKHSGNPGPEQSIPKISIDLRGGLLQVFWGQEHLNCLVLLHELLNGYLNEEGNFEVQVSEPVPQMSSPVEKNQTFKSEQSSDDLRTGLFQYVQDAESLKLPGVYEVLFYNETEDCPGMMLWRYPEPRVLTLVRITPVPFNTTEDPDISTADLGDVLQVPCSLEYWDELQKVFVAFREFNLSESKVCELQLPDINLVNDQKKLVSSDLWRIVLNSSQNGADDQSSASESGSQSTCDPLVTPTALAACTRVDSCFTPWFVPSLCVSFQFAHLEFHLCHHLDQLGTAAPQYLQPFVSDRNMPSELEYMIVSFREPHMYLRQWNNGSVCQEIQFLAQADCKLLECRNVTMQSVVKPFSIFGQMAVSSDVVEKLLDCTVIVDSVFVNLGQHVVHSLNTAIQAWQQNKCPEVEELVFSHFVICNDTQETLRFGQVDTDENILLASLHSHQYSWRSHKSPQLLHICIEGWGNWRWSEPFSVDHAGTFIRTIQYRGRTASLIIKVQQLNGVQKQIIICGRQIICSYLSQSIELKVVQHYIGQDGQAVVREHFDCLTAKQKLPSYILENNELTELCVKAKGDEDWSRDVCLESKAPEYSIVIQVPSSNSSIIYVWCTVLTLEPNSQVQQRMIVFSPLFIMRSHLPDPIIIHLEKRSLGLSETQIIPGKGQEKPLQNIEPDLVHHLTFQAREEYDPSDCAVPISTSLIKQIATKVHPGGTVNQILDEFYGPEKSLQPIWPYNKKDSDRNEQLSQWDSPMRVKLSIWKPYVRTLLIELLPWALLINESKWDLWLFEGEKIVLQVPAGKIIIPPNFQEAFQIGIYWANTNTVHKSVAIKLVHNLTSPKWKDGGNGEVVTLDEEAFVDTEIRLGAFPGHQKLCQFCISSMVQQGIQIIQIEDKTTIINNTPYQIFYKPQLSVCNPHSGKEYFRVPDSATFSICPGGEQPAMKSSSLPCWDLMPDISQSVLDASLLQKQIMLGFSPAPGADSSQCWSLPAIVRPEFPRQSVAVPLGNFRENGFCTRAIVLTYQEHLGVTYLTLSEDPSPRVIIHNRCPVKMLIKENIKDIPKFEVYCKKIPSECSIHHELYHQISSYPDCKTKDLLPSLLLRVEPLDEVTTEWSDAIDINSQGTQVVFLTGFGYVYVDVVHQCGTVFITVAPEGKAGPILTNTNRAPEKIVTFKMFITQLSLAVFDDLTHHKASAELLRLTLDNIFLCVAPGAGPLPGEEPVAALFELYCVEICCGDLQLDNQLYNKSNFHFAVLVCQGEKAEPIQCSKMQSLLISNKELEEYKEKCFIKLCITLNEGKSILCDINEFSFELKPARLYVEDTFVYYIKTLFDTYLPNSRLAGHSTHLSGGKQVLPMQVTQHARALVNPVKLRKLVIQPVNLLVSIHASLKLYIASDHTPLSFSVFERGPIFTTARQLVHALAMHYAAGALFRAGWVVGSLDILGSPASLVRSIGNGVADFFRLPYEGLTRGPGAFVSGVSRGTTSFVKHISKGTLTSITNLATSLARNMDRLSLDEEHYNRQEEWRRQLPESLGEGLRQGLSRLGISLLGAIAGIVDQPMQNFQKTSEAQASAGHKAKGVISGVGKGIMGVFTKPIGGAAELVSQTGYGILHGAGLSQLPKQRHQPSDLHADQAPNSHVKYVWKMLQSLGRPEVHMALDVVLVRGSGQEHEGCLLLTSEVLFVVSVSEDTQQQAFPVTEIDCAQDSKQNNLLTVQLKQPRVACDVEVDGVRERLSEQQYNRLVDYITKTSCHLAPSCSSMQIPCPVVAAEPPPSTVKTYHYLVDPHFAQVFLSKFTMVKNKALRKGFP

SEQ ID NO: 96142 - protein, 4022 aa, Homo sapiens
  Payload ID: 19191
  Gene Name: vacuolar protein sorting 13 homolog B (yeast)
  Uniprot ID: Q7Z7G8
  ENSP ID: ENSP00000351346
MLESYVTPILMSYVNRYIKNLKPSDLQLSLWGGDVVLSKLELKLDVLEQELKLPFTFLSGHIHELRIHVPWTKLGSEPVVITINTMECILKLKDGIQDDHESCGSNSTNRSTAESTKSSIKPRRMQQAAPTDPDLPPGYVQSLIRRVVNNVNIVINNLILKYVEDDIVLSVNITSAECYTVGELWDRAFMDISATDLVLRKVINFSDCTVCLDKRNASGKIEFYQDPLLYKCSFRTRLHFTYENLNSKMPSVIKIHTLVESLKLSITDQQLPMFIRIMQLGIALYYGEIGNFKEGEIEDLTCHNKDMLGNITGSEDETRIDMQYPAQHKGQELYSQQDEEQPQGWVSWAWSFVPAIVSYDDGEEDFVGNDPASTMHQQKAQTLKDPIVSIGFYCTKATVTFKLTEMQVESSYYSPQKVKSKEVLCWEQEGTTVEALMMGEPFFDCQIGFVGCRAMCLKGIMGVKDFEENMNRSETEACFFICGDNLSTKGFTYLTNSLFDYRSPENNGTRAEFILDSTHHKETYTEIAGMQRFGAFYMDYLYTMENTSGKGSTNQQDFSSGKSEDLGTVQEKSTKSLVIGPLDFRLDSSAVHRILKMIVCALEHEYEPYSRLKSDIKDENETILNPEEVALLEEYIPTRHTSVTLLKCTCTISMAEFNLLDHLLPVIMGEKNSSNFMNTTNFQSLRPLPSIRILVDKINLEHSVPMYAEQLVHVVSSLTQPSDNLLHYCYVHCYLKIFGFQAGLTSLDCSGSYCLPVPVIPSFSTALYGKLLKLPTCWTKRSQIAITEGIFELPNLTIQATRAQTLLLQAIYQSWSHLGNVSSSAVIEALINEIFLSIGVKSKNPLPTLEGSIQNVELKYCSTSLVKCASGTMGSIKICAKAPVDSGKEKLIPLLQGPSDTKDLHSTKWLNESRKPESLLAPDLMAFTIQVPQYIDYCHNSGAVLLCSIQGLAVNIDPILYTWLIYQPQKRTSRHMQQQPVVAVPLVMPVCRRKEDEVSIGSAPLAKQQSYQASEYASSPVKTKTVTESRPLSVPVKAMLNISESCRSPEERMKEFIGIVWNAVKHLTLQLEVQSCCVFIPNDSLPSPSTIVSGDIPGTVRSWYHGQTSMPGTLVLCLPQIKIISAGHKYMEPLQEIPFVIPRPILEEGDAFPWTISLHNFSIYTLLGKQVTLCLVEPMGCTSTLAVTSQKLLATGPDTRHSFVVCLHVDLESLEIKCSNPQVQLFYELTDIMNKVWNKIQKRGNLNLSPTSPETMAGPVPTSPVRSSIGTAPPDTSTCSPSADIGTTTEGDSIQAGEESPFSDSVTLEQTTSNIGGTSGRVSLWMQWVLPKITIKLFAPDPENKGTEVCMVSELEDLSASIDVQDVYTKVKCKIESFNIDHYRSSLGEECWSLGQCGGVFLSCTDKLNRRTLLVRPISKQDPFSNCSGFFPSTTTKLLDGTHQQHGFLSLTYTKAVTKNVRHKLTSRNERRSFHKLSEGLMDGSPHFLHEILLSAQAFDIVLYFPLLNAIASIFQAKLPKTQKEKRKSPGQPMRTHTLTSRNLPLIYVNTSVIRIFIPKTEEMQPTVEANQAAKEDTVVLKIGSVAMAPQADNPLGRSVLRKDIYQRALNLGILRDPGSEIEDRQYQIDLQSINIGTAQWHQLKPEKESVSGGVVTETERNSQNPALEWNMASSIRRHQERRAILTPVLTDFSVRITGAPAVIFTKVVSPENLHTEEILVCGHSLEVNITTNLDFFLSVAQVQLLHQLIVANMTGLEPSNKAAEISKQEQKKVDIFDGGMAETSSRYSGAQDSGIGSDSVKIRIVQIEQHSGASQHRIARPSRQSSIVKNLNFIPFDIFITASRISLMTYSCMALSKSKSQEQKNNEKTDKSSLNLPEVDSDVAKPNQACISTVTAEDLLRSSISFPSGKKIGVLSLESLHASTRSSARQALGITIVRQPGRRGTGDLQLEPFLYFIVSQPSLLLSCHHRKQRVEVSIFDAVLKGVASDYKCIDPGKTLPEALDYCTVWLQTVPGEIDSKSGIPPSFITLQIKDFLNGPADVNLDISKPLKANLSFTKLDQINLFLKKIKNAHSLAHSEETSAMSNTMVNKDDLPVSKYYRGKLSKPKIHGDGVQKISAQENMWRAVSCFQKISVQTTQIVISMETVPHTSKPCLLASLSNLNGSLSVKATQKVPGIILGSSFLLSINDFLLKTSLKERSRILIGPCCATANLEAKWCKHSGNPGPEQSIPKISIDLRGGLLQVFWGQEHLNCLVLLHELLNGYLNEEGNFEVQVSEPVPQMSSPVEKNQTFKSEQSSDDLRTGLFQYVQDAESLKLPGVYEVLFYNETEDCPGMMLWRYPEPRVLTLVRITPVPFNTTEDPDISTADLGDVLQVPCSLEYWDELQKVFVAFREFNLSESKVCELQLPDINLVNDQKKLVSSDLWRIVLNSSQNGADDQSSASESGSQSTCDPLVTPTALAACTRVDSCFTPWFVPSLCVSFQFAHLEFHLCHHLDQLGTAAPQYLQPFVSDRNMPSELEYMIVSFREPHMYLRQWNNGSVCQEIQFLAQADCKLLECRNVTMQSVVKPFSIFGQMAVSSDVVEKLLDCTVIVDSVFVNLGQHVVHSLNTAIQAWQQNKCPEVEELVFSHFVICNDTQETLRFGQVDTDENILLASLHSHQYSWRSHKSPQLLHICIEGWGNWRWSEPFSVDHAGTFIRTIQYRGRTASLIIKVQQLNGVQKQIIICGRQIICSYLSQSIELKVVQHYIGQDGQAVVREHFDCLTAKQKLPSYILENNELTELCVKAKGDEDWSRDVCLESKAPEYSIVIQVPSSNSSIIYVWCTVLTLEPNSQVQQRMIVFSPLFIMRSHLPDPIIIHLEKRSLGLSETQIIPGKGQEKPLQNIEPDLVHHLTFQAREEYDPSDCAVPISTSLIKQIATKVHPGGTVNQILDEFYGPEKSLQPIWPYNKKDSDRNEQLSQWDSPMRVKLSIWKPYVRTLLIELLPWALLINESKWDLWLFEGEKIVLQVPAGKIIIPPNFQEAFQIGIYWANTNTVHKSVAIKLVHNLTSPKWKDGGNGEVVTLDEEAFVDTEIRLGAFPGHQKLCQFCISSMVQQGIQIIQIEDKTTIINNTPYQIFYKPQLSVCNPHSGKEYFRVPDSATFSICPGGEQPAMKSSSLPCWDLMPDISQSVLDASLLQKQIMLGFSPAPGADSSQCWSLPAIVRPEFPRQSVAVPLGNFRENGFCTRAIVLTYQEHLGVTYLTLSEDPSPRVIIHNRCPVKMLIKENIKDIPKFEVYCKKIPSECSIHHELYHQISSYPDCKTKDLLPSLLLRVEPLDEVTTEWSDAIDINSQGTQVVFLTGFGYVYVDVVHQCGTVFITVAPEGKAGPILTNTNRAPEKIVTFKMFITQLSLAVFDDLTHHKASAELLRLTLDNIFLCVAPGAGPLPGEEPVAALFELYCVEICCGDLQLDNQLYNKSNFHFAVLVCQGEKAEPIQCSKMQSLLISNKELEEYKEKCFIKLCITLNEGKSILCDINEFSFELKPARLYVEDTFVYYIKTLFDTYLPNSRLAGHSTHLSGGKQVLPMQVTQHARALVNPVKLRKLVIQPVNLLVSIHASLKLYIASDHTPLSFSVFERGPIFTTARQLVHALAMHYAAGALFRAGWVVGSLDILGSPASLVRSIGNGVADFFRLPYEGLTRGPGAFVSGVSRGTTSFVKHISKGTLTSITNLATSLARNMDRLSLDEEHYNRQEEWRRQLPESLGEGLRQGLSRLGISLLGAIAGIVDQPMQNFQKTSEAQASAGHKAKGVISGVGKGIMGVFTKPIGGAAELVSQTGYGILHGAGLSQLPKQRHQPSDLHADQAPNSHVKYVWKMLQSLGRPEVHMALDVVLVRGSGQEHEGCLLLTSEVLFVVSVSEDTQQQAFPVTEIDCAQDSKQNNLLTVQLKQPRVACDVEVDGVRERLSEQQYNRLVDYITKTSCHLAPSCSSMQIPCPVVAAEPPPSTVKTYHYLVDPHFAQVFLSKFTMVKNKALRKGFP

SEQ ID NO: 96143 - protein, 415 aa, Homo sapiens
  Payload ID: 19191
  Gene Name: vacuolar protein sorting 13 homolog B (yeast)
  Uniprot ID: Q7Z7G8
  ENSP ID: ENSP00000398472
MLESYVTPILMSYVNRYIKNLKPSDLQLSLWGGDVVLSKLELKLDVLEQELKLPFTFLSGHIHELRIHVPWTKLGSEPVVITINTMECILKLKDGIQDDHESCGSNSTNRSTAESTKSSIKPRRMQQAAPTDPDLPPGYVQSLIRRVVNNVNIVINNLILKYVEDDIVLSVNITSAECYTVGELWDRAFMDISATDLVLRKVINFSDCTVCLDKRNASGKIEFYQDPLLYKCSFRTRLHFTYENLNSKMPSVIKIHTLVESLKLSITDQQLPMFIRIMQLGIALYYGEIGNFKEGEIEDLTCHNKDMLGNITGSEDETRIDMQYPAQHKGQELYSQQDEEQPQGWVSWAWSFVPAIVSYDDGEEDFVGNDPASTMHQQKAQTLKDPIVSIGFYCTKATVTFKVGLFSCCLYLYQL

SEQ ID NO: 96144 - protein, 155 aa, Homo sapiens
  Payload ID: 19191
  Gene Name: vacuolar protein sorting 13 homolog B (yeast)
  ENSP ID: ENSP00000428809
  MOD_RES (1)..(1): Any amino acid
XNQAAKEDTVVLKIGSVAMAPQADNPLGRSVLRKDIYHIRRHQERRAILTPVLTDFSVRITGAPAVIFTKVVSPENLHTEEILVCGHSLEVNITTNLDFFLSVAQVQLLHQLIVANMTGLEPSNKAAEISKQEQKKVDIFDGGMAETSSRYSGAQ

SEQ ID NO: 96145 - protein, 1427 aa, Homo sapiens
  Payload ID: 19191
  Gene Name: vacuolar protein sorting 13 homolog B (yeast)
  Uniprot ID: Q7Z7G8
  ENSP ID: ENSP00000430900
MLESYVTPILMSYVNRYIKNLKPSDLQLSLWGGDVVLSKLELKLDVLEQELKLPFTFLSGHIHELRIHVPWTKLGSEPVVITINTMECILKLKDGIQDDHESCGSNSTNRSTAESTKSSIKPRRMQQAAPTDPDLPPGYVQSLIRRVVNNVNIVINNLILKYVEDDIVLSVNITSAECYTVGELWDRAFMDISATDLVLRKVINFSDCTVCLDKRNASGKIEFYQDPLLYKCSFRTRLHFTYENLNSKMPSVIKIHTLVESLKLSITDQQLPMFIRIMQLGIALYYGEIGNFKEGEIEDLTCHNKDMLGNITGSEDETRIDMQYPAQHKGQELYSQQDEEQPQGWVSWAWSFVPAIVSYDDGEEDFVGNDPASTMHQQKAQTLKDPIVSIGFYCTKATVTFKLTEMQVESSYYSPQKVKSKEVLCWEQEGTTVEALMMGEPFFDCQIGFVGCRAMCLKGIMGVKDFEENMNRSETEACFFICGDNLSTKGFTYLTNSLFDYRSPENNGTRAEFILDSTHHKETYTEIAGMQRFGAFYMDYLYTMENTSGKGSTNQQDFSSGKSEDLGTVQEKSTKSLVIGPLDFRLDSSAVHRILKMIVCALEHEYEPYSRLKSDIKDENETILNPEEVALLEEYIPTRHTSVTLLKCTCTISMAEFNLLDHLLPVIMGEKNSSNFMNTTNFQSLRPLPSIRILVDKINLEHSVPMYAEQLVHVVSSLTQPSDNLLHYCYVHCYLKIFGFQAGLTSLDCSGSYCLPVPVIPSFSTALYGKLLKLPTCWTKRSQIAITEGIFELPNLTIQATRAQTLLLQAIYQSWSHLGNVSSSAVIEALINEIFLSIGVKSKNPLPTLEGSIQNVELKYCSTSLVKCASGTMGSIKICAKAPVDSGKEKLIPLLQGPSDTKDLHSTKWLNESRKPESLLAPDLMAFTIQVPQYIDYCHNSGAVLLCSIQGLAVNIDPILYTWLIYQPQKRTSRHMQQQPVVAVPLVMPVCRRKEDEVSIGSAPLAKQQSYQASEYASSPVKTKTVTESRPLSVPVKAMLNISESCRSPEERMKEFIGIVWNAVKHLTLQLEVQSCCVFIPNDSLPSPSTIVSGDIPGTVRSWYHGQTSMPGTLVLCLPQIKIISAGHKYMEPLQEIPFVIPRPILEEGDAFPWTISLHNFSIYTLLGKQVTLCLVEPMGCTSTLAVTSQKLLATGPDTRHSFVVCLHVDLESLEIKCSNPQVQLFYELTDIMNKVWNKIQKRGNLNLSPTSPETMAGPVPTSPVRSSIGTAPPDTSTCSPSADIGTTTEGDSIQAGEESPFSDSVTLEQTTSNIGGTSGRVSLWMQWVLPKITIKLFAPDPENKGTEVCMVSELEDLSASIDVQDVYTKVKCKIESFNIDHYRSRPGEGWQSGHFEGVFLQCKEKSVPWGRVLVFGAMWRCLPFLY

SEQ ID NO: 96146 - protein, 3710 aa, Homo sapiens
  Payload ID: 19192
  Gene Name: vacuolar protein sorting 13 homolog C (S. cerevisiae)
  Uniprot ID: Q709C8
  ENSP ID: ENSP00000249837
MVLESVVADLLNRFLGDYVENLNKSQLKLGIWGGNVALDNLQIKENALSELDVPFKVKAGQIDKLTLKIPWKNLYGEAVVATLEGLYLLVVPGASIKYDAVKEEKSLQDVKQKELSRIEEALQKAAEKDKPKEAKKDTFVEKLATQVIKNVQVKITDIHIKYEDDVTDPKRPLSFGVTLGELSLLTANEHWTPCILNEADKIIYKLIRLDSLSAYWNVNCSMSYQRSREQILDQLKNEILTSGNIPPNYQYIFQPISASAKLYMNPYAESELKTPKLDCNIEIQNIAIELTKPQYLSMIDLLESVDYMVRNAPYRKYKPYLPLHTNGRRWWKYAIDSVLEVHIRRYTQMWSWSNIKKHRQLLKSYKIAYKNKLTQSKVSEEIQKEIQDLEKTLDVFNIILARQQAQVEVIRSGQKLRKKSADTGEKRGGWFSGLWGKKESKKKDEESLIPETIDDLMTPEEKDKLFTAIGYSESTHNLTLPKQYVAHIMTLKLVSTSVTIRENKNIPEILKIQIIGLGTQVSQRPGAQALKVEAKLEHWYITGLRQQDIVPSLVASIGDTTSSLLKIKFETNPEDSPADQTLIVQSQPVEVIYDAKTVNAVVEFFQSNKGLDLEQITSATLMKLEEIKERTATGLTHIIETRKVLDLRINLKPSYLVVPQTGFHHEKSDLLILDFGTFQLNSKDQGLQKTTNSSLEEIMDKAYDKFDVEIKNVQLLFARAEETWKKCRFQHPSTMHILQPMDIHVELAKAMVEKDIRMARFKVSGGLPLMHVRISDQKMKDVLYLMNSIPLPQKSSAQSPERQVSSIPIISGGTKGLLGTSLLLDTVESESDDEYFDAEDGEPQTCKSMKGSELKKAAEVPNEELINLLLKFEIKEVILEFTKQQKEEDTILVFNVTQLGTEATMRTFDLTVVSYLKKISLDYHEIEGSKRKPLHLISSSDKPGLDLLKVEYIKADKNGPSFQTAFGKTEQTVKVAFSSLNLLLQTQALVASINYLTTIIPSDDQSISVAKEVQISTEKQQKNSTLPKAIVSSRDSDIIDFRLFAKLNAFCVIVCNEKNNIAEIKIQGLDSSLSLQSRKQSLFARLENIIVTDVDPKTVHKKAVSIMGNEVFRFNLDLYPDATEGDLYTDMSKVDGVLSLNVGCIQIVYLHKFLMSLLNFLNNFQTAKESLSAATAQAAERAATSVKDLAQRSFRVSINIDLKAPVIVIPQSSISTNAVVVDLGLIRVHNQFSLVSDEDYLNPPVIDRMDVQLTKLTLYRTVIQPGIYHPDIQLLHPINLEFLVNRNLAASWYHKVPVVEIKGHLDSMNVSLNQEDLNLLFRILTENLCEGTEDLDKVKPRVQETGEIKEPLEISISQDVHDSKNTLTTGVEEIRSVDIINMLLNFEIKEVVVTLMKKSEKKGRPLHELNVLQLGMEAKVKTYDMTAKAYLKKISMQCFDFTDSKGEPLHIINSSNVTDEPLLKMLLTKADSDGPEFKTIHDSTKQRLKVSFASLDLVLHLEALLSFMDFLSSAAPFSEPSSSEKESELKPLVGESRSIAVKAVSSNISQKDVFDLKITAELNAFNVFVCDQKCNIADIKIHGMDASISVKPKQTDVFARLKDIIVMNVDLQSIHKKAVSILGDEVFRFQLTLYPDATEGEAYADMSKVDGKLSFKVGCIQIVYVHKFFMSLLNFLNNFQTAKEALSTATVQAAERAASSMKDLAQKSFRLLMDINLKAPVIIIPQSSVSPNAVIADLGLIRVENKFSLVPMEHYSLPPVIDKMNIELTQLKLSRTILQASLPQNDIEILKPVNMLLSIQRNLAAAWYVQIPGMEIKGKLKPMQVALSEDDLTVLMKILLENLGEASSQPSPTQSVQETVRVRKVDVSSVPDHLKEQEDWTDSKLSMNQIVSLQFDFHFESLSIILYNNDINQESGVAFHNDSFQLGELRLHLMASSGKMFKDGSMNVSVKLKTCTLDDLREGIERATSRMIDRKNDQDNNSSMIDISYKQDKNGSQIDAVLDKLYVCASVEFLMTVADFFIKAVPQSPENVAKETQILPRQTATGKVKIEKDDSVRPNMTLKAMITDPEVVFVASLTKADAPALTASFQCNLSLSTSKLEQMMEASVRDLKVLACPFLREKRGKNITTVLQPCSLFMEKCTWASGKQNINIMVKEFIIKISPIILNTVLTIMAALSPKTKEDGSKDTSKEMENLWGIKSINDYNTWFLGVDTATEITESFKGIEHSLIEENCGVVVESIQVTLECGLGHRTVPLLLAESKFSGNIKNWTSLMAAVADVTLQVHYYNEIHAVWEPLIERVEGKRQWNLRLDVKKNPVQDKSLLPGDDFIPEPQMAIHISSGNTMNITISKSCLNVFNNLAKGFSEGTASTFDYSLKDRAPFTVKNAVGVPIKVKPNCNLRVMGFPEKSDIFDVDAGQNLELEYASMVPSSQGNLSILSRQESSFFTLTIVPHGYTEVANIPVARPGRRLYNVRNPNASHSDSVLVQIDATEGNKVITLRSPLQIKNHFSIAFIIYKFVKNVKLLERIGIARPEEEFHVPLDSYRCQLFIQPAGILEHQYKESTTYISWKEELHRSREVRCMLQCPSVEVSFLPLIVNTVALPDELSYICTHGEDWDVAYIIHLYPSLTLRNLLPYSLRYLLEGTAETHELAEGSTADVLHSRISGEIMELVLVKYQGKNWNGHFRIRDTLPEFFPVCFSSDSTEVTTVDLSVHVRRIGSRMVLSVFSPYWLINKTTRVLQYRSEDIHVKHPADFRDIILFSFKKKNIFTKNKVQLKISTSAWSSSFSLDTVGSYGCVKCPANNMEYLVGVSIKMSSFNLSRIVTLTPFCTIANKSSLELEVGEIASDGSMPTNKWNYIASSECLPFWPESLSGKLCVRVVGCEGSSKPFFYNRQDNGTLLSLEDLNGGILVDVNTAEHSTVITFSDYHEGSAPALIMNHTPWDILTYKQSGSPEEMVLLPRQARLFAWADPTGTRKLTWTYAANVGEHDLLKDGCGQFPYDANIQIHWVSFLDGRQRVLLFTDDVALVSKALQAEEMEQADYEITLSLHSLGLSLVNNESKQEVSYIGITSSGVVWEVKPKQKWKPFSQKQIILLEQSYQKHQISRDHGWIKLDNNFEVNFDKDPMEMRLPIRSPIKRDFLSGIQIEFKQSSHQRSLRARLYWLQVDNQLPGAMFPVVFHPVAPPKSIALDSEPKPFIDVSVITRFNEYSKVLQFKYFMVLIQEMALKIDQGFLGAIIALFTPTTDPEAERRRTKLIQQDIDALNAELMETSMTDMSILSFFEHFHISPVKLHLSLSLGSGGEESDKEKQEMFAVHSVNLLLKSIGATLTDVDDLIFKLAYYEIRYQFYKRDQLIWSVVRHYSEQFLKQMYVLVLGLDVLGNPFGLIRGLSEGVEALFYEPFQGAVQGPEEFAEGLVIGVRSLFGHTVGGAAGVVSRITGSVGKGLAAITMDKEYQQKRREELSRQPRDFGDSLARGGKGFLRGVVGGVTGIITKPVEGAKKEGAAGFFKGIGKGLVGAVARPTGGIVDMASSTFQGIQRAAESTEEVSSLRPPRLIHEDGIIRPYDRQESEGSDLLENHIKKLEGETYRYHCAIPGSKKTILMVTNRRVLCIKEVEILGLMCVDWQCPFEDFVFPPSVSENVLKISVKEQGLFHKKDSANQGCVRKVYLKDTATAERACNAIEDAQSTRQQQKLMKQSSVRLLRPQLPS

SEQ ID NO: 96147 - protein, 3753 aa, Homo sapiens
  Payload ID: 19192
  Gene Name: vacuolar protein sorting 13 homolog C (S. cerevisiae)
  Uniprot ID: Q709C8
  ENSP ID: ENSP00000261517
MVLESVVADLLNRFLGDYVENLNKSQLKLGIWGGNVALDNLQIKENALSELDVPFKVKAGQIDKLTLKIPWKNLYGEAVVATLEGLYLLVVPGASIKYDAVKEEKSLQDVKQKELSRIEEALQKAAEKGTHSGEFIYGLENFVYKDIKPGRKRKKHKKHFKKPFKGLDRSKDKPKEAKKDTFVEKLATQVIKNVQVKITDIHIKYEDDVTDPKRPLSFGVTLGELSLLTANEHWTPCILNEADKIIYKLIRLDSLSAYWNVNCSMSYQRSREQILDQLKNEILTSGNIPPNYQYIFQPISASAKLYMNPYAESELKTPKLDCNIEIQNIAIELTKPQYLSMIDLLESVDYMVRNAPYRKYKPYLPLHTNGRRWWKYAIDSVLEVHIRRYTQMWSWSNIKKHRQLLKSYKIAYKNKLTQSKVSEEIQKEIQDLEKTLDVFNIILARQQAQVEVIRSGQKLRKKSADTGEKRGGWFSGLWGKKESKKKDEESLIPETIDDLMTPEEKDKLFTAIGYSESTHNLTLPKQYVAHIMTLKLVSTSVTIRENKNIPEILKIQIIGLGTQVSQRPGAQALKVEAKLEHWYITGLRQQDIVPSLVASIGDTTSSLLKIKFETNPEDSPADQTLIVQSQPVEVIYDAKTVNAVVEFFQSNKGLDLEQITSATLMKLEEIKERTATGLTHIIETRKVLDLRINLKPSYLVVPQTGFHHEKSDLLILDFGTFQLNSKDQGLQKTTNSSLEEIMDKAYDKFDVEIKNVQLLFARAEETWKKCRFQHPSTMHILQPMDIHVELAKAMVEKDIRMARFKVSGGLPLMHVRISDQKMKDVLYLMNSIPLPQKSSAQSPERQVSSIPIISGGTKGLLGTSLLLDTVESESDDEYFDAEDGEPQTCKSMKGSELKKAAEVPNEELINLLLKFEIKEVILEFTKQQKEEDTILVFNVTQLGTEATMRTFDLTVVSYLKKISLDYHEIEGSKRKPLHLISSSDKPGLDLLKVEYIKADKNGPSFQTAFGKTEQTVKVAFSSLNLLLQTQALVASINYLTTIIPSDDQSISVAKEVQISTEKQQKNSTLPKAIVSSRDSDIIDFRLFAKLNAFCVIVCNEKNNIAEIKIQGLDSSLSLQSRKQSLFARLENIIVTDVDPKTVHKKAVSIMGNEVFRFNLDLYPDATEGDLYTDMSKVDGVLSLNVGCIQIVYLHKFLMSLLNFLNNFQTAKESLSAATAQAAERAATSVKDLAQRSFRVSINIDLKAPVIVIPQSSISTNAVVVDLGLIRVHNQFSLVSDEDYLNPPVIDRMDVQLTKLTLYRTVIQPGIYHPDIQLLHPINLEFLVNRNLAASWYHKVPVVEIKGHLDSMNVSLNQEDLNLLFRILTENLCEGTEDLDKVKPRVQETGEIKEPLEISISQDVHDSKNTLTTGVEEIRSVDIINMLLNFEIKEVVVTLMKKSEKKGRPLHELNVLQLGMEAKVKTYDMTAKAYLKKISMQCFDFTDSKGEPLHIINSSNVTDEPLLKMLLTKADSDGPEFKTIHDSTKQRLKVSFASLDLVLHLEALLSFMDFLSSAAPFSEPSSSEKESELKPLVGESRSIAVKAVSSNISQKDVFDLKITAELNAFNVFVCDQKCNIADIKIHGMDASISVKPKQTDVFARLKDIIVMNVDLQSIHKKAVSILGDEVFRFQLTLYPDATEGEAYADMSKVDGKLSFKVGCIQIVYVHKFFMSLLNFLNNFQTAKEALSTATVQAAERAASSMKDLAQKSFRLLMDINLKAPVIIIPQSSVSPNAVIADLGLIRVENKFSLVPMEHYSLPPVIDKMNIELTQLKLSRTILQASLPQNDIEILKPVNMLLSIQRNLAAAWYVQIPGMEIKGKLKPMQVALSEDDLTVLMKILLENLGEASSQPSPTQSVQETVRVRKVDVSSVPDHLKEQEDWTDSKLSMNQIVSLQFDFHFESLSIILYNNDINQESGVAFHNDSFQLGELRLHLMASSGKMFKDGSMNVSVKLKTCTLDDLREGIERATSRMIDRKNDQDNNSSMIDISYKQDKNGSQIDAVLDKLYVCASVEFLMTVADFFIKAVPQSPENVAKETQILPRQTATGKVKIEKDDSVRPNMTLKAMITDPEVVFVASLTKADAPALTASFQCNLSLSTSKLEQMMEASVRDLKVLACPFLREKRGKNITTVLQPCSLFMEKCTWASGKQNINIMVKEFIIKISPIILNTVLTIMAALSPKTKEDGSKDTSKEMENLWGIKSINDYNTWFLGVDTATEITESFKGIEHSLIEENCGVVVESIQVTLECGLGHRTVPLLLAESKFSGNIKNWTSLMAAVADVTLQVHYYNEIHAVWEPLIERVEGKRQWNLRLDVKKNPVQDKSLLPGDDFIPEPQMAIHISSGNTMNITISKSCLNVFNNLAKGFSEGTASTFDYSLKDRAPFTVKNAVGVPIKVKPNCNLRVMGFPEKSDIFDVDAGQNLELEYASMVPSSQGNLSILSRQESSFFTLTIVPHGYTEVANIPVARPGRRLYNVRNPNASHSDSVLVQIDATEGNKVITLRSPLQIKNHFSIAFIIYKFVKNVKLLERIGIARPEEEFHVPLDSYRCQLFIQPAGILEHQYKESTTYISWKEELHRSREVRCMLQCPSVEVSFLPLIVNTVALPDELSYICTHGEDWDVAYIIHLYPSLTLRNLLPYSLRYLLEGTAETHELAEGSTADVLHSRISGEIMELVLVKYQGKNWNGHFRIRDTLPEFFPVCFSSDSTEVTTVDLSVHVRRIGSRMVLSVFSPYWLINKTTRVLQYRSEDIHVKHPADFRDIILFSFKKKNIFTKNKVQLKISTSAWSSSFSLDTVGSYGCVKCPANNMEYLVGVSIKMSSFNLSRIVTLTPFCTIANKSSLELEVGEIASDGSMPTNKWNYIASSECLPFWPESLSGKLCVRVVGCEGSSKPFFYNRQDNGTLLSLEDLNGGILVDVNTAEHSTVITFSDYHEGSAPALIMNHTPWDILTYKQSGSPEEMVLLPRQARLFAWADPTGTRKLTWTYAANVGEHDLLKDGCGQFPYDANIQIHWVSFLDGRQRVLLFTDDVALVSKALQAEEMEQADYEITLSLHSLGLSLVNNESKQEVSYIGITSSGVVWEVKPKQKWKPFSQKQIILLEQSYQKHQISRDHGWIKLDNNFEVNFDKDPMEMRLPIRSPIKRDFLSGIQIEFKQSSHQRSLRARLYWLQVDNQLPGAMFPVVFHPVAPPKSIALDSEPKPFIDVSVITRFNEYSKVLQFKYFMVLIQEMALKIDQGFLGAIIALFTPTTDPEAERRRTKLIQQDIDALNAELMETSMTDMSILSFFEHFHISPVKLHLSLSLGSGGEESDKEKQEMFAVHSVNLLLKSIGATLTDVDDLIFKLAYYEIRYQFYKRDQLIWSVVRHYSEQFLKQMYVLVLGLDVLGNPFGLIRGLSEGVEALFYEPFQGAVQGPEEFAEGLVIGVRSLFGHTVGGAAGVVSRITGSVGKGLAAITMDKEYQQKRREELSRQPRDFGDSLARGGKGFLRGVVGGVTGIITKPVEGAKKEGAAGFFKGIGKGLVGAVARPTGGIVDMASSTFQGIQRAAESTEEVSSLRPPRLIHEDGIIRPYDRQESEGSDLLENHIKKLEGETYRYHCAIPGSKKTILMVTNRRVLCIKEVEILGLMCVDWQCPFEDFVFPPSVSENVLKISVKEQGLFHKKDSANQGCVRKVYLKDTATAERACNAIEDAQSTRQQQKLMKQSSVRLLRPQLPS

SEQ ID NO: 96148 - protein, 3628 aa, Homo sapiens
  Payload ID: 19192
  Gene Name: vacuolar protein sorting 13 homolog C (S. cerevisiae)
  Uniprot ID: Q709C8
  ENSP ID: ENSP00000379233
MVLESVVADLLNRFLGDYVENLNKSQLKLGIWGGNVALDNLQIKENALSELDVPFKVKAGQIDKLTLKIPWKNLYGEAVVATLEGLYLLVVPGASIKYDAVKEEKSLQDVKQKELSRIEEALQKAAEKGTHSGEFIYGLENFVYKDIKPGRKRKKHKKHFKKPFKGLDRSKDKPKEAKKDTFVEKLATQVIKNVQVKITDIHIKYEDDVTDPKRPLSFGVTLGELSLLTANEHWTPCILNEADKIIYKLIRLDSLSAYWNVNCSMSYQRSREQILDQLKNEILTSGNIPPNYQYIFQPISASAKLYMNPYAESELKTPKLDCNIEIQNIAIELTKPQYLSMIDLLESVDYMVRNAPYRKYKPYLPLHTNGRRWWKYAIDSVLEVHIRRYTQMWSWSNIKKHRQLLKSYKIAYKNKLTQSKVSEEIQKEIQDLEKTLDVFNIILARQQAQVEVIRSGQKLRKKSADTGEKRGGWFSGLWGKKESKKKDEESLIPETIDDLMTPEEKDKLFTAIGYSESTHNLTLPKQYVAHIMTLKLVSTSVTIRENKNIPEILKIQIIGLGTQVSQRPGAQALKVEAKLEHWYITGLRQQDIVPSLVASIGDTTSSLLKIKFETNPEDSPADQTLIVQSQPVEVIYDAKTVNAVVEFFQSNKGLDLEQITSATLMKLEEIKERTATGLTHIIETRKVLDLRINLKPSYLVVPQTGFHHEKSDLLILDFGTFQLNSKDQGLQKTTNSSLEEIMDKAYDKFDVEIKNVQLLFARAEETWKKCRFQHPSTMHILQPMDIHVELAKAMVEKDIRMARFKVSGGLPLMHVRISDQKMKDVLYLMNSIPLPQKSSAQSPERQVSSIPIISGGTKGLLGTSLLLDTVESESDDEYFDAEDGEPQTCKSMKGSELKKAAEVPNEELINLLLKFEIKEVILEFTKQQKEEDTILVFNVTQLGTEATMRTFDLTVVSYLKKISLDYHEIEGSKRKPLHLISSSDKPGLDLLKVEYIKADKNGPSFQTAFGKTEQTVKVAFSSLNLLLQTQALVASINYLTTIIPSDDQSISVAKEVQISTEKQQKNSTLPKAIVSSRDSDIIDFRLFAKLNAFCVIVCNEKNNIAEIKIQGLDSSLSLQSRKQSLFARLENIIVTDVDPKTVHKKAVSIMGNEVFRFNLDLYPDATEGDLYTDMSKVDGVLSLNVGCIQIVYLHKFLMSLLNFLNNFQTAKESLSAATAQAAERAATSVKDLAQRSFRVSINIDLKAPVIVIPQSSISTNAVVVDLGLIRVHNQFSLVSDEDYLNPPVIDRMDVQLTKLTLYRTVIQPGIYHPDIQLLHPINLEFLVNRNLAASWYHKVPVVEIKGHLDSMNVSLNQEDLNLLFRILTENLCEGTEDLDKVKPRVQETGEIKEPLEISISQDVHDSKNTLTTGVEEIRSVDIINMLLNFEIKEVVVTLMKKSEKKGRPLHELNVLQLGMEAKVKTYDMTAKAYLKKISMQCFDFTDSKGEPLHIINSSNVTDEPLLKMLLTKADSDGPEFKTIHDSTKQRLKVSFASLDLVLHLEALLSFMDFLSSAAPFSEPSSSEKESELKPLVGESRSIAVKAVSSNISQKDVFDLKITAELNAFNVFVCDQKCNIADIKIHGMDASISVKPKQTDVFARLKDIIVMNVDLQSIHKKAVSILGDEVFRFQLTLYPDATEGEAYADMSKVDGKLSFKVGCIQIVYVHKFFMSLLNFLNNFQTAKEALSTATVQAAERAASSMKDLAQKSFRLLMDINLKAPVIIIPQSSVSPNAVIADLGLIRVENKFSLVPMEHYSLPPVIDKMNIELTQLKLSRTILQASLPQNDIEILKPVNMLLSIQRNLAAAWYVQIPGMEIKGKLKPMQVALSEDDLTVLMKILLENLGEASSQPSPTQSVQETVRVRKVDVSSVPDHLKEQEDWTDSKLSMNQIVSLQFDFHFESLSIILYNNDINQESGVAFHNDSFQLGELRLHLMASSGKMFKDGSMNVSVKLKTCTLDDLREGIERATSRMIDRKNDQDNNSSMIDISYKQDKNGSQIDAVLDKLYVCASVEFLMTVADFFIKAVPQSPENVAKETQILPRQTATGKVKIEKDDSVRPNMTLKAMITDPEVVFVASLTKADAPALTASFQCNLSLSTSKLEQMMEASVRDLKVLACPFLREKRGKNITTVLQPCSLFMEKCTWASGKQNINIMVKEFIIKISPIILNTVLTIMAALSPKTKEDGSKDTSKEMENLWGIKSINDYNTWFLGVDTATEITESFKGIEHSLIEENCGVVVESIQVTLECGLGHRTVPLLLAESKFSGNIKNWTSLMAAVADVTLQVHYYNEIHAVWEPLIERVEGKRQWNLRLDVKKNPVQDKSLLPGDDFIPEPQMAIHISSGNTMNITISKSCLNVFNNLAKGFSEGTASTFDYSLKDRAPFTVKNAVGVPIKVKPNCNLRVMGFPEKSDIFDVDAGQNLELEYASMVPSSQGNLSILSRQESSFFTLTIVPHGYTEVANIPVARPGRRLYNVRNPNASHSDSVLVQIDATEGNKVITLRSPLQIKNHFSIAFIIYKFVKNVKLLERIGIARPEEEFHVPLDSYRCQLFIQPAGILEHQYKESTTYISWKEELHRSREVRCMLQCPSVEVSFLPLIVNTVALPDELSYICTHGEDWDVAYIIHLYPSLTLRNLLPYSLRYLLEGTAETHELAEGSTADVLHSRISGEIMELVLVKYQGKNWNGHFRIRDTLPEFFPVCFSSDSTEVTTVDLSVHVRRIGSRMVLSVFSPYWLINKTTRVLQYRSEDIHVKHPADFRDIILFSFKKKNIFTKNKVQLKISTSAWSSSFSLDTVGSYGCVKCPANNMEYLVGVSIKMSSFNLSRIVTLTPFCTIANKSSLELEVGEIASDGSMPTNKWNYIASSECLPFWPESLSGKLCVRVVGCEGSSKPFFYNRQDNGTLLSLEDLNGGILVDVNTAEHSTVITFSDYHEGSAPALIMNHTPWDILTYKQSGSPEEMVLLPRQARLFAWADPTGTRKLTWTYAANVGEHDLLKDGCGQFPYDANIQIHWVSFLDGRQRVLLFTDDVALVSKALQAEEMEQADYEITLSLHSLGLSLVNNESKQEVSYIGITSSGVVWEVKPKQKWKPFSQKQIILLEQSYQKHQISRDHGWIKLDNNFEVNFDKDPMEMRLPIRSPIKRDFLSGIQIEFKQSSHQRSLRARLYWLQVDNQLPGAMFPVVFHPVAPPKSIALDSEPKPFIDVSVITRFNEYSKVLQFKYFMVLIQEMALKIDQGFLGAIIALFTPTTDPEAERRRTKLIQQDIDALNAELMETSMTDMSILSFFEHFHISPVKLHLSLSLGSGGEESDKEKQEMFAVHSVNLLLKSIGATLTDVDDLIFKLAYYEIRYQFYKRDQLIWSVVRHYSEQFLKQMYVLVLGLDVLGNPFGLIRGLSEGVEALFYEPFQGAVQGPEEFAEGLVIGVRSLFGHTVGGAAGVVSRITGSVGKGLAAITMDKEYQQKRREELSRQPRDFGDSLARGGKGFLRGVVGGVTGIITKPVEGAKKEGAAGFFKGIGKGLVGAVARPTGGIVDMASSTFQGIQRAAESTEEVSSLRPPRLIHEDGIIRPYDRQESEGSDLLEQELEIQE

SEQ ID NO: 96149 - protein, 3585 aa, Homo sapiens
  Payload ID: 19192
  Gene Name: vacuolar protein sorting 13 homolog C (S. cerevisiae)
  Uniprot ID: Q709C8
  ENSP ID: ENSP00000379235
MVLESVVADLLNRFLGDYVENLNKSQLKLGIWGGNVALDNLQIKENALSELDVPFKVKAGQIDKLTLKIPWKNLYGEAVVATLEGLYLLVVPGASIKYDAVKEEKSLQDVKQKELSRIEEALQKAAEKDKPKEAKKDTFVEKLATQVIKNVQVKITDIHIKYEDDVTDPKRPLSFGVTLGELSLLTANEHWTPCILNEADKIIYKLIRLDSLSAYWNVNCSMSYQRSREQILDQLKNEILTSGNIPPNYQYIFQPISASAKLYMNPYAESELKTPKLDCNIEIQNIAIELTKPQYLSMIDLLESVDYMVRNAPYRKYKPYLPLHTNGRRWWKYAIDSVLEVHIRRYTQMWSWSNIKKHRQLLKSYKIAYKNKLTQSKVSEEIQKEIQDLEKTLDVFNIILARQQAQVEVIRSGQKLRKKSADTGEKRGGWFSGLWGKKESKKKDEESLIPETIDDLMTPEEKDKLFTAIGYSESTHNLTLPKQYVAHIMTLKLVSTSVTIRENKNIPEILKIQIIGLGTQVSQRPGAQALKVEAKLEHWYITGLRQQDIVPSLVASIGDTTSSLLKIKFETNPEDSPADQTLIVQSQPVEVIYDAKTVNAVVEFFQSNKGLDLEQITSATLMKLEEIKERTATGLTHIIETRKVLDLRINLKPSYLVVPQTGFHHEKSDLLILDFGTFQLNSKDQGLQKTTNSSLEEIMDKAYDKFDVEIKNVQLLFARAEETWKKCRFQHPSTMHILQPMDIHVELAKAMVEKDIRMARFKVSGGLPLMHVRISDQKMKDVLYLMNSIPLPQKSSAQSPERQVSSIPIISGGTKGLLGTSLLLDTVESESDDEYFDAEDGEPQTCKSMKGSELKKAAEVPNEELINLLLKFEIKEVILEFTKQQKEEDTILVFNVTQLGTEATMRTFDLTVVSYLKKISLDYHEIEGSKRKPLHLISSSDKPGLDLLKVEYIKADKNGPSFQTAFGKTEQTVKVAFSSLNLLLQTQALVASINYLTTIIPSDDQSISVAKEVQISTEKQQKNSTLPKAIVSSRDSDIIDFRLFAKLNAFCVIVCNEKNNIAEIKIQGLDSSLSLQSRKQSLFARLENIIVTDVDPKTVHKKAVSIMGNEVFRFNLDLYPDATEGDLYTDMSKVDGVLSLNVGCIQIVYLHKFLMSLLNFLNNFQTAKESLSAATAQAAERAATSVKDLAQRSFRVSINIDLKAPVIVIPQSSISTNAVVVDLGLIRVHNQFSLVSDEDYLNPPVIDRMDVQLTKLTLYRTVIQPGIYHPDIQLLHPINLEFLVNRNLAASWYHKVPVVEIKGHLDSMNVSLNQEDLNLLFRILTENLCEGTEDLDKVKPRVQETGEIKEPLEISISQDVHDSKNTLTTGVEEIRSVDIINMLLNFEIKEVVVTLMKKSEKKGRPLHELNVLQLGMEAKVKTYDMTAKAYLKKISMQCFDFTDSKGEPLHIINSSNVTDEPLLKMLLTKADSDGPEFKTIHDSTKQRLKVSFASLDLVLHLEALLSFMDFLSSAAPFSEPSSSEKESELKPLVGESRSIAVKAVSSNISQKDVFDLKITAELNAFNVFVCDQKCNIADIKIHGMDASISVKPKQTDVFARLKDIIVMNVDLQSIHKKAVSILGDEVFRFQLTLYPDATEGEAYADMSKVDGKLSFKVGCIQIVYVHKFFMSLLNFLNNFQTAKEALSTATVQAAERAASSMKDLAQKSFRLLMDINLKAPVIIIPQSSVSPNAVIADLGLIRVENKFSLVPMEHYSLPPVIDKMNIELTQLKLSRTILQASLPQNDIEILKPVNMLLSIQRNLAAAWYVQIPGMEIKGKLKPMQVALSEDDLTVLMKILLENLGEASSQPSPTQSVQETVRVRKVDVSSVPDHLKEQEDWTDSKLSMNQIVSLQFDFHFESLSIILYNNDINQESGVAFHNDSFQLGELRLHLMASSGKMFKDGSMNVSVKLKTCTLDDLREGIERATSRMIDRKNDQDNNSSMIDISYKQDKNGSQIDAVLDKLYVCASVEFLMTVADFFIKAVPQSPENVAKETQILPRQTATGKVKIEKDDSVRPNMTLKAMITDPEVVFVASLTKADAPALTASFQCNLSLSTSKLEQMMEASVRDLKVLACPFLREKRGKNITTVLQPCSLFMEKCTWASGKQNINIMVKEFIIKISPIILNTVLTIMAALSPKTKEDGSKDTSKEMENLWGIKSINDYNTWFLGVDTATEITESFKGIEHSLIEENCGVVVESIQVTLECGLGHRTVPLLLAESKFSGNIKNWTSLMAAVADVTLQVHYYNEIHAVWEPLIERVEGKRQWNLRLDVKKNPVQDKSLLPGDDFIPEPQMAIHISSGNTMNITISKSCLNVFNNLAKGFSEGTASTFDYSLKDRAPFTVKNAVGVPIKVKPNCNLRVMGFPEKSDIFDVDAGQNLELEYASMVPSSQGNLSILSRQESSFFTLTIVPHGYTEVANIPVARPGRRLYNVRNPNASHSDSVLVQIDATEGNKVITLRSPLQIKNHFSIAFIIYKFVKNVKLLERIGIARPEEEFHVPLDSYRCQLFIQPAGILEHQYKESTTYISWKEELHRSREVRCMLQCPSVEVSFLPLIVNTVALPDELSYICTHGEDWDVAYIIHLYPSLTLRNLLPYSLRYLLEGTAETHELAEGSTADVLHSRISGEIMELVLVKYQGKNWNGHFRIRDTLPEFFPVCFSSDSTEVTTVDLSVHVRRIGSRMVLSVFSPYWLINKTTRVLQYRSEDIHVKHPADFRDIILFSFKKKNIFTKNKVQLKISTSAWSSSFSLDTVGSYGCVKCPANNMEYLVGVSIKMSSFNLSRIVTLTPFCTIANKSSLELEVGEIASDGSMPTNKWNYIASSECLPFWPESLSGKLCVRVVGCEGSSKPFFYNRQDNGTLLSLEDLNGGILVDVNTAEHSTVITFSDYHEGSAPALIMNHTPWDILTYKQSGSPEEMVLLPRQARLFAWADPTGTRKLTWTYAANVGEHDLLKDGCGQFPYDANIQIHWVSFLDGRQRVLLFTDDVALVSKALQAEEMEQADYEITLSLHSLGLSLVNNESKQEVSYIGITSSGVVWEVKPKQKWKPFSQKQIILLEQSYQKHQISRDHGWIKLDNNFEVNFDKDPMEMRLPIRSPIKRDFLSGIQIEFKQSSHQRSLRARLYWLQVDNQLPGAMFPVVFHPVAPPKSIALDSEPKPFIDVSVITRFNEYSKVLQFKYFMVLIQEMALKIDQGFLGAIIALFTPTTDPEAERRRTKLIQQDIDALNAELMETSMTDMSILSFFEHFHISPVKLHLSLSLGSGGEESDKEKQEMFAVHSVNLLLKSIGATLTDVDDLIFKLAYYEIRYQFYKRDQLIWSVVRHYSEQFLKQMYVLVLGLDVLGNPFGLIRGLSEGVEALFYEPFQGAVQGPEEFAEGLVIGVRSLFGHTVGGAAGVVSRITGSVGKGLAAITMDKEYQQKRREELSRQPRDFGDSLARGGKGFLRGVVGGVTGIITKPVEGAKKEGAAGFFKGIGKGLVGAVARPTGGIVDMASSTFQGIQRAAESTEEVSSLRPPRLIHEDGIIRPYDRQESEGSDLLEQELEIQE

SEQ ID NO: 96150 - protein, 3210 aa, Homo sapiens
  Payload ID: 19193
  Gene Name: vacuolar protein sorting 13 homolog D (S. cerevisiae)
  ENSP ID: ENSP00000011700
  MOD_RES (1)..(1): Any amino acid
XRTVGMANREKYGRKIATASIGGTKVNVSMGSTFDMNGSLGCLQLMDLTQDNVKNQYVVSIGNSVGYENIISDIGYFESVFVRMEDAALTEALSFTFVERSKQECFLNLKMASLHYNHSAKFLKELTLSMDELEENFRGMLKSAATKVTTVLATKTAEYSEMVSLFETPRKTREPFILEENEIYGFDLASSHLDTVKLILNINIESPVVSIPRKPGSPELLVGHLGQIFIQNFVAGDDESRSDRLQVEIKDIKLYSLNCTQLAGREAVGSEGSRMFCPPSGSGSANSQEEAHFTRHDFFESLHRGQAFHILNNTTIQFKLEKIPIERESELTFSLSPDDLGTSSIMKIEGKFVNPVQVVLAKHVYEQVLQTLDNLVYSEDLNKYPASATSSPCPDSPLPPLSTCGESSVERKENGLFSHSSLSNTSQKSLSVKEVKSFTQIQATFCISELQVQLSGDLTLGAQGLVSLKFQDFEVEFSKDHPQTLSIQIALHSLLMEDLLEKNPDSKYKNLMVSRGAPKPSSLAQKEYLSQSCPSVSNVEYPDMPRSLPSHMEEAPNVFQLYQRPTSASRKKQKEVQDKDYPLTPPPSPTVDEPKILVGKSKFDDSLVHINIFLVDKKHPEFSSSYNRVNRSIDVDFNCLDVLITLQTWVVILDFFGIGSTADNHAMRLPPEGILHNVKLEPHASMESGLQDPVNTKLDLKVHSLSLVLNKTTSELAKANVSKLVAHLEMIEGDLALQGSIGSLSLSDLTCHGEFYRERFTTSGEEALIFQTFKYGRPDPLLRREHDIRVSLRMASVQYVHTQRFQAEVVAFIQHFTQLQDVLGRQRAAIEGQTVRDQAQRCSRVLLDIEAGAPVLLIPESSRSNNLIVANLGKLKVKNKFLFAGFPGTFSLQDKESVPSASPTGIPKHSLRKTTSTEEPRGTHSQGQFTMPLAGMSLGSLKSEFVPSTSTKQQGPQPTLSVGQESSSPEDHVCLLDCVVVDLQDMDIFAAERHPREYSKAPEDSSGDLIFPSYFVRQTGGSLLTEPCRLKLQVERNLDKEISHTVPDISIHGNLSSVHCSLDLYKYKLIRGLLENNLGEPIEEFMRPYDLQDPRIHTVLSGEVYTCMCFLIDMVNVSLELKDPKRKEGAGSLARFDFKKCKLLYESFSNQTKSINLVSHSMMAFDTRYAGQKTSPGMTNVFSCIFQPAKNSSTTQGSIQIELHFRSTKDSSCFTVVLNNLRVFLIFDWLLLVHDFLHTPSDIKKQNHVTPSRHRNSSSESAIVPKTVKSGVVTKRSSLPVSNERHLEVKVNVTGTEFVVIEDVSCFDTNAIILKGTTVLTYKPRFVDRPFSGSLFGIEVFSCRLGNEHDTALSIVDPVQIQMELVGNSSYQNSSGLMDAFNSEDFPPVLEIQLQALDIRLSYNDVQLFLAIAKSIPEQANAAVPDSVALESDSVGTYLPGASRVGEEIREGTRHTLDPVLELQLARLQELGFSMDDCRKALLACQGQLKKAASWLFKNAEPLKSLSLASTSRDSPGAVAAPLISGVEIKAESVCICFIDDCMDCDVPLAELTFSRLNFLQRVRTSPEGYAHFTLSGDYYNRALSGWEPFIEPWPCSVSWQQQAASRLHPPRLKLEAKAKPRLDINITSVLIDQYVSTKESWMADYCKDDKDIESAKSEDWMGSSVDPPCFGQSLPLVYLRTRSTASLTNLEHQIYAREVKTPKRRQPFVPFALRNHTGCTLWFATLTTTPTRAALSHSGSPGVVPEGNGTFLDDTHNVSEWREVLTGEEIPFEFEARGKLRHRHTHDLRIHQLQVRVNGWEQVSPVSVDKVGTFFRYAAPDKNSSSSTIGSPSSRTNIIHPQVYFSSLPPVRVVFAVTMEGSARKVITVRSALIVRNRLETPMELRLDSPSAPDKPVVLPAIMPGDSFAVPLHLTSWRLQARPKGLGVFFCKAPIHWTNVVKTAEISSSKRECHSMDTEKSRFFRFCVAIKKENYPDYMPSNIFSDSAKQIFRQPGHTIYLLPTVVICNLLPCELDFYVKGMPINGTLKPGKEAALHTADTSQNIELGVSLENFPLCKELLIPPGTQNYMVRMRLYDVNRRQLNLTIRIVCRAEGSLKIFISAPYWLINKTGLPLIFRQDNAKTDAAGQFEEHELARSLSPLLFCYADKEQPNLCTMRIGRGIHPEGMPGWCQGFSLDGGSGVRALKVIQQGNRPGLIYNIGIDVKKGRGRYIDTCMVIFAPRYLLDNKSSHKLAFAQREFARGQGTANPEGYISTLPGSSVVFHWPRNDYDQLLCVRLMDVPNCIWSGGFEVNKNNSFHINMRDTLGKCFFLRVEITLRGATYRISFSDTDQLPPPFRIDNFSKVPVVFTQHGVAEPRLRTEVKPMTSLDYAWDEPTLPPFITLTVKGAGSSEINCNMNDFQDNRQLYYENFIYIAATYTFSGLQEGTGRPVASNKAITCAELVLDVSPKTQRVILKKKEPGKRSQLWRMTGTGMLAHEGSSVPHNPNKPSAARSTEGSAILDIAGLAAVTDNRYEPLMLRKPDRRRSTTQTWSFREGKLTCGLHGLVVQAKGGLSGLFDGAEVVLGPDTSMELLGPVPPEQQFINQKMRPGSGMLSIRVIPDGPTRALQITDFCHRKSSRSYEVDELPVTEQELQKLKNPDTEQELEVLVRLEGGIGLSLINKVPEELVFASLTGINVHYTQLATSHMLELSIQDVQVDNQLIGTTQPFMLYVTPLSNENEVIETGPAVQVNAVKFPSKSALTNIYKHLMITAQRFTVQIEEKLLLKLLSFFGYDQAESEVEKYDENLHEKTAEQGGTPIRYYFENLKISIPQIKLSVFTSNKLPLDLKALKSTLGFPLIRFEDAVINLDPFTRVHPYETKEFIINDILKHFQEELLSQAARILGSVDFLGNPMGLLNDVSEGVTGLIKYGNVGGLIRNVTHGVSNSAAKFAGTLSDGLGKTMDNRHQSEREYIRYHAATSGEHLVAGIHGLAHGIIGGLTSVITSTVEGVKTEGGVSGFISGLGKGLVGTVTKPVAGALDFASETAQAVRDTATLSGPRTQAQRVRKPRCCTGPQGLLPRYSESQAEGQEQLFKLTDNIQDEFFIAVENIDSYCVLISSKAVYFLKSGDYVDREAIFLEVKYDDLYHCLVSKDHGKVYVQVTKKAVSTSSGVSIPGPSHQKPMVHVKSEVLAVKLSQEINYAKSLYYEQQLMLRLSENREQLELDS

SEQ ID NO: 96151 - protein, 44 aa, Homo sapiens
  Payload ID: 19193
  Gene Name: vacuolar protein sorting 13 homolog D (S. cerevisiae)
  ENSP ID: ENSP00000441122
MVHVKSEVLAVKLSQEINYAKSLYYEQQLMLRLSENREQLELDS

SEQ ID NO: 96152 - protein, 45 aa, Homo sapiens
  Payload ID: 19193
  Gene Name: vacuolar protein sorting 13 homolog D (S. cerevisiae)
  ENSP ID: ENSP00000473375
ALTNIYKHLMITAQRFTVQIEEKLLLKLLSFFGYDQAESDLEFKL

SEQ ID NO: 96153 - protein, 4388 aa, Homo sapiens
  Payload ID: 19193
  Gene Name: vacuolar protein sorting 13 homolog D (S. cerevisiae)
  Uniprot ID: Q5THJ4
  ENSP ID: ENSP00000478104
MLEGLVAWVLNTYLGKYVNNLNTDQLSVALLKGAVELENLPLKKDALKELELPFEVKAGFIGKVTLQIPFYRPHVDPWVISISSLHLIGAPEKIQDFNDEKEKLLERERKKALLQALEEKWKNDRQQKGESYWYSVTASVVTRIVENIELKIQDVHLRFEDGVTNPSHPFAFGICIKNVSMQNAVNEPVQKLMRKKQLDVAEFSIYWDVDCTLLGDLPQMELQEAMARSMESRSHHYVLEPVFASALLKRNCSKKPLRSRHSPRIDCDIQLETIPLKLSQLQYRQIMEFLKELERKERQVKFRRWKPKVAISKNCREWWYFALNANLYEIREQRKRCTWDFMLHRARDAVSYTDKYFNKLKGGLLSTDDKEEMCRIEEEQSFEELKILRELVHDRFHKQEELAESLREPQFDSPGACPGAPEPGGGSGMLQYLQSWFPGWGGWYGQQTPEGNVVEGLSAEQQEQWIPEEILGTEEFFDPTADASCMNTYTKRDHVFAKLNLQLQRGTVTLLHKEQGTPQMNESAFMQLEFSDVKLLAESLPRRNSSLLSVRLGGLFLRDLATEGTMFPLLVFPNPQKEVGRVSQSFGLQTTSADRSDHYPAADPDGPVFEMLYERNPAHSHFERRLNVSTRPLNIIYNPQAIKKVADFFYKGKVHTSGFGYQSELELRVAEAARRQYNKLKMQTKAEIRQTLDRLLVGDFIEESKRWTVRLDISAPQVIFPDDFKFKNPVLVVVDLGRMLLTNTQDNSRRKSRDGSASEETQFSDDEYKTPLATPPNTPPPESSSSNGEKTPPFSGVEFSEEQLQAHLMSTKMYERYSLSFMDLQIMVGRVKDNWKHVQDIDVGPTHVVEKFNVHLQLERRLIYTSDPKYPGAVLSGNLPDLKIHINEDKISALKNCFALLTTPEMKTSDTQIKEKIFPQEEQRGSLQDSVMNLTQSIVLLEQHTREVLVESQLLLAEFKVNCMQLGVESNGRYISVLKVFGTNAHFVKRPYDAEVSLTVHGLLLVDTMQTYGADFDLLMASHKNLSFDIPTGSLRDSRAQSPVSGPNVAHLTDGATLNDRSATSVSLDKILTKEQESLIKLEYQFVSSECPSMNLDSTLQVISLQVNNLDIILNPETIVELIGFLQKSFPKEKDDLSPQPLMTDFERSFREQGTYQSTYEQNTEVAVEIHRLNLLLLRTVGMANREKYGRKIATASIGGTKVNVSMGSTFDMNGSLGCLQLMDLTQDNVKNQYVVSIGNSVGYENIISDIGYFESVFVRMEDAALTEALSFTFVERSKQECFLNLKMASLHYNHSAKFLKELTLSMDELEENFRGMLKSAATKVTTVLATKTAEYSEMVSLFETPRKTREPFILEENEIYGFDLASSHLDTVKLILNINIESPVVSIPRKPGSPELLVGHLGQIFIQNFVAGDDESRSDRLQVEIKDIKLYSLNCTQLAGREAVGSEGSRMFCPPSGSGSANSQEEAHFTRHDFFESLHRGQAFHILNNTTIQFKLEKIPIERESELTFSLSPDDLGTSSIMKIEGKFVNPVQVVLAKHVYEQVLQTLDNLVYSEDLNKYPASATSSPCPDSPLPPLSTCGESSVERKENGLFSHSSLSNTSQKSLSVKEVKSFTQIQATFCISELQVQLSGDLTLGAQGLVSLKFQDFEVEFSKDHPQTLSIQIALHSLLMEDLLEKNPDSKYKNLMVSRGAPKPSSLAQKEYLSQSCPSVSNVEYPDMPRSLPSHMEEAPNVFQLYQRPTSASRKKQKEVQDKDYPLTPPPSPTVDEPKILVGKSKFDDSLVHINIFLVDKKHPEFSSSYNRVNRSIDVDFNCLDVLITLQTWVVILDFFGIGSTADNHAMRLPPEGILHNVKLEPHASMESGLQDPVNTKLDLKVHSLSLVLNKTTSELAKANVSKLVAHLEMIEGDLALQGSIGSLSLSDLTCHGEFYRERFTTSGEEALIFQTFKYGRPDPLLRREHDIRVSLRMASVQYVHTQRFQAEVVAFIQHFTQLQDVLGRQRAAIEGQTVRDQAQRCSRVLLDIEAGAPVLLIPESSRSNNLIVANLGKLKVKNKFLFAGFPGTFSLQDKESVPSASPTGIPKHSLRKTTSTEEPRGTHSQGQFTMPLAGMSLGSLKSEFVPSTSTKQQGPQPTLSVGQESSSPEDHVCLLDCVVVDLQDMDIFAAERHPREYSKAPEDSSGDLIFPSYFVRQTGGSLLTEPCRLKLQVERNLDKEISHTVPDISIHGNLSSVHCSLDLYKYKLIRGLLENNLGEPIEEFMRPYDLQDPRIHTVLSGEVYTCMCFLIDMVNVSLELKDPKRKEGAGSLARFDFKKCKLLYESFSNQTKSINLVSHSMMAFDTRYAGQKTSPGMTNVFSCIFQPAKNSSTTQGSIQIELHFRSTKDSSCFTVVLNNLRVFLIFDWLLLVHDFLHTPSDIKKQNHVTPSRHRNSSSESAIVPKTVKSGVVTKRSSLPVSNERHLEVKVNVTGTEFVVIEDVSCFDTNAIILKGTTVLTYKPRFVDRPFSGSLFGIEVFSCRLGNEHDTALSIVDPVQIQMELVGNSSYQNSSGLMDAFNSEDFPPVLEIQLQALDIRLSYNDVQLFLAIAKSIPEQANAAVPDSVALESDSVGTYLPGASRVGEEIREGTRHTLDPVLELQLARLQELGFSMDDCRKALLACQGQLKKAASWLFKNAEPLKSLSLASTSRDSPGAVAAPLISGVEIKAESVCICFIDDCMDCDVPLAELTFSRLNFLQRVRTSPEGYAHFTLSGDYYNRALSGWEPFIEPWPCSVSWQQQAASRLHPPRLKLEAKAKPRLDINITSVLIDQYVSTKESWMADYCKDDKDIESAKSEDWMGSSVDPPCFGQSLPLVYLRTRSTASLTNLEHQIYARAEVKTPKRRQPFVPFALRNHTGCTLWFATLTTTPTRAALSHSGSPGVVPEGNGTFLDDTHNVSEWREVLTGEEIPFEFEARGKLRHRHTHDLRIHQLQVRVNGWEQVSPVSVDKVGTFFRYAAPDKNSSSSTIGSPSSRTNIIHPQVYFSSLPPVRVVFAVTMEGSARKVITVRSALIVRNRLETPMELRLDSPSAPDKPVVLPAIMPGDSFAVPLHLTSWRLQARPKGLGVFFCKAPIHWTNVVKTAEISSSKRECHSMDTEKSRFFRFCVAIKKENYPDYMPSNIFSDSAKQIFRQPGHTIYLLPTVVICNLLPCELDFYVKGMPINGTLKPGKEAALHTADTSQNIELGVSLENFPLCKELLIPPGTQNYMVRMRLYDVNRRQLNLTIRIVCRAEGSLKIFISAPYWLINKTGLPLIFRQDNAKTDAAGQFEEHELARSLSPLLFCYADKEQPNLCTMRIGRGIHPEGMPGWCQGFSLDGGSGVRALKVIQQGNRPGLIYNIGIDVKKGRGRYIDTCMVIFAPRYLLDNKSSHKLAFAQREFARGQGTANPEGYISTLPGSSVVFHWPRNDYDQLLCVRLMDVPNCIWSGGFEVNKNNSFHINMRDTLGKCFFLRVEITLRGATYRISFSDTDQLPPPFRIDNFSKVPVVFTQHGVAEPRLRTEVKPMTSLDYAWDEPTLPPFITLTVKGAGSSEINCNMNDFQDNRQLYYENFIYIAATYTFSGLQEGTGRPVASNKAITCAELVLDVSPKTQRVILKKKEPGKRSQLWRMTGTGMLAHEGSSVPHNPNKPSAARSTEGSAILDIAGLAAVTDNRYEPLMLRKPDRRRSTTQTWSFREGKLTCGLHGLVVQAKGGLSGLFDGAEVVLGPDTSMELLGPVPPEQQFINQKMRPGSGMLSIRVIPDGPTRALQITDFCHRKSSRSYEVDELPVTEQELQKLKNPDTEQELEVLVRLEGGIGLSLINKVPEELVFASLTGINVHYTQLATSHMLELSIQDVQVDNQLIGTTQPFMLYVTPLSNENEVIETGPAVQVNAVKFPSKSALTNIYKHLMITAQRFTVQIEEKLLLKLLSFFGYDQAESEVEKYDENLHEKTAEQGGTPIRYYFENLKISIPQIKLSVFTSNKLPLDLKALKSTLGFPLIRFEDAVINLDPFTRVHPYETKEFIINDILKHFQEELLSQAARILGSVDFLGNPMGLLNDVSEGVTGLIKYGNVGGLIRNVTHGVSNSAAKFAGTLSDGLGKTMDNRHQSEREYIRYHAATSGEHLVAGIHGLAHGIIGGLTSVITSTVEGVKTEGGVSGFISGLGKGLVGTVTKPVAGALDFASETAQAVRDTATLSGPRTQAQRVRKPRCCTGPQGLLPRYSESQAEGQEQLFKLTDNIQDEFFIAVENIDSYCVLISSKAVYFLKSGDYVDREAIFLEVKYDDLYHCLVSKDHGKVYVQVTKKAVSTSSGVSIPGPSHQKPMVHVKSEVLAVKLSQEINYAKSLYYEQQLMLRLSENREQLELDS

SEQ ID NO: 96154 - protein, 4363 aa, Homo sapiens
  Payload ID: 19193
  Gene Name: vacuolar protein sorting 13 homolog D (S. cerevisiae)
  Uniprot ID: Q5THJ4
  ENSP ID: ENSP00000482233
MLEGLVAWVLNTYLGKYVNNLNTDQLSVALLKGAVELENLPLKKDALKELELPFEVKAGFIGKVTLQIPFYRPHVDPWVISISSLHLIGAPEKIQDFNDEKEKLLERERKKALLQALEEKWKNDRQQKGESYWYSVTASVVTRIVENIELKIQDVHLRFEDGVTNPSHPFAFGICIKNVSMQNAVNEPVQKLMRKKQLDVAEFSIYWDVDCTLLGDLPQMELQEAMARSMESRSHHYVLEPVFASALLKRNCSKKPLRSRHSPRIDCDIQLETIPLKLSQLQYRQIMEFLKELERKERQVKFRRWKPKVAISKNCREWWYFALNANLYEIREQRKRCTWDFMLHRARDAVSYTDKYFNKLKGGLLSTDDKEEMCRIEEEQSFEELKILRELVHDRFHKQEELAESLREPQFDSPGACPGAPEPGGGSGMLQYLQSWFPGWGGWYGQQTPEGNVVEGLSAEQQEQWIPEEILGTEEFFDPTADASCMNTYTKRDHVFAKLNLQLQRGTVTLLHKEQGTPQMNESAFMQLEFSDVKLLAESLPRRNSSLLSVRLGGLFLRDLATEGTMFPLLVFPNPQKEVGRVSQSFGLQTTSADRSDHYPAADPDGPVFEMLYERNPAHSHFERRLNVSTRPLNIIYNPQAIKKVADFFYKGKVHTSGFGYQSELELRVAEAARRQYNKLKMQTKAEIRQTLDRLLVGDFIEESKRWTVRLDISAPQVIFPDDFKFKNPVLVVVDLGRMLLTNTQDNSRRKSRDGSASEETQFSDDEYKTPLATPPNTPPPESSSSNGEKTPPFSGVEFSEEQLQAHLMSTKMYERYSLSFMDLQIMVGRVKDNWKHVQDIDVGPTHVVEKFNVHLQLERRLIYTSDPKYPGAVLSGNLPDLKIHINEDKISALKNCFALLTTPEMKTSDTQIKEKIFPQEEQRGSLQDSVMNLTQSIVLLEQHTREVLVESQLLLAEFKVNCMQLGVESNGRYISVLKVFGTNAHFVKRPYDAEVSLTVHGLLLVDTMQTYGADFDLLMASHKNLSFDIPTGSLRDSRAQSPVSGPNVAHLTDGATLNDRSATSVSLDKILTKEQESLIKLEYQFVSSECPSMNLDSTLQVISLQVNNLDIILNPETIVELIGFLQKSFPKEKDDLSPQPLMTDFERSFREQGTYQSTYEQNTEVAVEIHRLNLLLLRTVGMANREKYGRKIATASIGGTKVNVSMGSTFDMNGSLGCLQLMDLTQDNVKNQYVVSIGNSVGYENIISDIGYFESVFVRMEDAALTEALSFTFVERSKQECFLNLKMASLHYNHSAKFLKELTLSMDELEENFRGMLKSAATKVTTVLATKTAEYSEMVSLFETPRKTREPFILEENEIYGFDLASSHLDTVKLILNINIESPVVSIPRKPGSPELLVGHLGQIFIQNFVAGDDESRSDRLQVEIKDIKLYSLNCTQLAGREAVGSEGSRMFCPPSGSGSANSQEEAHFTRHDFFESLHRGQAFHILNNTTIQFKLEKIPIERESELTFSLSPDDLGTSSIMKIEGKFVNPVQVVLAKHVYEQVLQTLDNLVYSEDLNKYPASATSSPCPDSPLPPLSTCGESSVERKENGLFSHSSLSNTSQKSLSVKEVKSFTQIQATFCISELQVQLSGDLTLGAQGLVSLKFQDFEVEFSKDHPQTLSIQIALHSLLMEDLLEKNPDSKYKNLMVSRGAPKPSSLAQKEYLSQSCPSVSNVEYPDMPRSLPSHMEEAPNVFQLYQRPTSASRKKQKEVQDKDYPLTPPPSPTVDEPKILVGKSKFDDSLVHINIFLVDKKHPEFSSSYNRVNRSIDVDFNCLDVLITLQTWVVILDFFGIGSTADNHAMRLPPEGILHNVKLEPHASMESGLQDPVNTKLDLKVHSLSLVLNKTTSELAKANVSKLVAHLEMIEGDLALQGSIGSLSLSDLTCHGEFYRERFTTSGEEALIFQTFKYGRPDPLLRREHDIRVSLRMASVQYVHTQRFQAEVVAFIQHFTQLQDVLGRQRAAIEGQTVRDQAQRCSRVLLDIEAGAPVLLIPESSRSNNLIVANLGKLKVKNKFLFAGFPGTFSLQDKESVPSASPTGIPKHSLRKTTSTEEPRGTHSQGQFTMPLAGMSLGSLKSEFVPSTSTKQQGPQPTLSVGQESSSPEDHVCLLDCVVVDLQDMDIFAAERHPREYSKAPEDSSGDLIFPSYFVRQTGGSLLTEPCRLKLQVERNLDKEISHTVPDISIHGNLSSVHCSLDLYKYKLIRGLLENNLGEPIEEFMRPYDLQDPRIHTVLSGEVYTCMCFLIDMVNVSLELKDPKRKEGAGSLARFDFKKCKLLYESFSNQTKSINLVSHSMMAFDTRYAGQKTSPGMTNVFSCIFQPAKNSSTTQGSIQIELHFRSTKDSSCFTVVLNNLRVFLIFDWLLLVHDFLHTPSDIKKQNHVTPSRHRNSSSESAIVPKTVKSGVVTKRSSLPVSNERHLEVKVNVTGTEFVVIEDVSCFDTNAIILKGTTVLTYKPRFVDRPFSGSLFGIEVFSCRLGNEHDTALSIVDPVQIQMELVGNSSYQNSSGLMDAFNSEDFPPVLEIQLQALDIRLSYNDVQLFLAIAKSIPEQANAAVPDSVALESDSVGTYLPGASRVGEEIREGTRHTLDPVLELQLARLQELGFSMDDCRKALLACQGQLKKAASWLFKNAEPLKSLSLASTSRDSPGAVAAPLISGVEIKAESVCICFIDDCMDCDVPLAELTFSRLNFLQRVRTSPEGYAHFTLSGDYYNRALSGWEPFIEPWPCSVSWQQQAASRLHPPRLKLEAKAKPRLDINITSVLIDQYVSTKESWMADYCKDDKDIESAKSEDWMGSSVDPPCFGQTEVKTPKRRQPFVPFALRNHTGCTLWFATLTTTPTRAALSHSGSPGVVPEGNGTFLDDTHNVSEWREVLTGEEIPFEFEARGKLRHRHTHDLRIHQLQVRVNGWEQVSPVSVDKVGTFFRYAAPDKNSSSSTIGSPSSRTNIIHPQVYFSSLPPVRVVFAVTMEGSARKVITVRSALIVRNRLETPMELRLDSPSAPDKPVVLPAIMPGDSFAVPLHLTSWRLQARPKGLGVFFCKAPIHWTNVVKTAEISSSKRECHSMDTEKSRFFRFCVAIKKENYPDYMPSNIFSDSAKQIFRQPGHTIYLLPTVVICNLLPCELDFYVKGMPINGTLKPGKEAALHTADTSQNIELGVSLENFPLCKELLIPPGTQNYMVRMRLYDVNRRQLNLTIRIVCRAEGSLKIFISAPYWLINKTGLPLIFRQDNAKTDAAGQFEEHELARSLSPLLFCYADKEQPNLCTMRIGRGIHPEGMPGWCQGFSLDGGSGVRALKVIQQGNRPGLIYNIGIDVKKGRGRYIDTCMVIFAPRYLLDNKSSHKLAFAQREFARGQGTANPEGYISTLPGSSVVFHWPRNDYDQLLCVRLMDVPNCIWSGGFEVNKNNSFHINMRDTLGKCFFLRVEITLRGATYRISFSDTDQLPPPFRIDNFSKVPVVFTQHGVAEPRLRTEVKPMTSLDYAWDEPTLPPFITLTVKGAGSSEINCNMNDFQDNRQLYYENFIYIAATYTFSGLQEGTGRPVASNKAITCAELVLDVSPKTQRVILKKKEPGKRSQLWRMTGTGMLAHEGSSVPHNPNKPSAARSTEGSAILDIAGLAAVTDNRYEPLMLRKPDRRRSTTQTWSFREGKLTCGLHGLVVQAKGGLSGLFDGAEVVLGPDTSMELLGPVPPEQQFINQKMRPGSGMLSIRVIPDGPTRALQITDFCHRKSSRSYEVDELPVTEQELQKLKNPDTEQELEVLVRLEGGIGLSLINKVPEELVFASLTGINVHYTQLATSHMLELSIQDVQVDNQLIGTTQPFMLYVTPLSNENEVIETGPAVQVNAVKFPSKSALTNIYKHLMITAQRFTVQIEEKLLLKLLSFFGYDQAESEVEKYDENLHEKTAEQGGTPIRYYFENLKISIPQIKLSVFTSNKLPLDLKALKSTLGFPLIRFEDAVINLDPFTRVHPYETKEFIINDILKHFQEELLSQAARILGSVDFLGNPMGLLNDVSEGVTGLIKYGNVGGLIRNVTHGVSNSAAKFAGTLSDGLGKTMDNRHQSEREYIRYHAATSGEHLVAGIHGLAHGIIGGLTSVITSTVEGVKTEGGVSGFISGLGKGLVGTVTKPVAGALDFASETAQAVRDTATLSGPRTQAQRVRKPRCCTGPQGLLPRYSESQAEGQEQLFKLTDNIQDEFFIAVENIDSYCVLISSKAVYFLKSGDYVDREAIFLEVKYDDLYHCLVSKDHGKVYVQVTKKAVSTSSGVSIPGPSHQKPMVHVKSEVLAVKLSQEINYAKSLYYEQQLMLRLSENREQLELDS

SEQ ID NO: 96155 - protein, 839 aa, Homo sapiens
  Payload ID: 19194
  Gene Name: vacuolar protein sorting 16 homolog (S. cerevisiae)
  Uniprot ID: Q9H269
  ENSP ID: ENSP00000369810
MDCYTANWNPLGDSAFYRKYELYSMDWDLKEELRDCLVAAAPYGGPIALLRNPWRKEKAASVRPVLDIYSASGMPLASLLWKSGPVVSLGWSAEEELLCVQEDGAVLVYGLHGDFRRHFSMGNEVLQNRVLDARIFHTEFGSGVAILTGAHRFTLSANVGDLKLRRMPEVPGLQSAPSCWTVLCQDRVAHILLAVGPDLYLLDHAACSAVTPPGLAPGVSSFLQMAVSFTYRHLALFTDTGYIWMGTASLKEKLCEFNCNIRAPPKQMVWCSRPRSKERAVVVAWERRLMVVGDAPESIQFVLDEDSYLVPELDGVRIFSRSTHEFLHEVPAASEEIFKIASMAPGALLLEAQKEYEKESQKADEYLREIQELGQLTQAVQQCIEAAGHEHQPDMQKSLLRAASFGKCFLDRFPPDSFVHMCQDLRVLNAVRDYHIGIPLTYSQYKQLTIQVLLDRLVLRRLYPLAIQICEYLRLPEVQGVSRILAHWACYKVQQKDVSDEDVARAINQKLGDTPGVSYSDIAARAYGCGRTELAIKLLEYEPRSGEQVPLLLKMKRSKLALSKAIESGDTDLVFTVLLHLKNELNRGDFFMTLRNQPMALSLYRQFCKHQELETLKDLYNQDDNHQELGSFHIRASYAAEERIEGRVAALQTAADAFYKAKNEFAAKATEDQMRLLRLQRRLEDELGGQFLDLSLHDTVTTLILGGHNKRAEQLARDFRIPDKRLWWLKLTALADLEDWEELEKFSKSKKSPIGYLPFVEICMKQHNKYEAKKYASRVGPEQKVKALLLVGDVAQAADVAIEHRNEAELSLVLSHCTGATDGATADKIQRARAQAQKK

SEQ ID NO: 96156 - protein, 695 aa, Homo sapiens
  Payload ID: 19194
  Gene Name: vacuolar protein sorting 16 homolog (S. cerevisiae)
  Uniprot ID: Q9H269
  ENSP ID: ENSP00000369836
MDCYTANWNPLGDSAFYRKYELYSMDWDLKEELRDCLVAAAPYGGPIALLRNPWRKEKAASVRPVLDIYSASGMPLASLLWKSGPVVSLGWSAEEELLCVQEDGAVLVYGLHGDFRRHFSMGNEVLQNRVLDARIFHTEFGSGVAILTGAHRFTLSANVGDLKLRRMPEVPGLQSAPSCWTVLCQDRVAHILLAVGPDLYLLDHAACSAVTPPGLAPGVSSFLQMAVSFTYRHLALFTDTGYIWMGTASLKEKLCEFNCNIRAPPKQMVWCSRPRSKERAVVVAWERRLMVVGDAPESIQYKQLTIQVLLDRLVLRRLYPLAIQICEYLRLPEVQGVSRILAHWACYKVQQKDVSDEDVARAINQKLGDTPGVSYSDIAARAYGCGRTELAIKLLEYEPRSGEQVPLLLKMKRSKLALSKAIESGDTDLVFTVLLHLKNELNRGDFFMTLRNQPMALSLYRQFCKHQELETLKDLYNQDDNHQELGSFHIRASYAAEERIEGRVAALQTAADAFYKAKNEFAAKATEDQMRLLRLQRRLEDELGGQFLDLSLHDTVTTLILGGHNKRAEQLARDFRIPDKRLWWLKLTALADLEDWEELEKFSKSKKSPIGYLPFVEICMKQHNKYEAKKYASRVGPEQKVKALLLVGDVAQAADVAIEHRNEAELSLVLSHCTGATDGATADKIQRARAQAQKK

SEQ ID NO: 96157 - protein, 226 aa, Homo sapiens
  Payload ID: 19194
  Gene Name: vacuolar protein sorting 16 homolog (S. cerevisiae)
  ENSP ID: ENSP00000409840
MGAPLEVLQNRVLDARIFHTEFGSGVAILTGAHRFTLSANVGDLKLRRMPEVPGLQSAPSCWTVLCQDRVAHILLAVGPDLYLLDHAACSAVTPPGLAPGVSSFLQMAVSFTYRHLALFTDTGYIWMGTASLKEKLCEFNCNIRAPPKQMVWCSRPRSKERAVVVAWERRLMVVGDAPESIQFVLDEDSYLVPELDGVRIFSRSTHEFLHEVPAASEEIFKIASMA

SEQ ID NO: 96158 - protein, 274 aa, Homo sapiens
  Payload ID: 19194
  Gene Name: vacuolar protein sorting 16 homolog (S. cerevisiae)
  ENSP ID: ENSP00000417031
MGAPLEVLQNRVLDARIFHTEFGSGVAILTGAHRFTLSANVGDLKLRRMPEVPGLQSAPSCWTVLCQDRVAHILLAVGPDLYLLDHAACSAVTPPGLAPGVSSFLQMAVSFTYRHLALFTDTGYIWMGTASLKEKLCEFNCNIRAPPKQMVWCSRPRSKERAVVVAWERRLMVVGDAPESIQYKQLTIQVLLDRLVLRRLYPLAIQICEYLRLPEVQGVSRILAHWACYKVQQKDVSDEDVARAINQKLGDTPGVSYSDIAARAYGCGRTELAI

SEQ ID NO: 96159 - protein, 973 aa, Homo sapiens
  Payload ID: 19195
  Gene Name: vacuolar protein sorting 18 homolog (S. cerevisiae)
  Uniprot ID: Q9P253
  ENSP ID: ENSP00000220509
MASILDEYENSLSRSAVLQPGCPSVGIPHSGYVNAQLEKEVPIFTKQRIDFTPSERITSLVVSSNQLCMSLGKDTLLRIDLGKANEPNHVELGRKDDAKVHKMFLDHTGSHLLIALSSTEVLYVNRNGQKVRPLARWKGQLVESVGWNKALGTESSTGPILVGTAQGHIFEAELSASEGGLFGPAPDLYFRPLYVLNEEGGPAPVCSLEAERGPDGRSFVIATTRQRLFQFIGRAAEGAEAQGFSGLFAAYTDHPPPFREFPSNLGYSELAFYTPKLRSAPRAFAWMMGDGVLYGALDCGRPDSLLSEERVWEYPEGVGPGASPPLAIVLTQFHFLLLLADRVEAVCTLTGQVVLRDHFLEKFGPLKHMVKDSSTGQLWAYTERAVFRYHVQREARDVWRTYLDMNRFDLAKEYCRERPDCLDTVLAREADFCFRQRRYLESARCYALTQSYFEEIALKFLEARQEEALAEFLQRKLASLKPAERTQATLLTTWLTELYLSRLGALQGDPEALTLYRETKECFRTFLSSPRHKEWLFASRASIHELLASHGDTEHMVYFAVIMQDYERVVAYHCQHEAYEEALAVLARHRDPQLFYKFSPILIRHIPRQLVDAWIEMGSRLDARQLIPALVNYSQGGEVQQVSQAIRYMEFCVNVLGETEQAIHNYLLSLYARGRPDSLLAYLEQAGASPHRVHYDLKYALRLCAEHGHHRACVHVYKVLELYEEAVDLALQVDVDLAKQCADLPEEDEELRKKLWLKIARHVVQEEEDVQTAMACLASCPLLKIEDVLPFFPDFVTIDHFKEAICSSLKAYNHHIQELQREMEEATASAQRIRRDLQELRGRYGTVEPQDKCATCDFPLLNRPFYLFLCGHMFHADCLLQAVRPGLPAYKQARLEELQRKLGAAPPPAKGSARAKEAEGGAATAGPSREQLKADLDELVAAECVYCGELMIRSIDRPFIDPQRYEEEQLSWL

SEQ ID NO: 96160 - protein, 130 aa, Homo sapiens
  Payload ID: 19195
  Gene Name: vacuolar protein sorting 18 homolog (S. cerevisiae)
  ENSP ID: ENSP00000453265
MASILDEYENSLSRSAVLQPGCPSVGIPHSGYVNAQLEKEVPIFTKQRIDFTPSERITSLVVSSNQLCMSLGKDTLLRDGISPCCPVWSQTPELKQSTHLGLPKCWDYRLSQCTWPVFSILCIDVYFREH

SEQ ID NO: 96161 - protein, 121 aa, Homo sapiens
  Payload ID: 19195
  Gene Name: vacuolar protein sorting 18 homolog (S. cerevisiae)
  ENSP ID: ENSP00000453555
MASILDEYENSLSRSAVLQPGCPSVGIPHSGYVNAQLEKEVPIFTKQRIDFTPSERITSLVVSSNQLCMSLGKDTLLRIDLGKANEPNHVELGRKDDAKVHKMFLDHTGGCGPGQAVCRPA

SEQ ID NO: 96162 - protein, 176 aa, Homo sapiens
  Payload ID: 19196
  Gene Name: vacuolar protein sorting 25 homolog (S. cerevisiae)
  Uniprot ID: Q9BRG1
  ENSP ID: ENSP00000253794
MAMSFEWPWQYRFPPFFTLQPNVDTRQKQLAAWCSLVLSFCRLHKQSSMTVMEAQESPLFNNVKLQRKLPVESIQIVLEELRKKGNLEWLDKSKSSFLIMWRRPEEWGKLIYQWVSRSGQNNSVFTLYELTNGEDTEDEEFHGLDEATLLRALQALQQEHKAEIITVSDGRGVKFF

SEQ ID NO: 96163 - protein, 111 aa, Homo sapiens
  Payload ID: 19196
  Gene Name: vacuolar protein sorting 25 homolog (S. cerevisiae)
  ENSP ID: ENSP00000465798
  MOD_RES (1)..(1): Any amino acid
XRFPPFFTLQPNVDTRQKQLAAWCSLVLSFCRLHKQSSMTVMEAQESPLFNNVKLQRKLPVESIQIVLEELRKKEFHGLDEATLLRALQALQQEHKAEIITVSDGRGVKFF

SEQ ID NO: 96164 - protein, 108 aa, Homo sapiens
  Payload ID: 19196
  Gene Name: vacuolar protein sorting 25 homolog (S. cerevisiae)
  ENSP ID: ENSP00000466909
MTVMEAQESPLFNNVKLQRKLPVESIQIVLEELRKKGNLEWLDKSKSSFLIMWRRPEEWGKLIYQWVSRSGQNNSVFTLYELTNGEDTEDEEFHGLDEATLLRALQAL

SEQ ID NO: 96165 - protein, 99 aa, Homo sapiens
  Payload ID: 19196
  Gene Name: vacuolar protein sorting 25 homolog (S. cerevisiae)
  ENSP ID: ENSP00000467225
MAMSFEWPWQYRFPPFFTLQPNVDTRQKQLAAWCSLVLSFCRLHKQSSMTVMEAQESPLFNNVKLQRILPQALPQPIHMHFCAFTHAQTPPRASPLLPM

SEQ ID NO: 96166 - protein, 221 aa, Homo sapiens
  Payload ID: 19197
  Gene Name: vacuolar protein sorting 28 homolog (S. cerevisiae)
  Uniprot ID: Q9UK41
  ENSP ID: ENSP00000292510
MFHGIPATPGIGAPGNKPELYEEVKLYKNAREREKYDNMAELFAVVKTMQALEKAYIKDCVSPSEYTAACSRLLVQYKAAFRQVQGSEISSIDEFCRKFRLDCPLAMERIKEDRPITIKDDKGNLNRCIADVVSLFITVMDKLRLEIRAMDEIQPDLRELMETMHRMSHLPPDFEGRQTVSQWLQTLSGMSASDELDDSQVRQMLFDLESAYNAFNRFLHA

SEQ ID NO: 96167 - protein, 233 aa, Homo sapiens
  Payload ID: 19197
  Gene Name: vacuolar protein sorting 28 homolog (S. cerevisiae)
  Uniprot ID: Q9UK41
  ENSP ID: ENSP00000366565
MFHGIPATPGIGAPGNKPELYEEVKLYKNAREREKYDNMAELFAVVKTMQALEKAYIKDCVSPSEYTAACSRLLVQYKAAFRQVQGSEISSIDEFCRKFRLDCPLAMERIKEDRPITIKDDKGNLNRCIADVVSLFITVMDKLRLEIRAMDEIQPDLRELMETMHRMSHLPPDFEGRQTVSQWWVSLPARQSPAVPETLPARRSPAVPLRPSAPTCPVLHSQAADPERHVGVR

SEQ ID NO: 96168 - protein, 185 aa, Homo sapiens
  Payload ID: 19197
  Gene Name: vacuolar protein sorting 28 homolog (S. cerevisiae)
  ENSP ID: ENSP00000431243
MFHGIPATPGIGAPGNKPELYEEVKLYKNAREREKYDNMAELFAVVKTMQALEKAYIKDCVSPSEQVQGSEISSIDEFCRKFRLDCPLAMERIKEDRPITIKDDKGNLNRCIADVVSLFITVMDKLRLEIRAMDEIQPDLRELMETMHRMSHLPPDFEGRQTVSQWLQTLSGMSASDELDDSQVR

SEQ ID NO: 96169 - protein, 53 aa, Homo sapiens
  Payload ID: 19197
  Gene Name: vacuolar protein sorting 28 homolog (S. cerevisiae)
  ENSP ID: ENSP00000432395
MFHGIPATPGIGAPGNKPELYEEVKLYKNAREREKYDNMAELFAVVKTMQALE

SEQ ID NO: 96170 - protein, 35 aa, Homo sapiens
  Payload ID: 19197
  Gene Name: vacuolar protein sorting 28 homolog (S. cerevisiae)
  ENSP ID: ENSP00000433228
MFHGIPATPGIGAPGNKPELYEEVKLYKNAREREK

SEQ ID NO: 96171 - protein, 221 aa, Homo sapiens; identical to SEQ ID NO: 96166
  Payload ID: 19197
  Gene Name: vacuolar protein sorting 28 homolog (S. cerevisiae)
  Uniprot ID: Q9UK41
  ENSP ID: ENSP00000434064

SEQ ID NO: 96172 - protein, 161 aa, Homo sapiens
  Payload ID: 19197
  Gene Name: vacuolar protein sorting 28 homolog (S. cerevisiae)
  ENSP ID: ENSP00000434393
MFHGIPATPGIGAPGNKPELYEEVKLYKNAREREKYDNMAELFAVVKTMQALEKAYIKDCVSPSEYTAACSRLLVQYKAAFRQVQGSEISSIDEFCRKFRLDCPLAMERIKEDRPITIKDDKGNLNRCIADVVSLFITVMDKLRLEIRAMDEIQPDLRELM

SEQ ID NO: 96173 - protein, 233 aa, Homo sapiens; identical to SEQ ID NO: 96167
  Payload ID: 19197
  Gene Name: vacuolar protein sorting 28 homolog (S. cerevisiae)
  Uniprot ID: Q9UK41
  ENSP ID: ENSP00000434556

SEQ ID NO: 96174 - protein, 35 aa, Homo sapiens; identical to SEQ ID NO: 96170
  Payload ID: 19197
  Gene Name: vacuolar protein sorting 28 homolog (S. cerevisiae)
  ENSP ID: ENSP00000436102

SEQ ID NO: 96175 - protein, 596 aa, Homo sapiens
  Payload ID: 19198
  Gene Name: vacuolar protein sorting 33 homolog A (S. cerevisiae)
  Uniprot ID: Q96AX1
  ENSP ID: ENSP00000267199
MAAHLSYGRVNLNVLREAVRRELREFLDKCAGSKAIVWDEYLTGPFGLIAQYSLLKEHEVEKMFTLKGNRLPAADVKNIIFFVRPRLELMDIIAENVLSEDRRGPTRDFHILFVPRRSLLCEQRLKDLGVLGSFIHREEYSLDLIPFDGDLLSMESEGAFKECYLEGDQTSLYHAAKGLMTLQALYGTIPQIFGKGECARQVANMMIRMKREFTGSQNSIFPVFDNLLLLDRNVDLLTPLATQLTYEGLIDEIYGIQNSYVKLPPEKFAPKKQGDGGKDLPTEAKKLQLNSAEELYAEIRDKNFNAVGSVLSKKAKIISAAFEERHNAKTVGEIKQFVSQLPHMQAARGSLANHTSIAELIKDVTTSEDFFDKLTVEQEFMSGIDTDKVNNYIEDCIAQKHSLIKVLRLVCLQSVCNSGLKQKVLDYYKREILQTYGYEHILTLHNLEKAGLLKPQTGGRNNYPTIRKTLRLWMDDVNEQNPTDISYVYSGYAPLSVRLAQLLSRPGWRSIEEVLRILPGPHFEERQPLPTGLQKKRQPGENRVTLIFFLGGVTFAEIAALRFLSQLEDGGTEYVIATTKLMNGTSWIEALMEKPF

SEQ ID NO: 96176 - protein, 154 aa, Homo sapiens
  Payload ID: 19198
  Gene Name: vacuolar protein sorting 33 homolog A (S. cerevisiae)
  ENSP ID: ENSP00000439255
MFCFQQVANMMIRMKREFTGSQNSIFPVFDNLLLLDRNVDLLTPLATQLTYEGLIDEIYGIQNSYVKLPPEKFAPKKQGDGGKDLPTEAKKLQLNSAEELYAEIRDKNFNAVGSVLSKKAKIISAAFEERHNAKTVGEIKQFVSQLPHMQAARG

SEQ ID NO: 96177 - protein, 42 aa, Homo sapiens
  Payload ID: 19198
  Gene Name: vacuolar protein sorting 33 homolog A (S. cerevisiae)
  ENSP ID: ENSP00000442392
MAAHLSYGRVNLNVLREAVRRELREFLDKCAGSKGLSVTLSY

SEQ ID NO: 96178 - protein, 186 aa, Homo sapiens
  Payload ID: 19198
  Gene Name: vacuolar protein sorting 33 homolog A (S. cerevisiae)
  ENSP ID: ENSP00000442951
MAAHLSYGRVNLNVLREAVRRELREFLDKCAGSKAIVWDEYLTGPFGLIAQYSLLKEHEVEKMFTLKGNRLPAADVKNIIFFVRPRLELMDIIAENVLSEDRRGPTRDFHILFVPRRSLLCEQRLKDLGVLGSFIHREEYSLDLIPFDGDLLSMESEGAFKSCSVAPAGVQWHNLSSLQPPPPEFK

SEQ ID NO: 96179 - protein, 617 aa, Homo sapiens
  Payload ID: 19199
  Gene Name: vacuolar protein sorting 33 homolog B (yeast)
  Uniprot ID: Q9H267
  ENSP ID: ENSP00000327650
MAFPHRPDAPELPDFSMLKRLARDQLIYLLEQLPGKKDLFIEADLMSPLDRIANVSILKQHEVDKLYKVENKPALSSNEQLCFLVRPRIKNMRYIASLVNADKLAGRTRKYKVIFSPQKFYACEMVLEEEGIYGDVSCDEWAFSLLPLDVDLLSMELPEFFRDYFLEGDQRWINTVAQALHLLSTLYGPFPNCYGIGRCAKMAYELWRNLEEEEDGETKGRRPEIGHIFLLDRDVDFVTALCSQVVYEGLVDDTFRIKCGSVDFGPEVTSSDKSLKVLLNAEDKVFNEIRNEHFSNVFGFLSQKARNLQAQYDRRRGMDIKQMKNFVSQELKGLKQEHRLLSLHIGACESIMKKKTKQDFQELIKTEHALLEGFNIRESTSYIEEHIDRQVSPIESLRLMCLLSITENGLIPKDYRSLKTQYLQSYGPEHLLTFSNLRRAGLLTEQAPGDTLTAVESKVSKLVTDKAAGKITDAFSSLAKRSNFRAISKKLNLIPRVDGEYDLKVPRDMAYVFGGAYVPLSCRIIEQVLERRSWQGLDEVVRLLNCSDFAFTDMTKEDKASSESLRLILVVFLGGCTFSEISALRFLGREKGYRFIFLTTAVTNSARLMEAMSEVKA

SEQ ID NO: 96180 - protein, 590 aa, Homo sapiens
  Payload ID: 19199
  Gene Name: vacuolar protein sorting 33 homolog B (yeast)
  ENSP ID: ENSP00000444053
MAFPHRPDAPELPDFSMLKRLARDQLIYLLEQQHEVDKLYKVENKPALSSNEQLCFLVRPRIKNMRYIASLVNADKLAGRTRKYKVIFSPQKFYACEMVLEEEGIYGDVSCDEWAFSLLPLDVDLLSMELPEFFRDYFLEGDQRWINTVAQALHLLSTLYGPFPNCYGIGRCAKMAYELWRNLEEEEDGETKGRRPEIGHIFLLDRDVDFVTALCSQVVYEGLVDDTFRIKCGSVDFGPEVTSSDKSLKVLLNAEDKVFNEIRNEHFSNVFGFLSQKARNLQAQYDRRRGMDIKQMKNFVSQELKGLKQEHRLLSLHIGACESIMKKKTKQDFQELIKTEHALLEGFNIRESTSYIEEHIDRQVSPIESLRLMCLLSITENGLIPKDYRSLKTQYLQSYGPEHLLTFSNLRRAGLLTEQAPGDTLTAVESKVSKLVTDKAAGKITDAFSSLAKRSNFRAISKKLNLIPRVDGEYDLKVPRDMAYVFGGAYVPLSCRIIEQVLERRSWQGLDEVVRLLNCSDFAFTDMTKEDKASSESLRLILVVFLGGCTFSEISALRFLGREKGYRFIFLTTAVTNSARLMEAMSEVKA

SEQ ID NO: 96181 - protein, 80 aa, Homo sapiens
  Payload ID: 19199
  Gene Name: vacuolar protein sorting 33 homolog B (yeast)
  ENSP ID: ENSP00000460413
MAFPHRPDAPELPDFSMLKRLARDQLIYLLEQLPGKKDLFIEADLMSPLDRIANVSILKIVLLGQTPHQEYAIHCQSCQC

SEQ ID NO: 96182 - protein, 386 aa, Homo sapiens
  Payload ID: 19200
  Gene Name: vacuolar protein sorting 36 homolog (S. cerevisiae)
  Uniprot ID: Q86VN1
  ENSP ID: ENSP00000367299
MDRFVWTSGLLEINETLVIQQRGVRIYDGEEKIKFDAGTLLLSTHRLIWRDQKNHECCMAILLSQIVFIEEQAAGIGKSAKIVVHLHPAPPNKEPGPFQSSKNSYIKLSFKEHGQIEFYRRLSEEMTQRRWENMPVSQSLQTNRGPQPGRIRAVGIVGIERKLEEKRKETDKNISEAFEDLSKLMIKAKEMVELSKSIANKIKDKQGDITEDETIRFKSYLLSMGIANPVTRETYGSGTQYHMQLAKQLAGILQVPLEERGGIMSLTEVYCLVNRARGMELLSPEDLVNACKMLEALKLPLRLRVFDSGVMVIELQSHKEEEMVASALETVSEKGSLTSEEFAKLVGMSVLLAKERLLLAEKMGHLCRDDSVEGLRFYPNLFMTQS

SEQ ID NO: 96183 - protein, 328 aa, Homo sapiens
  Payload ID: 19200
  Gene Name: vacuolar protein sorting 36 homolog (S. cerevisiae)
  Uniprot ID: Q86VN1
  ENSP ID: ENSP00000484968
MAILLSQIVFIEEQAAGIGKSAKIVVHLHPAPPNKEPGPFQSSKNSYIKLSFKEHGQIEFYRRLSEEMTQRRWENMPVSQSLQTNRGPQPGRIRAVGIVGIERKLEEKRKETDKNISEAFEDLSKLMIKAKEMVELSKSIANKIKDKQGDITEDETIRFKSYLLSMGIANPVTRETYGSGTQYHMQLAKQLAGILQVPLEERGGIMSLTEVYCLVNRARGMELLSPEDLVNACKMLEALKLPLRLRVFDSGVMVIELQSHKEEEMVASALETVSEKGSLTSEEFAKLVGMSVLLAKERLLLAEKMGHLCRDDSVEGLRFYPNLFMTQS

SEQ ID NO: 96184 - protein, 397 aa, Homo sapiens
  Payload ID: 19201
  Gene Name: vacuolar protein sorting 37 homolog A (S. cerevisiae)
  Uniprot ID: Q8NEZ2
  ENSP ID: ENSP00000318629
MSWLFPLTKSASSSAAGSPGGLTSLQQQKQRLIESLRNSHSSIAEIQKDVEYRLPFTINNLTININILLPPQFPQEKPVISVYPPIRHHLMDKQGVYVTSPLVNNFTMHSDLGKIIQSLLDEFWKNPPVLAPTSTAFPYLYSNPSGMSPYASQGFPFLPPYPPQEANRSITSLSVADTVSSSTTSHTTAKPAAPSFGVLSNLPLPIPTVDASIPTSQNGFGYKMPDVPDAFPELSELSVSQLTDMNEQEEVLLEQFLTLPQLKQIITDKDDLVKSIEELARKNLLLEPSLEAKRQTVLDKYELLTQMKSTFEKKMQRQHELSESCSASALQARLKVAAHEAEEESDNIAEDFLEGKMEIDDFLSSFMEKRTICHCRRAKEEKLQQAIAMHSQFHAPL

SEQ ID NO: 96185 - protein, 185 aa, Homo sapiens
  Payload ID: 19201
  Gene Name: vacuolar protein sorting 37 homolog A (S. cerevisiae)
  Uniprot ID: Q8NEZ2
  ENSP ID: ENSP00000412824
MSWLFPLTKSASSSAAGSPGGLTSLQQQKQRLIESLRNSHSSIAEIQKDVEYRLPFTINNLTININILLPPQFPQEKPVISVYPPIRHHLMDKQGVYVTSPLVNNFTMHSDLGKIIQSLLDEFWKNPPVLAPTSTAFPYQLEIRWHHPHCLEISLARSSNSLGFSISSSISSTRSKQEYHFFICC

SEQ ID NO: 96186 - protein, 317 aa, Homo sapiens
  Payload ID: 19201
  Gene Name: vacuolar protein sorting 37 homolog A (S. cerevisiae)
  ENSP ID: ENSP00000428823
MSWLFPLTKSASSSAAGSPGGLTSLQQQKQRLIESLRNSHSSIAEIQKDVEYRLPFTINNLTININILLPPQFPQEKPVISVYPPIRHHLMDKQGVYVTSPLVNNFTMHSDLGKIIQSLLDEFWKNPPVLAPTSTAFPYLYSNPSGMSPYASQGFPFLPPYPPQEANRSITSLSVADTVSSSTTSHTTAKPAAPSFGVLSNLPLPIPTVDASIPTSQNGFGYKMPDVPDAFPELSELRSLYNCEHFPTVVIFKESRYIDISIGPKFTFTDSVKNILQTALCSIVVDVLFDFKVKTGSLRCICKNYLEPYQLTKAEKL

SEQ ID NO: 96187 - protein, 53 aa, Homo sapiens
  Payload ID: 19201
  Gene Name: vacuolar protein sorting 37 homolog A (S. cerevisiae)
  ENSP ID: ENSP00000429227
MSWLFPLTKSASSSAAGSPGGLTSLQQQKQRLIESLRNSHSRYKLCWLSRFCD

SEQ ID NO: 96188 - protein, 372 aa, Homo sapiens
  Payload ID: 19201
  Gene Name: vacuolar protein sorting 37 homolog A (S. cerevisiae)
  Uniprot ID: Q8NEZ2
  ENSP ID: ENSP00000429680
MSWLFPLTKSASSSAAGSPGGLTSLQQQKQRLIESLRNSHSRLLPPQFPQEKPVISVYPPIRHHLMDKQGVYVTSPLVNNFTMHSDLGKIIQSLLDEFWKNPPVLAPTSTAFPYLYSNPSGMSPYASQGFPFLPPYPPQEANRSITSLSVADTVSSSTTSHTTAKPAAPSFGVLSNLPLPIPTVDASIPTSQNGFGYKMPDVPDAFPELSELSVSQLTDMNEQEEVLLEQFLTLPQLKQIITDKDDLVKSIEELARKNLLLEPSLEAKRQTVLDKYELLTQMKSTFEKKMQRQHELSESCSASALQARLKVAAHEAEEESDNIAEDFLEGKMEIDDFLSSFMEKRTICHCRRAKEEKLQQAIAMHSQFHAPL

SEQ ID NO: 96189 - protein, 170 aa, Homo sapiens
  Payload ID: 19201
  Gene Name: vacuolar protein sorting 37 homolog A (S. cerevisiae)
  ENSP ID: ENSP00000429858
PDAFPELSELSVSQLTDMNEQEEVLLEQFLTLPQLKQIITDKDDLVKSIEELARKNLLLEPSLEAKRQTVLDKYELLTQMKSTFEKKMQRQHELSESCSASALQARLKVAAHEAEEESDNIAEDFLEGKMEIDDFLSSFMEKRTICHCRRAKEEKLQQAIAMHSQFHAPL

SEQ ID NO: 96190 - protein, 116 aa, Homo sapiens
  Payload ID: 19201
  Gene Name: vacuolar protein sorting 37 homolog A (S. cerevisiae)
  ENSP ID: ENSP00000430456
MSWLFPLTKSASSSAAGSPGGLTSLQQQKQRLIESLRNSHSRLERSGAISVHCNLRLPDSSNHPPSAPHTPPSSWDYRLLPPQFPQEKPVISVYPPIRHHLMDKQGVYVTSPLVNN

SEQ ID NO: 96191 - protein, 76 aa, Homo sapiens
  Payload ID: 19201
  Gene Name: vacuolar protein sorting 37 homolog A (S. cerevisiae)
  ENSP ID: ENSP00000430933
MSWLFPLTKSASSSAAGSPGGLTSLQQQKQRLIESLRNSHSSLFPVSLAAQASPLIFPFAHLIAASAELLKYNCEE

SEQ ID NO: 96192 - protein, 285 aa, Homo sapiens
  Payload ID: 19202
  Gene Name: vacuolar protein sorting 37 homolog B (S. cerevisiae)
  Uniprot ID: Q9H9H4
  ENSP ID: ENSP00000267202
MAGAGSEARFAGLSLVQLNELLEDEGQLTEMVQKMEETQNVQLNKEMTLASNRSLAEGNLLYQPQLDTLKARLTQKYQELQVLFEAYQIKKTKLDRQSSSASLETLLALLQAEGAKIEEDTENMAEKFLDGELPLDSFIDVYQSKRKLAHMRRVKIEKLQEMVLKGQRLPQALAPLPPRLPELAPTAPLPYPAPEASGPPAVAPRRIPPPPPPVPAGRLATPFTAAMSSGQAVPYPGLQCPPLPPRVGLPTQQGFSSQFVSPYPPPLPQRPPPRLPPHQPGFILQ

SEQ ID NO: 96193 - protein, 184 aa, Homo sapiens
  Payload ID: 19202
  Gene Name: vacuolar protein sorting 37 homolog B (S. cerevisiae)
  ENSP ID: ENSP00000360294
MQSGCVLELRNAGLVACLALITVFVAECCYGDSCQTQNVQLNKEMTLASNRSLAEGNLLYQPQLDTLKARLTQKYQELQVLFEAYQIKKTKLDRQSSSASLETLLALLQAEGAKIEEDTENMAEKFLDGELPLDSFIDVYQSKRKLAHMRRVKIEKLQEMVLKGQRLPQALAPLPPRLPELAPT

SEQ ID NO: 96194 - protein, 271 aa, Homo sapiens
  Payload ID: 19202
  Gene Name: vacuolar protein sorting 37 homolog B (S. cerevisiae)
  ENSP ID: ENSP00000446075
MAGAGSEARFAGLSLVQLNELLEDEGQLTEMVQKMEENVQLNKEMTLASNRSLAEGNLLYQPQLDTLKARLTQKYQELQVLFEAYQIKKTKLDRQSSSASLETLLALLQAEGAKIEEDTENMAEKFLDGELPLDSFIDVYQSKRKLAHMRRVKIEKLQEMVLKGQRLPQALAPLPPRLPELAPTAPLPYPAPEASGPPAVAPRRIPPPPPPVPAGRLATPFTAAMSSGQAVPYPGLQCPPLPPRVGLPTQQGFSSQFVSPYPPPLPQRPPP

SEQ ID NO: 96195 - protein, 355 aa, Homo sapiens
  Payload ID: 19203
  Gene Name: vacuolar protein sorting 37 homolog C (S. cerevisiae)
  Uniprot ID: A5D8V6
  ENSP ID: ENSP00000301765
METLKDKTLQELEELQNDSEAIDQLALESPEVQDLQLEREMALATNRSLAERNLEFQGPLEISRSNLSDRYQELRKLVERCQEQKAKLEKFSSALQPGTLLDLLQVEGMKIEEESEAMAEKFLEGEVPLETFLENFSSMRMLSHLRRVRVEKLQEVVRKPRASQELAGDAPPPRPPPPVRPVPQGTPPVVEEQPQPPLAMPPYPLPYSPSPSLPVGPTAHGALPPAPFPVVSQPSFYSGPLGPTYPAAQLGPRGAAGYSWSPQRSMPPRPGYPGTPMGASGPGYPLRGGRAPSPGYPQQSPYPATGGKPPYPIQPQLPSFPGQPQPSVPLQPPYPPGPAPPYGFPPPPGPAWPGY

SEQ ID NO: 96196 - protein, 148 aa, Homo sapiens
  Payload ID: 19203
  Gene Name: vacuolar protein sorting 37 homolog C (S. cerevisiae)
  ENSP ID: ENSP00000446013
METLKDKTLQELEELQNDSEAIDQLALESPEVQDLQLEREMALATNRSLAERNLEFQGPLEISRSNLSDRYQELRKLVERCQEQKAKLEKFSSALQPGTLLDLLQVEGMKIEEESEAMAEKFLEGEVPLETFLENFSSMRMLSHLRRV

SEQ ID NO: 96197 - protein, 251 aa, Homo sapiens
  Payload ID: 19204
  Gene Name: vacuolar protein sorting 37 homolog D (S. cerevisiae)
  Uniprot ID: Q86XT2
  ENSP ID: ENSP00000320416
MYRARAARAGPEPGSPGRFGILSTGQLRDLLQDEPKLDRIVRLSRKFQGLQLEREACLASNYALAKENLALRPRLEMGRAALAIKYQELREVAENCADKLQRLEESMHRWSPHCALGWLQAELEEAEQEAEEQMEQLLLGEQSLEAFLPAFQRGRALAHLRRTQAEKLQELLRRRERSAQPAPTSAADPPKSFPAAAVLPTGAARGPPAVPRSLPPLDSRPVPPLKGSPGCPLGPAPLLSPRPSQPEPPHR

SEQ ID NO: 96198 - protein, 166 aa, Homo sapiens
  Payload ID: 19204
  Gene Name: vacuolar protein sorting 37 homolog D (S. cerevisiae)
  ENSP ID: ENSP00000413337
MYRARAARAGPEPGSPGRFGILSTGQLRDLLQDEPKLDRIVRLSRKEQMEQLLLGEQSLEAFLPAFQRGRALAHLRRTQAEKLQELLRRRERSAQPAPTSAADPPKSFPAAAVLPTGAARGPPAVPRSLPPLDSRPVPPLKGSPGCPLGPAPLLSPRPSQPEPPHR

SEQ ID NO: 96199 - protein, 875 aa, Homo sapiens
  Payload ID: 19205
  Gene Name: vacuolar protein sorting 39 homolog (S. cerevisiae)
  Uniprot ID: Q96JC1
  ENSP ID: ENSP00000326534
MHDAFEPVPILEKLPLQIDCLAAWEEWLLVGTKQGHLLLYRIRKDVGCNRFEVTLEKSNKNFSKKIQQIHVVSQFKILVSLLENNIYVHDLLTFQQITTVSKAKGASLFTCDLQHTETGEEVLRMCVAVKKKLQLYFWKDREFHELQGDFSVPDVPKSMAWCENSICVGFKRDYYLIRVDGKGSIKELFPTGKQLEPLVAPLADGKVAVGQDDLTVVLNEEGICTQKCALNWTDIPVAMEHQPPYIIAVLPRYVEIRTFEPRLLVQSIELQRPRFITSGGSNIIYVASNHFVWRLIPVPMATQIQQLLQDKQFELALQLAEMKDDSDSEKQQQIHHIKNLYAFNLFCQKRFDESMQVFAKLGTDPTHVMGLYPDLLPTDYRKQLQYPNPLPVLSGAELEKAHLALIDYLTQKRSQLVKKLNDSDHQSSTSPLMEGTPTIKSKKKLLQIIDTTLLKCYLHTNVALVAPLLRLENNHCHIEESEHVLKKAHKYSELIILYEKKGLHEKALQVLVDQSKKANSPLKGHERTVQYLQHLGTENLHLIFSYSVWVLRDFPEDGLKIFTEDLPEVESLPRDRVLGFLIENFKGLAIPYLEHIIHVWEETGSRFHNCLIQLYCEKVQGLMKEYLLSFPAGKTPVPAGEEEGELGEYRQKLLMFLEISSYYDPGRLICDFPFDGLLEERALLLGRMGKHEQALFIYVHILKDTRMAEEYCHKHYDRNKDGNKDVYLSLLRMYLSPPSIHCLGPIKLELLEPKANLQAALQVLELHHSKLDTTKALNLLPANTQINDIRIFLEKVLEENAQKKRFNQVLKNLLHAEFLRVQEERILHQQVKCIITEEKVCMVCKKKIGNSAFARYPNGVVVHYFCSKEVNPADT

SEQ ID NO: 96200 - protein, 886 aa, Homo sapiens
  Payload ID: 19205
  Gene Name: vacuolar protein sorting 39 homolog (S. cerevisiae)
  Uniprot ID: Q96JC1
  ENSP ID: ENSP00000335193
MHDAFEPVPILEKLPLQIDCLAAWEEWLLVGTKQGHLLLYRIRKDVVPADVASPESGSCNRFEVTLEKSNKNFSKKIQQIHVVSQFKILVSLLENNIYVHDLLTFQQITTVSKAKGASLFTCDLQHTETGEEVLRMCVAVKKKLQLYFWKDREFHELQGDFSVPDVPKSMAWCENSICVGFKRDYYLIRVDGKGSIKELFPTGKQLEPLVAPLADGKVAVGQDDLTVVLNEEGICTQKCALNWTDIPVAMEHQPPYIIAVLPRYVEIRTFEPRLLVQSIELQRPRFITSGGSNIIYVASNHFVWRLIPVPMATQIQQLLQDKQFELALQLAEMKDDSDSEKQQQIHHIKNLYAFNLFCQKRFDESMQVFAKLGTDPTHVMGLYPDLLPTDYRKQLQYPNPLPVLSGAELEKAHLALIDYLTQKRSQLVKKLNDSDHQSSTSPLMEGTPTIKSKKKLLQIIDTTLLKCYLHTNVALVAPLLRLENNHCHIEESEHVLKKAHKYSELIILYEKKGLHEKALQVLVDQSKKANSPLKGHERTVQYLQHLGTENLHLIFSYSVWVLRDFPEDGLKIFTEDLPEVESLPRDRVLGFLIENFKGLAIPYLEHIIHVWEETGSRFHNCLIQLYCEKVQGLMKEYLLSFPAGKTPVPAGEEEGELGEYRQKLLMFLEISSYYDPGRLICDFPFDGLLEERALLLGRMGKHEQALFIYVHILKDTRMAEEYCHKHYDRNKDGNKDVYLSLLRMYLSPPSIHCLGPIKLELLEPKANLQAALQVLELHHSKLDTTKALNLLPANTQINDIRIFLEKVLEENAQKKRFNQVLKNLLHAEFLRVQEERILHQQVKCIITEEKVCMVCKKKIGNSAFARYPNGVVVHYFCSKEVNPADT

SEQ ID NO: 96201 - protein, 47 aa, Homo sapiens
  Payload ID: 19205
  Gene Name: vacuolar protein sorting 39 homolog (S. cerevisiae)
  ENSP ID: ENSP00000457325
LHAEFLRVQEERILHQQVKCIITEEKVCMVCKKKIGNREGEHGCWLS

SEQ ID NO: 96202 - protein, 437 aa, Homo sapiens
  Payload ID: 19206
  Gene Name: vacuolar protein sorting 4 homolog A (S. cerevisiae)
  Uniprot ID: Q9UN37
  ENSP ID: ENSP00000254950
MTTSTLQKAIDLVTKATEEDKAKNYEEALRLYQHAVEYFLHAIKYEAHSDKAKESIRAKCVQYLDRAEKLKDYLRSKEKHGKKPVKENQSEGKGSDSDSEGDNPEKKKLQEQLMGAVVMEKPNIRWNDVAGLEGAKEALKEAVILPIKFPHLFTGKRTPWRGILLFGPPGTGKSYLAKAVATEANNSTFFSVSSSDLMSKWLGESEKLVKNLFELARQHKPSIIFIDEVDSLCGSRNENESEAARRIKTEFLVQMQGVGNNNDGTLVLGATNIPWVLDSAIRRRFEKRIYIPLPEEAARAQMFRLHLGSTPHNLTDANIHELARKTEGYSGADISIIVRDSLMQPVRKVQSATHFKKVCGPSRTNPSMMIDDLLTPCSPGDPGAMEMTWMDVPGDKLLEPVVCMSDMLRSLATTRPTVNADDLLKVKKFSEDFGQES

SEQ ID NO: 96203 - protein, 444 aa, Homo sapiens
  Payload ID: 19207
  Gene Name: vacuolar protein sorting 4 homolog B (S. cerevisiae)
  Uniprot ID: O75351
  ENSP ID: ENSP00000238497
MSSTSPNLQKAIDLASKAAQEDKAGNYEEALQLYQHAVQYFLHVVKYEAQGDKAKQSIRAKCTEYLDRAEKLKEYLKNKEKKAQKPVKEGQPSPADEKGNDSDGEGESDDPEKKKLQNQLQGAIVIERPNVKWSDVAGLEGAKEALKEAVILPIKFPHLFTGKRTPWRGILLFGPPGTGKSYLAKAVATEANNSTFFSISSSDLVSKWLGESEKLVKNLFQLARENKPSIIFIDEIDSLCGSRSENESEAARRIKTEFLVQMQGVGVDNDGILVLGATNIPWVLDSAIRRRFEKRIYIPLPEPHARAAMFKLHLGTTQNSLTEADFRELGRKTDGYSGADISIIVRDALMQPVRKVQSATHFKKVRGPSRADPNHLVDDLLTPCSPGDPGAIEMTWMDVPGDKLLEPVVSMSDMLRSLSNTKPTVNEHDLLKLKKFTEDFGQEG

SEQ ID NO: 96204 - protein, 128 aa, Homo sapiens
  Payload ID: 19207
  Gene Name: vacuolar protein sorting 4 homolog B (S. cerevisiae)
  ENSP ID: ENSP00000465846
MSSTSPNLQKAIDLASKAAQEDKAGNYEEALQLYQHAVQYFLHVVKYEAQGDKAKQSIRAKCTEYLDRAEKLKEYLKNKEKKAQKPVKEGQPSPADEKGNDSDGEGESDDPEKKKLQNQLQGCFRFHF

SEQ ID NO: 96205 - protein, 111 aa, Homo sapiens
  Payload ID: 19207
  Gene Name: vacuolar protein sorting 4 homolog B (S. cerevisiae)
  ENSP ID: ENSP00000465944
MSSTSPNLQKAIDLASKAAQEDKAGNYEEALQLYQHAVQYFLHVVKYEAQGDKAKQSIRAKCTEYLDRAEKLKEYLKNKEKKAQKPVKEGQPSPADEKGCHCYRTTKCEME

SEQ ID NO: 96206 - protein, 209 aa, Homo sapiens
  Payload ID: 19208
  Gene Name: vacuolar protein sorting 41 homolog (S. cerevisiae)
  ENSP ID: ENSP00000265745
MAEAEEQETGSLEESTDESEEEESEEEPKLKYERLSNGVTEILQKDAASCMTVHDKFLALGTHYGKVYLLDVQGNITQKFDVSPVKINQISLDESGEHMGVCSEDGKVQVFGLYSGEEFHETFDCPIKIIAVHPHFVRSSCKQFVTGGKKLLLFERSWMNRWKSAVLHEGEGNIRSVKWRGHLIAWANNMSKKPEAWRVAKKMKSYLNN

SEQ ID NO: 96207 - protein, 854 aa, Homo sapiens
  Payload ID: 19208
  Gene Name: vacuolar protein sorting 41 homolog (S. cerevisiae)
  Uniprot ID: P49754
  ENSP ID: ENSP00000309457
MAEAEEQETGSLEESTDESEEEESEEEPKLKYERLSNGVTEILQKDAASCMTVHDKFLALGTHYGKVYLLDVQGNITQKFDVSPVKINQISLDESGEHMGVCSEDGKVQVFGLYSGEEFHETFDCPIKIIAVHPHFVRSSCKQFVTGGKKLLLFERSWMNRWKSAVLHEGEGNIRSVKWRGHLIAWANNMGVKIFDIISKQRITNVPRDDISLRPDMYPCSLCWKDNVTLIIGWGTSVKVCSVKERHASEMRDLPSRYVEIVSQFETEFYISGLAPLCDQLVVLSYVKEISEKTEREYCARPRLDIIQPLSETCEEISSDALTVRGFQENECRDYHLEYSEGESLFYIVSPRDVVVAKERDQDDHIDWLLEKKKYEEALMAAEISQKNIKRHKILDIGLAYINHLVERGDYDIAARKCQKILGKNAALWEYEVYKFKEIGQLKAISPYLPRGDPVLKPLIYEMILHEFLESDYEGFATLIREWPGDLYNNSVIVQAVRDHLKKDSQNKTLLKTLAELYTYDKNYGNALEIYLTLRHKDVFQLIHKHNLFSSIKDKIVLLMDFDSEKAVDMLLDNEDKISIKKVVEELEDRPELQHVYLHKLFKRDHHKGQRYHEKQISLYAEYDRPNLLPFLRDSTHCPLEKALEICQQRNFVEETVYLLSRMGNSRSALKMIMEELHDVDKAIEFAKEQDDGELWEDLILYSIDKPPFITGLLNNIGTHVDPILLIHRIKEGMEIPNLRDSLVKILQDYNLQILLREGCKKILVADSLSLLKKMHRTQMKGVLVDEENICESCLSPILPSDAAKPFSVVVFHCRHMFHKECLPMPSMNSAAQFCNICSAKNRGPGSAILEMKK

SEQ ID NO: 96208 - protein, 829 aa, Homo sapiens
  Payload ID: 19208
  Gene Name: vacuolar protein sorting 41 homolog (S. cerevisiae)
  Uniprot ID: P49754
  ENSP ID: ENSP00000379297
MAEAEEQETGSLEESTDESEEEESEEEPKLKYERLSNGVTEILQKDAASCMTVHDKFLALGTHYGKVYLLDVQGNITQKFDVVQVFGLYSGEEFHETFDCPIKIIAVHPHFVRSSCKQFVTGGKKLLLFERSWMNRWKSAVLHEGEGNIRSVKWRGHLIAWANNMGVKIFDIISKQRITNVPRDDISLRPDMYPCSLCWKDNVTLIIGWGTSVKVCSVKERHASEMRDLPSRYVEIVSQFETEFYISGLAPLCDQLVVLSYVKEISEKTEREYCARPRLDIIQPLSETCEEISSDALTVRGFQENECRDYHLEYSEGESLFYIVSPRDVVVAKERDQDDHIDWLLEKKKYEEALMAAEISQKNIKRHKILDIGLAYINHLVERGDYDIAARKCQKILGKNAALWEYEVYKFKEIGQLKAISPYLPRGDPVLKPLIYEMILHEFLESDYEGFATLIREWPGDLYNNSVIVQAVRDHLKKDSQNKTLLKTLAELYTYDKNYGNALEIYLTLRHKDVFQLIHKHNLFSSIKDKIVLLMDFDSEKAVDMLLDNEDKISIKKVVEELEDRPELQHVYLHKLFKRDHHKGQRYHEKQISLYAEYDRPNLLPFLRDSTHCPLEKALEICQQRNFVEETVYLLSRMGNSRSALKMIMEELHDVDKAIEFAKEQDDGELWEDLILYSIDKPPFITGLLNNIGTHVDPILLIHRIKEGMEIPNLRDSLVKILQDYNLQILLREGCKKILVADSLSLLKKMHRTQMKGVLVDEENICESCLSPILPSDAAKPFSVVVFHCRHMFHKECLPMPSMNSAAQFCNICSAKNRGPGSAILEMKK

SEQ ID NO: 96209 - protein, 150 aa, Homo sapiens
  Payload ID: 19208
  Gene Name: vacuolar protein sorting 41 homolog (S. cerevisiae)
  ENSP ID: ENSP00000391980
  MOD_RES (1)..(1): Any amino acid
XEETVYLLSRMGNSRSALKMIMEELHDVDKAIEFAKEQDDGELWEDLILYSIDKPPFITGLLNNIGTHVDPILLIHRIKEGMEIPNLRDSLVKILQDYNLQILLREGCKKILVADSLSLLKKMHRTQMKGVLVDEENICESCLSPILPSE

SEQ ID NO: 96210 - protein, 109 aa, Homo sapiens
  Payload ID: 19208
  Gene Name: vacuolar protein sorting 41 homolog (S. cerevisiae)
  ENSP ID: ENSP00000395410
LSRMGNSRSALKMIMEELHDVDKAIEFAKEQDDGELWEDLILYSIDKPPFITGLLNNIGTHVDPILLIHRIKEGMEIPNLRDSLVKILQDYNLQVTITIFQDAGNFYRT

SEQ ID NO: 96211 - protein, 73 aa, Homo sapiens
  Payload ID: 19208
  Gene Name: vacuolar protein sorting 41 homolog (S. cerevisiae)
  ENSP ID: ENSP00000398584
MTVHDKFLALGTHYGKVYLLDVQGNITQKFDVSPVKINQISLDESGEHMGVCSEDGKVQVFGLYSGEEFHETF

SEQ ID NO: 96212 - protein, 104 aa, Homo sapiens
  Payload ID: 19208
  Gene Name: vacuolar protein sorting 41 homolog (S. cerevisiae)
  ENSP ID: ENSP00000407835
MTVHDKFLALGTHYGKVYLLDVQGNITQKFDVSPVKINQISLDESGEHMGVCSEDGKVQVFGLYSGEEFHETFDCPIKIIAVHPHFVRSSCKQFVTGGKKVSAV

SEQ ID NO: 96213 - protein, 177 aa, Homo sapiens
  Payload ID: 19208
  Gene Name: vacuolar protein sorting 41 homolog (S. cerevisiae)
  ENSP ID: ENSP00000411919
MAEAEEQEEESEEEPKLKYERLSNGVTEILQKDAASCMTVHDKFLALGTHYGKVYLLDVQGNITQKFDVSPVKINQISLDESGEHMGVCSEDGKVQVFGLYSGEEFHETFDCPIKIIAVHPHFVRSSCKQFVTGGKKLLLFERSWMNRWKSAVLHEGEGNIRSVKWRGHLIAWANNM

SEQ ID NO: 96214 - protein, 156 aa, Homo sapiens
  Payload ID: 19208
  Gene Name: vacuolar protein sorting 41 homolog (S. cerevisiae)
  ENSP ID: ENSP00000412974
MPKKLQSESPVKINQISLDESGEHMGVCSEDGKVQVFGLYSGEEFHETFDCPIKIIAVHPHFVRSSCKQFVTGGKKLLLFERSWMNRWKSAVLHEGEGNIRSVKWRGHLIAWANNMGVKIFDIISKQRITNVPRDDISLRPDMYPCSLCWKDNVTL

SEQ ID NO: 96215 - protein, 538 aa, Homo sapiens
  Payload ID: 19209
  Gene Name: vacuolar protein sorting 45 homolog (S. cerevisiae)
  Uniprot ID: Q9NRW7
  ENSP ID: ENSP00000358124
MVYTQSEILQKEVYLFERIDSQNREIMKHLKAICFLRPTKENVDYIIQELRRPKYTIYFIYFSNVISKSDVKSLAEADEQEVVAEVQQVITKEYELFEFRRTEVPPLLLILDRCDDAITPLLNQWTYQAMVHELLGINNNRIDLSRVPGISKDLREVVLSAENDEFYANNMYLNFAEIGSNIKNLMEDFQKKKPKEQQKLESIADMKAFVENYPQFKKMSGTVSKHVTVVGELSRLVSERNLLEVSEVEQELACQNDHSSALQNIKRLLQNPKVTEFDAARLVMLYALHYERHSSNSLPGLMMDLRNKGVSEKYRKLVSAVVEYGGKRVRGSDLFSPKDAVAITKQFLKGLKGVENVYTQHQPFLHETLDHLIKGRLKENLYPYLGPSTLRDRPQDIIVFVIGGATYEEALTVYNLNRTTPGVRIVLGGTTVHNTKRDGVSLCSPAWFRTPGLKRSTRLSLPKCWDYSFPRGSSGFWTAQPKQGELSSHIKVSEQKMKRWLGEGHSFLSCPHYRFSLLNKGVGEQLWVLCWLLELISR

SEQ ID NO: 96216 - protein, 570 aa, Homo sapiens
  Payload ID: 19209
  Gene Name: vacuolar protein sorting 45 homolog (S. cerevisiae)
  Uniprot ID: Q9NRW7
  ENSP ID: ENSP00000358126
MNVVFAVKQYISKMIEDSGPGMKVLLMDKETTGIVSMVYTQSEILQKEVYLFERIDSQNREIMKHLKAICFLRPTKENVDYIIQELRRPKYTIYFIYFSNVISKSDVKSLAEADEQEVVAEVQEFYGDYIAVNPHLFSLNILGCCQGRNWDPAQLSRTTQGLTALLLSLKKCPMIRYQLSSEAAKRLAECVKQVITKEYELFEFRRTEVPPLLLILDRCDDAITPLLNQWTYQAMVHELLGINNNRIDLSRVPGISKDLREVVLSAENDEFYANNMYLNFAEIGSNIKNLMEDFQKKKPKEQQKLESIADMKAFVENYPQFKKMSGTVSKHVTVVGELSRLVSERNLLEVSEVEQELACQNDHSSALQNIKRLLQNPKVTEFDAARLVMLYALHYERHSSNSLPGLMMDLRNKGVSEKYRKLVSAVVEYGGKRVRGSDLFSPKDAVAITKQFLKGLKGVENVYTQHQPFLHETLDHLIKGRLKENLYPYLGPSTLRDRPQDIIVFVIGGATYEEALTVYNLNRTTPGVRIVLGGTTVHNTKSFLEEVLASGLHSRSKESSQVTSRSASRR

SEQ ID NO: 96217 - protein, 315 aa, Homo sapiens
  Payload ID: 19209
  Gene Name: vacuolar protein sorting 45 homolog (S. cerevisiae)
  ENSP ID: ENSP00000400143
MNVVFAVKQYISKMIEDSGPGMKVLLMDKETTGIVSMVYTQSEILQKEVYLFERIDSQNREIMKHLKAICFLRPTKENVDYIIQELRRPKYTIYFIYFSNVISKSDVKSLAEADEQEVVAEVQQVITKEYELFEFRRTEVPPLLLILDRCDDAITPLLNQWTYQAMVHELLGINNNRIDLSRVPGISKDLREVVLSAENDEFYANNMYLNFAEIGSNIKNLMEDFQKKKPKEQQKLESIADMKAFVENYPQFKKMSGTVSKHVTVVGELSRLVSERNLLEVSEVEQELACQNDHSSALQNIKRLLQNPKVTEFDA

SEQ ID NO: 96218 - protein, 538 aa, Homo sapiens; identical to SEQ ID NO: 96215
  Payload ID: 19209
  Gene Name: vacuolar protein sorting 45 homolog (S. cerevisiae)
  Uniprot ID: Q9NRW7
  ENSP ID: ENSP00000440690

SEQ ID NO: 96219 - protein, 447 aa, Homo sapiens
  Payload ID: 19209
  Gene Name: vacuolar protein sorting 45 homolog (S. cerevisiae)
  ENSP ID: ENSP00000478403
MNVVFAVKQYPHLFSLNILGCCQGRNWDPAQLSRTTQGLTALLLSLKKCPMIRYQLSSEAAKRLAECVKQVITKEYELFEFRRTEVPPLLLILDRCDDAITPLLNQWTYQAMVHELLGINNNRIDLSRVPGISKDLREVVLSAENDEFYANNMYLNFAEIGSNIKNLMEDFQKKKPKEQQKLESIADMKAFVENYPQFKKMSGTVSKHVTVVGELSRLVSERNLLEVSEVEQELACQNDHSSALQNIKRLLQNPKVTEFDAARLVMLYALHYERHSSNSLPGLMMDLRNKGVSEKYRKLVSAVVEYGGKRVRGSDLFSPKDAVAITKQFLKGLKGVENVYTQHQPFLHETLDHLIKGRLKENLYPYLGPSTLRDRPQDIIVFVIGGATYEEALTVYNLNRTTPGVRIVLGGTTVHNTKSFLEEVLASGLHSRSKESSQVTSRSASRR

SEQ ID NO: 96220 - protein, 198 aa, Homo sapiens
  Payload ID: 19209
  Gene Name: vacuolar protein sorting 45 homolog (S. cerevisiae)
  ENSP ID: ENSP00000481356
MVYTQSEILQKEVYLFERIDSQNREIMKHLKAICFLRPTKENVDYIIQELRRPKYTIYFIYFSNVISKSDVKSLAEADEQEVVAEVQEFYGDYIAVNPHLFSLNILGCCQGRNWDPAQLSRTTQGLTALLLSLKKCPMIRYQLSSEAAKRLAECVKQVITKEYELFEFRRTEVPPLLLILDRCDDAITPLLNQSAGNQ

SEQ ID NO: 96221 - protein, 782 aa, Homo sapiens
  Payload ID: 19210
  Gene Name: vacuolar protein sorting 51 homolog (S. cerevisiae)
  Uniprot ID: Q9UID3
  ENSP ID: ENSP00000279281
MAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATDTIRKMKNDFRKMEDEMDRLATNMAVITDFSARISATLQDRHERITKLAGVHALLRKLQFLFELPSRLTKCVELGAYGQAVRYQGRAQAVLQQYQHLPSFRAIQDDCQVITARLAQQLRQRFREGGSGAPEQAECVELLLALGEPAEELCEEFLAHARGRLEKELRNLEAELGPSPPAPDVLEFTDHGGSGFVGGLCQVAAAYQELFAAQGPAGAEKLAAFARQLGSRYFALVERRLAQEQGGGDNSLLVRALDRFHRRLRAPGALLAAAGLADAATEIVERVARERLGHHLQGLRAAFLGCLTDVRQALAAPRVAGKEGPGLAELLANVASSILSHIKASLAAVHLFTAKEVSFSNKPYFRGEFCSQGVREGLIVGFVHSMCQTAQSFCDSPGEKGGATPPALLLLLSRLCLDYETATISYILTLTDEQFLVQDQFPVTPVSTLCAEARETARRLLTHYVKVQGLVISQMLRKSVETRDWLSTLEPRNVRAVMKRVVEDTTAIDVQVGLLYEEGVRKAQSSDSSKRTFSVYSSSRQQGRYAPSYTPSAPMDTNLLSNIQKLFSERIDVFSPVEFNKVSVLTGIIKISLKTLLECVRLRTFGRFGLQQVQVDCHFLQLYLWRFVADEELVHLLLDEVVASAALRCPDPVPMEPSVVEVICERG

SEQ ID NO: 96222 - protein, 110 aa, Homo sapiens
  Payload ID: 19210
  Gene Name: vacuolar protein sorting 51 homolog (S. cerevisiae)
  ENSP ID: ENSP00000431188
MDSETDMVRQIRALDSDMQTLVYENYNKFISATDTIRKMKNDFRKMEDEMDRLATNMAVITDFSARISATLQDRHERITKLAGVHALLRKLQFLFELPSRLTKCVELGAY

SEQ ID NO: 96223 - protein, 99 aa, Homo sapiens
  Payload ID: 19210
  Gene Name: vacuolar protein sorting 51 homolog (S. cerevisiae)
  ENSP ID: ENSP00000431317
VGLLYEEGVRKAQSSDSSKRTFSVYSSSRQQGRYAPSYTPSAPMDTNLLSNIQKLFSERIDVFSPVEFNKMTALILYPSLLIWPRRLSASSQLLPSCRC

SEQ ID NO: 96224 - protein, 81 aa, Homo sapiens
  Payload ID: 19210
  Gene Name: vacuolar protein sorting 51 homolog (S. cerevisiae)
  ENSP ID: ENSP00000433579
MAAAAAAGPSPGSGPGDSPEGPEGEAPERRRKAHGMLKLYYGLSEGEAAGRPAGPDPLDPTDLNGAHFDPEVYLDKTPSGR

SEQ ID NO: 96225 - protein, 233 aa, Homo sapiens
  Payload ID: 19210
  Gene Name: vacuolar protein sorting 51 homolog (S. cerevisiae)
  ENSP ID: ENSP00000434138
MAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATGVHALLRKLQFLFELPSRLTKCVELGAYGQAVRYQGRAQAVLQQYQHLPSFRAIQDDCQVITARLAQQLRQRFREGGSGAPEQAECVELLLALGEPAEELCEEFLAHARGRLEK

SEQ ID NO: 96226 - protein, 72 aa, Homo sapiens
  Payload ID: 19210
  Gene Name: vacuolar protein sorting 51 homolog (S. cerevisiae)
  ENSP ID: ENSP00000434542
  MOD_RES (1)..(1): Any amino acid
XSQGVREGLIVGFVHSMCQTAQSFCDSPGEKGGATPPALLLLLSRLCLDYETATISYILTLTDEQFLVQVKH

SEQ ID NO: 96227 - protein, 334 aa, Homo sapiens
  Payload ID: 19210
  Gene Name: vacuolar protein sorting 51 homolog (S. cerevisiae)
  ENSP ID: ENSP00000435245
MAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATDTIRKMKNDFRKMEDEMDRLATNMAVITDFSARISATLQDRHERITKLAGGRCRAGPAVGLSWGSGANVTLRPPGVHALLRKLQFLFELPSRLTKCVELGAYGQAVRYQGRAQAVLQQYQHLPSFRAIQDDCQVITARLAQQLRQRFREGGSGAPEQAECVELLLALGEPAEELCEEFLAHARGRLEKELRNLEAELGPSPPAPDVLEFTDHGGS

SEQ ID NO: 96228 - protein, 199 aa, Homo sapiens
  Payload ID: 19210
  Gene Name: vacuolar protein sorting 51 homolog (S. cerevisiae)
  ENSP ID: ENSP00000435629
  MOD_RES (1)..(1): Any amino acid
XTAQSFCDSPGEKGGATPPALLLLLSRLCLDYETATISYILTLTDEQFLVQDQFPVTPVSTLCAEARETARRLLTHYVKVQGLVISQMLRKSVETRDWLSTLEPRNVRAVMKRVVEDTTAIDVQVGLLYEEGVRKAQSSDSSKRTFSVYSSSRQQGRYAPSYTPSAPMDTNLLSNIQKLFSERIDVFSPVEFNKVRLPT

SEQ ID NO: 96229 - protein, 255 aa, Homo sapiens
  Payload ID: 19210
  Gene Name: vacuolar protein sorting 51 homolog (S. cerevisiae)
  ENSP ID: ENSP00000435691
MDSETDMVRQIRALDSDMQTLVYENYNKFISATDTIRKMKNDFRKMEDEMDRLATNMAVITDFSARISATLQDRHERITKLAGVHALLRKLQFLFELPSRLTKCVELGAYGQAVRYQGRAQAVLQQYQHLPSFRAIQDDCQVITARLAQQLRQRFREGGSGAPEQAECVELLLALGEPAEELCEEFLAHARGRLEKELRNLEAELGPSPPAPDVLEFTDHGGSGFVGGLCQVAAAYQELFAAQGPAGAEKLAAFA

SEQ ID NO: 96230 - protein, 165 aa, Homo sapiens
  Payload ID: 19210
  Gene Name: vacuolar protein sorting 51 homolog (S. cerevisiae)
  ENSP ID: ENSP00000436134
MIMPLYSKLGDREKKKRKEKASRPWAAVGTMAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATDTIRKMKNDFRKMEDE

SEQ ID NO: 96231 - protein, 163 aa, Homo sapiens
  Payload ID: 19210
  Gene Name: vacuolar protein sorting 51 homolog (S. cerevisiae)
  ENSP ID: ENSP00000436867
MAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATGSALDTQMRLGASGPCLGCLWSDGAVEAQWWQLAKHLRPASDLD

SEQ ID NO: 96232 - protein, 723 aa, Homo sapiens
  Payload ID: 19211
  Gene Name: vacuolar protein sorting 52 homolog (S. cerevisiae)
  Uniprot ID: Q8N1B4
  ENSP ID: ENSP00000372697
MAAAATMAAAARELVLRAGTSDMEEEEGPLAGGPGLQEPLQLGELDITSDEFILDEVDVHIQANLEDELVKEALKTGVDLRHYSKQVELELQQIEQKSIRDYIQESENIASLHNQITACDAVLERMEQMLGAFQSDLSSISSEIRTLQEQSGAMNIRLRNRQAVRGKLGELVDGLVVPSALVTAILEAPVTEPRFLEQLQELDAKAAAVREQEARGTAACADVRGVLDRLRVKAVTKIREFILQKIYSFRKPMTNYQIPQTALLKYRFFYQFLLGNERATAKEIRDEYVETLSKIYLSYYRSYLGRLMKVQYEEVAEKDDLMGVEDTAKKGFFSKPSLRSRNTIFTLGTRGSVISPTELEAPILVPHTAQRGEQRYPFEALFRSQHYALLDNSCREYLFICEFFVVSGPAAHDLFHAVMGRTLSMTLKHLDSYLADCYDAIAVFLCIHIVLRFRNIAAKRDVPALDRYWEQVLALLWPRFELILEMNVQSVRSTDPQRLGGLDTRPHYITRRYAEFSSALVSINQTIPNERTMQLLGQLQVEVENFVLRVAAEFSSRKEQLVFLINNYDMMLGVLMERAADDSKEVESFQQLLNARTQEFIEELLSPPFGGLVAFVKEAEALIERGQAERLRGEEARVTQLIRGFGSSWKSSVESLSQDVMRSFTNFRNGTSIIQGALTQLIQLYHRFHRVLSQPQLRALPARAELINIHHLMVELKKHKPNF

SEQ ID NO: 96233 - protein, 723 aa, Homo sapiens; identical to SEQ ID NO: 96232
  Payload ID: 19211
  Gene Name: vacuolar protein sorting 52 homolog (S. cerevisiae)
  Uniprot ID: Q8N1B4
  ENSP ID: ENSP00000390831

SEQ ID NO: 96234 - protein, 723 aa, Homo sapiens; identical to SEQ ID NO: 96232
  Payload ID: 19211
  Gene Name: vacuolar protein sorting 52 homolog (S. cerevisiae)
  Uniprot ID: Q8N1B4
  ENSP ID: ENSP00000391197

SEQ ID NO: 96235 - protein, 125 aa, Homo sapiens
  Payload ID: 19211
  Gene Name: vacuolar protein sorting 52 homolog (S. cerevisiae)
  ENSP ID: ENSP00000398367
EFIEELLSPPFGGLVAFVKEAEALIERGQAERLRGEEARVTQLIRGFGSSWKSSVESLSQDVMRSFTNFRNGTSIIQGALTQLIQLYHRFHRVLSQPQLRALPARAELINIHHLMVELKKHKPNF

SEQ ID NO: 96236 - protein, 723 aa, Homo sapiens; identical to SEQ ID NO: 96232
  Payload ID: 19211
  Gene Name: vacuolar protein sorting 52 homolog (S. cerevisiae)
  Uniprot ID: Q8N1B4
  ENSP ID: ENSP00000404016

SEQ ID NO: 96237 - protein, 723 aa, Homo sapiens; identical to SEQ ID NO: 96232
  Payload ID: 19211
  Gene Name: vacuolar protein sorting 52 homolog (S. cerevisiae)
  Uniprot ID: Q8N1B4
  ENSP ID: ENSP00000406988

SEQ ID NO: 96238 - protein, 723 aa, Homo sapiens; identical to SEQ ID NO: 96232
  Payload ID: 19211
  Gene Name: vacuolar protein sorting 52 homolog (S. cerevisiae)
  Uniprot ID: Q8N1B4
  ENSP ID: ENSP00000409952

SEQ ID NO: 96239 - protein, 88 aa, Homo sapiens
  Payload ID: 19211
  Gene Name: vacuolar protein sorting 52 homolog (S. cerevisiae)
  ENSP ID: ENSP00000434319
MAAAATMAAAARELVLRAGTSDMEEEEGPLVRARSCFSSVVPVLLASERPELGLGTRVGTWLLPVILPVWLPVPFPVIRPDPERDPSG

SEQ ID NO: 96240 - protein, 88 aa, Homo sapiens; identical to SEQ ID NO: 96239
  Payload ID: 19211
  Gene Name: vacuolar protein sorting 52 homolog (S. cerevisiae)
  ENSP ID: ENSP00000434469

SEQ ID NO: 96241 - protein, 88 aa, Homo sapiens; identical to SEQ ID NO: 96239
  Payload ID: 19211
  Gene Name: vacuolar protein sorting 52 homolog (S. cerevisiae)
  ENSP ID: ENSP00000434720

SEQ ID NO: 96242 - protein, 125 aa, Homo sapiens; identical to SEQ ID NO: 96235
  Payload ID: 19211
  Gene Name: vacuolar protein sorting 52 homolog (S. cerevisiae)
  ENSP ID: ENSP00000435031

SEQ ID NO: 96243 - protein, 88 aa, Homo sapiens; identical to SEQ ID NO: 96239
  Payload ID: 19211
  Gene Name: vacuolar protein sorting 52 homolog (S. cerevisiae)
  ENSP ID: ENSP00000435407

SEQ ID NO: 96244 - protein, 88 aa, Homo sapiens; identical to SEQ ID NO: 96239
  Payload ID: 19211
  Gene Name: vacuolar protein sorting 52 homolog (S. cerevisiae)
  ENSP ID: ENSP00000436612

SEQ ID NO: 96245 - protein, 670 aa, Homo sapiens
  Payload ID: 19212
  Gene Name: vacuolar protein sorting 53 homolog (S. cerevisiae)
  Uniprot ID: Q5VIR6
  ENSP ID: ENSP00000291074
MMEEEELEFVEELEAVLQLTPEVQLAIEQVFPSQDPLDRADFNAVEYINTLFPTEQSLANIDEVVNKIRLKIRRLDDNIRTVVRGQTNVGQDGRQVKEITRDIKQLDHAKRHLTTSITTLNHLHMLAGGVDSLEAMTRRRQYGEVANLLQGVMNVLEHFHKYMGIPQIRQLSERVKAAQTELGQQILADFEEAFPSQGTKRPGGPSNVLRDACLVANILDPRIKQEIIKKFIKQHLSEYLVLFQENQDVAWLDKIDRRYAWIKRQLVDYEEKYGRMFPREWCMAERIAVEFCHVTRAELAKIMRTRAKEIEVKLLLFAIQRTTNFEGFLAKRFSGCTLTDGTLKKLESPPPSTNPFLEDEPTPEMEELATEKGDLDQPKKPKAPDNPFHGIVSKCFEPHLYVYIESQDKNLGELIDRFVADFKAQGPPKPNTDEGGAVLPSCADLFVYYKKCMVQCSQLSTGEPMIALTTIFQKYLREYAWKILSGNLPKTTTSSGGLTISSLLKEKEGSEVAKFTLEELCLICNILSTAEYCLATTQQLEEKLKEKVDVSLIERINLTGEMDTFSTVISSSIQLLVQDLDAACDPALTAMSKMQWQNVEHVGDQSPYVTSVILHIKQNVPIIRDNLASTRKYFTQFCVKFANSFIPKFITHLFKCKPISMVGAEQVRWT

SEQ ID NO: 96246 - protein, 547 aa, Homo sapiens
  Payload ID: 19212
  Gene Name: vacuolar protein sorting 53 homolog (S. cerevisiae)
  ENSP ID: ENSP00000373692
MMEEEELEFVEELEAVLQLTPEVQLAIEQVFPSQDPLDRADFNAVEYINTLFPTEQSLANIDEVVNKIRLKIRRLDDNIRTVVRGQTNVGQDGRQALEEAQKAIQQLFGKIKDIKDKAEKSEQMVKEITRDIKQLDHAKRHLTTSITTLNHLHMLAGGVDSLEAMTRRRQYGEVANLLQGVMNVLEHFHKYMGIPQIRQLSERVKAAQTELGQQILADFEEAFPSQGTKVAWLDKIDRRYAWIKRQLVDYEEKYGRMFPREWCMAERIAVEFCHVTRAELAKIMRTRAKEIEVKLLLFAIQRTTNFEGFLAKRFSGCTLTDGTLKKLESPPPSTNPFLEDEPTPEMEELATEKGDLDQPKKPKAPDNPFHGIVSKCFEPHLYVYIESQDKNLGELIDRFVADFKAQGPPKPNTDEGGAVLPSCADLFVYYKKCMVQCSQLSTGEPMIALTTIFQKYLREYAWKILSGNLPKTTTSSGGLTISSLLKEKEGSEVAKFTLEELCLICNILSTAEYCLATTQQLEEKLKEKVDRHLQQYSAAGSGSGCCL

SEQ ID NO: 96247 - protein, 422 aa, Homo sapiens
  Payload ID: 19212
  Gene Name: vacuolar protein sorting 53 homolog (S. cerevisiae)
  ENSP ID: ENSP00000384294
MMEEEELEFVEELEAVLQLTPEVQLAIEQVFPSQDPLDRADFNAVEYINTLFPTEQSLANIDEVVNKIRLKIRRLDDNIRTVVRGQTNVGQDGRQKKLESPPPSTNPFLEDEPTPEMEELATEKGDLDQPKKPKAPDNPFHGIVSKCFEPHLYVYIESQDKNLGELIDRFVADFKAQGPPKPNTDEGGAVLPSCADLFVYYKKCMVQCSQLSTGEPMIALTTIFQKYLREYAWKILSGNLPKTTTSSGGLTISSLLKEKEGSEVAKFTLEELCLICNILSTAEYCLATTQQLEEKLKEKVDVSLIERINLTGEMDTFSTVISSSIQLLVQDLDAACDPALTAMSKMQWQNVEHVGDQSPYVTSVILHIKQNVPIIRDNLASTRKYFTQFCVKFANSFIPKFITHLFKCKPISMVGAEQVRWT

SEQ ID NO: 96248 - protein, 832 aa, Homo sapiens
  Payload ID: 19212
  Gene Name: vacuolar protein sorting 53 homolog (S. cerevisiae)
  Uniprot ID: Q5VIR6
  ENSP ID: ENSP00000401435
MMEEEELEFVEELEAVLQLTPEVQLAIEQVFPSQDPLDRADFNAVEYINTLFPTEQSLANIDEVVNKIRLKIRRLDDNIRTVVRGQTNVGQDGRQALEEAQKAIQQLFGKIKDIKDKAEKSEQMVKEITRDIKQLDHAKRHLTTSITTLNHLHMLAGGVDSLEAMTRRRQYGEVANLLQGVMNVLEHFHKYMGIPQIRQLSERVKAAQTELGQQILADFEEAFPSQGTKRPGGPSNVLRDACLVANILDPRIKQEIIKKFIKQHLSEYLVLFQENQDVAWLDKIDRRYAWIKRQLVDYEEKYGRMFPREWCMAERIAVEFCHVTRAELAKIMRTRAKEIEVKLLLFAIQRTTNFEGFLAKRFSGCTLTDGTLKKLESPPPSTNPFLEDEPTPEMEELATEKGDLDQPKKPKAPDNPFHGIVSKCFEPHLYVYIESQDKNLGELIDRFVADFKAQGPPKPNTDEGGAVLPSCADLFVYYKKCMVQCSQLSTGEPMIALTTIFQKYLREYAWKILSGNLPKTTTSSGGLTISSLLKEKEGSEVAKFTLEELCLICNILSTAEYCLATTQQLEEKLKEKVDVSLIERINLTGEMDTFSTVISSSIQLLVQDLDAACDPALTAMSKMQWQNVEHVGDQSPYVTSVILHIKQNVPIIRDNLASTRKYFTQFCVKFANSFIPKFITHLFKCKPISMVGAEQLLLDTHSLKMVLLDLPSISSQVVRKAPASYTKIVVKGMTRAEMILKVVMAPHEPLVVFVDNYIKLLTDCNTETFQKILDMKGLKRSEQSSMLELLRQRLPAPPSGAESSGSLSLTAPTPEQESSRIRKLEKLIKKRL

SEQ ID NO: 96249 - protein, 216 aa, Homo sapiens
  Payload ID: 19212
  Gene Name: vacuolar protein sorting 53 homolog (S. cerevisiae)
  ENSP ID: ENSP00000458311
MMEEEELEFVEELEAVLQLTPEVQLAIEQVFPSQDPLDRADFNAVEYINTLFPTEQSLANIDEVVNKIRLKIRRLDDNIRTVVRGQTNVGQDGRQALEEAQKAIQQLFGKIKDIKDKAEKSEQMVKEITRDIKQLDHAKRHLTTSITTLNHLHMLAGGVDSLEAMTRRRQYGEVANLLQGVMNVLEHFHKYMGIPQIRQLSERKPKTLQLHGLNWT

SEQ ID NO: 96250 - protein, 237 aa, Homo sapiens
  Payload ID: 19212
  Gene Name: vacuolar protein sorting 53 homolog (S. cerevisiae)
  ENSP ID: ENSP00000458651
RPGGPSNVLRDACLVANILDPRIKQEIIKKFIKQHLSEYLVLFQENQDVAWLDKIDRRYAWIKRQLVDYEEKYGRMFPREWCMAERIAVEFCHVTRAELAKIMRTRAKEIEVKLLLFAIQRTTNFEGFLAKRFSGCTLTDGTLKKLESPPPSTNPFLEDEPTPEMEELATEKGDLDQTPPKGRLAGRTSSEKPVTMYFAASPAFILSQHHKGRSQESRASRSSSEMMQSNVSGPLIK

SEQ ID NO: 96251 - protein, 145 aa, Homo sapiens
  Payload ID: 19212
  Gene Name: vacuolar protein sorting 53 homolog (S. cerevisiae)
  ENSP ID: ENSP00000459159
MMEEEELEFVEELEAVLQLTPEVQLAIEQVFPSQDPLDRADFNAVEYINTLFPTEQSLANIDEVVNKIRLRQENHLNPGGGGCSEPRFHHCTPAWVTEQDPFSKSFQDRGNFLKIHKTCNSRTVGIRFGNLPGNLISSSPPCFPT

SEQ ID NO: 96252 - protein, 699 aa, Homo sapiens
  Payload ID: 19212
  Gene Name: vacuolar protein sorting 53 homolog (S. cerevisiae)
  Uniprot ID: Q5VIR6
  ENSP ID: ENSP00000459312
MMEEEELEFVEELEAVLQLTPEVQLAIEQVFPSQDPLDRADFNAVEYINTLFPTEQSLANIDEVVNKIRLKIRRLDDNIRTVVRGQTNVGQDGRQALEEAQKAIQQLFGKIKDIKDKAEKSEQMVKEITRDIKQLDHAKRHLTTSITTLNHLHMLAGGVDSLEAMTRRRQYGEVANLLQGVMNVLEHFHKYMGIPQIRQLSERVKAAQTELGQQILADFEEAFPSQGTKRPGGPSNVLRDACLVANILDPRIKQEIIKKFIKQHLSEYLVLFQENQDVAWLDKIDRRYAWIKRQLVDYEEKYGRMFPREWCMAERIAVEFCHVTRAELAKIMRTRAKEIEVKLLLFAIQRTTNFEGFLAKRFSGCTLTDGTLKKLESPPPSTNPFLEDEPTPEMEELATEKGDLDQPKKPKAPDNPFHGIVSKCFEPHLYVYIESQDKNLGELIDRFVADFKAQGPPKPNTDEGGAVLPSCADLFVYYKKCMVQCSQLSTGEPMIALTTIFQKYLREYAWKILSGNLPKTTTSSGGLTISSLLKEKEGSEVAKFTLEELCLICNILSTAEYCLATTQQLEEKLKEKVDVSLIERINLTGEMDTFSTVISSSIQLLVQDLDAACDPALTAMSKMQWQNVEHVGDQSPYVTSVILHIKQNVPIIRDNLASTRKYFTQFCVKFANSFIPKFITHLFKCKPISMVGAEQVRWT

SEQ ID NO: 96253 - protein, 68 aa, Homo sapiens
  Payload ID: 19212
  Gene Name: vacuolar protein sorting 53 homolog (S. cerevisiae)
  ENSP ID: ENSP00000461429
MVKEITRDIKQLDHAKRHLTTSITTLNHLHMLAGGVDSLEAMTRRRQYGEVANLLQGVMNVLEHFHKY

SEQ ID NO: 96254 - protein, 977 aa, Homo sapiens
  Payload ID: 19213
  Gene Name: vacuolar protein sorting 54 homolog (S. cerevisiae)
  Uniprot ID: Q9P1Q0
  ENSP ID: ENSP00000272322
MASSHSSSPVPQGSSSDVFFKIEVDPSKHIRPVPSLPDVCPKEPTGDSHSLYVAPSLVTDQHRWTVYHSKVNLPAALNDPRLAKRESDFFTKTWGLDFVDTEVIPSFYLPQISKEHFTVYQQEISQREKIHERCKNICPPKDTFERTLLHTHDKSRTDLEQVPKIFMKPDFALDDSLTFNSVLPWSHFNTAGGKGNRDAASSKLLQEKLSHYLDIVEVNIAHQISLRSEAFFHAMTSQHELQDYLRKTSQAVKMLRDKIAQIDKVMCEGSLHILRLALTRNNCVKVYNKLKLMATVHQTQPTVQVLLSTSEFVGALDLIATTQEVLQQELQGIHSFRHLGSQLCELEKLIDKMMIAEFSTYSHSDLNRPLEDDCQVLEEERLISLVFGLLKQRKLNFLEIYGEKMVITAKNIIKQCVINKVSQTEEIDTDVVVKLADQMRMLNFPQWFDLLKDIFSKFTIFLQRVKATLNIIHSVVLSVLDKNQRTRELEEISQQKNAAKDNSLDTEVAYLIHEGMFISDAFGEGELTPIAVDTTSQRNASPNSEPCSSDSVSEPECTTDSSSSKEHTSSSAIPGGVDIMVSEDMKLTDSELGKLANNIQELLYSASDICHDRAVKFLMSRAKDGFLEKLNSMEFITLSRLMETFILDTEQICGRKSTSLLGALQSQAIKFVNRFHEERKTKLSLLLDNERWKQADVPAEFQDLVDSLSDGKIALPEKKSGATEERKPAEVLIVEGQQYAVVGTVLLLIRIILEYCQCVDNIPSVTTDMLTRLSDLLKYFNSRSCQLVLGAGALQVVGLKTITTKNLALSSRCLQLIVHYIPVIRAHFEARLPPKQYSMLRHFDHITKDYHDHIAEISAKLVAIMDSLFDKLLSKYEVKAPVPSACFRNICKQMTKMHEAIFDLLPEEQTQMLFLRINASYKLHLKKQLSHLNVINDGGPQNGLVTADVAFYTGNLQALKGLKDLDLNMAEIWEQKR

SEQ ID NO: 96255 - protein, 824 aa, Homo sapiens
  Payload ID: 19213
  Gene Name: vacuolar protein sorting 54 homolog (S. cerevisiae)
  Uniprot ID: Q9P1Q0
  ENSP ID: ENSP00000346499
MLPTKNRIKREKIHERCKNICPPKDTFERTLLHTHDKSRTDLEQVPKIFMKPDFALDDSLTFNSVLPWSHFNTAGGKGNRDAASSKLLQEKLSHYLDIVEVNIAHQISLRSEAFFHAMTSQHELQDYLRKTSQAVKMLRDKIAQIDKVMCEGSLHILRLALTRNNCVKVYNKLKLMATVHQTQPTVQVLLSTSEFVGALDLIATTQEVLQQELQGIHSFRHLGSQLCELEKLIDKMMIAEFSTYSHSDLNRPLEDDCQVLEECVINKVSQTEEIDTDVVVKLADQMRMLNFPQWFDLLKDIFSKFTIFLQRVKATLNIIHSVVLSVLDKNQRTRELEEISQQKNAAKDNSLDTEVAYLIHEGMFISDAFGEGELTPIAVDTTSQRNASPNSEPCSSDSVSEPECTTDSSSSKEHTSSSAIPGGVDIMVSEDMKLTDSELGKLANNIQELLYSASDICHDRAVKFLMSRAKDGFLEKLNSMEFITLSRLMETFILDTEQICGRKSTSLLGALQSQAIKFVNRFHEERKTKLSLLLDNERWKQADVPAEFQDLVDSLSDGKIALPEKKSGATEERKPAEVLIVEGQQYAVVGTVLLLIRIILEYCQCVDNIPSVTTDMLTRLSDLLKYFNSRSCQLVLGAGALQVVGLKTITTKNLALSSRCLQLIVHYIPVIRAHFEARLPPKQYSMLRHFDHITKDYHDHIAEISAKLVAIMDSLFDKLLSKYEVKAPVPSACFRNICKQMTKMHEAIFDLLPEEQTQMLFLRINASYKLHLKKQLSHLNVINDGGPQNGLVTADVAFYTGNLQALKGLKDLDLNMAEIWEQKR

SEQ ID NO: 96256 - protein, 965 aa, Homo sapiens
  Payload ID: 19213
  Gene Name: vacuolar protein sorting 54 homolog (S. cerevisiae)
  Uniprot ID: Q9P1Q0
  ENSP ID: ENSP00000386980
MASSHSSSPVPQGSSSDVFFKIEVDPSKHIRPVPSLPDVCPKEPTVTDQHRWTVYHSKVNLPAALNDPRLAKRESDFFTKTWGLDFVDTEVIPSFYLPQISKEHFTVYQQEISQREKIHERCKNICPPKDTFERTLLHTHDKSRTDLEQVPKIFMKPDFALDDSLTFNSVLPWSHFNTAGGKGNRDAASSKLLQEKLSHYLDIVEVNIAHQISLRSEAFFHAMTSQHELQDYLRKTSQAVKMLRDKIAQIDKVMCEGSLHILRLALTRNNCVKVYNKLKLMATVHQTQPTVQVLLSTSEFVGALDLIATTQEVLQQELQGIHSFRHLGSQLCELEKLIDKMMIAEFSTYSHSDLNRPLEDDCQVLEEERLISLVFGLLKQRKLNFLEIYGEKMVITAKNIIKQCVINKVSQTEEIDTDVVVKLADQMRMLNFPQWFDLLKDIFSKFTIFLQRVKATLNIIHSVVLSVLDKNQRTRELEEISQQKNAAKDNSLDTEVAYLIHEGMFISDAFGEGELTPIAVDTTSQRNASPNSEPCSSDSVSEPECTTDSSSSKEHTSSSAIPGGVDIMVSEDMKLTDSELGKLANNIQELLYSASDICHDRAVKFLMSRAKDGFLEKLNSMEFITLSRLMETFILDTEQICGRKSTSLLGALQSQAIKFVNRFHEERKTKLSLLLDNERWKQADVPAEFQDLVDSLSDGKIALPEKKSGATEERKPAEVLIVEGQQYAVVGTVLLLIRIILEYCQCVDNIPSVTTDMLTRLSDLLKYFNSRSCQLVLGAGALQVVGLKTITTKNLALSSRCLQLIVHYIPVIRAHFEARLPPKQYSMLRHFDHITKDYHDHIAEISAKLVAIMDSLFDKLLSKYEVKAPVPSACFRNICKQMTKMHEAIFDLLPEEQTQMLFLRINASYKLHLKKQLSHLNVINDGGPQNGLVTADVAFYTGNLQALKGLKDLDLNMAEIWEQKR

SEQ ID NO: 96257 - protein, 81 aa, Homo sapiens
  Payload ID: 19213
  Gene Name: vacuolar protein sorting 54 homolog (S. cerevisiae)
  ENSP ID: ENSP00000414725
  MOD_RES (1)..(1): Any amino acid
XSLSDGKIALPEKKSGATEERKPAEVLIVEGQQYAVVGTVLLLIRIILEYCQCVDNIPSVTTDMLTRLSDLLKVLNMTEAT

SEQ ID NO: 96258 - protein, 375 aa, Homo sapiens
  Payload ID: 19214
  Gene Name: vacuolar protein sorting 72 homolog (S. cerevisiae)
  Uniprot ID: Q15906
  ENSP ID: ENSP00000346464
MSLAGGRAPRKTAGNRLSGLLEAEEEDEFYQTTYGGFTEESGDDEYQGDQSDTEDEVDSDFDIDEGDEPSSDGEAEEPRRKRRVVTKAYKEPLKSLRPRKVNTPAGSSQKAREEKALLPLELQDDGSDSRKSMRQSTAEHTRQTFLRVQERQGQSRRRKGPHCERPLTQEELLREAKITEELNLRSLETYERLEADKKKQVHKKRKCPGPIITYHSVTVPLVGEPGPKEENVDIEGSLCFSLSFVLRLDPAPSVSALTPHAGTGPVNPPARCSRTFITFSDDATFEEWFPQGRPPKVPVREVCPVTHRPALYRDPVTDIPYATARAFKIIREAYKKYITAHGLPPTASALGPGPPPPEPLPGSGPRALRQKIVIK

SEQ ID NO: 96259 - protein, 364 aa, Homo sapiens
  Payload ID: 19214
  Gene Name: vacuolar protein sorting 72 homolog (S. cerevisiae)
  Uniprot ID: Q15906
  ENSP ID: ENSP00000357887
MSLAGGRAPRKTAGNRLSGLLEAEEEDEFYQTTYGGFTEESGDDEYQGDQSDTEDEVDSDFDIDEGDEPSSDGEAEEPRRKRRVVTKAYKEPLKSLRPRKVNTPAGSSQKAREEKALLPLELQDDGSDSRKSMRQSTAEHTRQTFLRVQERQGQSRRRKGPHCERPLTQEELLREAKITEELNLRSLETYERLEADKKKQVHKKRKCPGPIITYHSVTVPLVGEPGPKEENVDIEGLDPAPSVSALTPHAGTGPVNPPARCSRTFITFSDDATFEEWFPQGRPPKVPVREVCPVTHRPALYRDPVTDIPYATARAFKIIREAYKKYITAHGLPPTASALGPGPPPPEPLPGSGPRALRQKIVIK

SEQ ID NO: 96260 - protein, 1428 aa, Homo sapiens
  Payload ID: 19215
  Gene Name: vacuolar protein sorting 8 homolog (S. cerevisiae)
  ENSP ID: ENSP00000287546
MENEPDHENVEQSLCAKTSEEELNKSFNLEASLSKFSYIDMDKELEFKNDLIDDKEFDIPQVDTPPTLESILNETDDEDESFILEDPTLLNIDTIDSHSYDTSSVASSDSGDRTNLKRKKKLPDSFSLHGSVMRHSLLKGISAQIVSAADKVDAGLPTAIAVSSLIAVGTSHGLALIFGKYQNQALRLCLGSTSVGGQYGAISALSINNDCSRLLCGFAKGQITMWDLASGKLLRSITDAHPPGTAILHIKFTDDPTLAICNDSGGSVFELTFKRVMGVRTCESRCLFSGSKGEVCCIEPLHSKPELKDHPITQFSLLAMASLTKILVIGLKPSLKVWMTFPYGRMDPSSVPLLAWHFVAVQNYVNPMLAFCRGDVVHFLLVKRDESGAIHVTKQKHLHLYYDLINFTWINSRTVVLLDSVEKLHVIDRQTQEELETVEISEVQLVYNSSHFKSLATGGNVSQALALVGEKACYQSISSYGGQIFYLGTKSVYVMMLRSWRERVDHLLKQDCLTEALALAWSFHEGKAKAVVGLSGDASKRKAIVADRMVEILFHYADRALKKCPDQGKIQVMEQHFQDMVPVIVDYCLLLQRKDLLFSQMYDKLSENSVAKGVFLECLEPYILSDKLVGITPQVMKDLIVHFQDKKLMENVEALIVHMDITSLDIQQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDHIEELVSLKPCKAAELVATHFSGHIETVIKKLQNQVLLFKFLRSLLDPREGIHVNQELLQISPCITEQFIELLCQFNPTQVIETLQVLECYRLEETIQITQKYQLHEVTAYLLEKKGDIHGAFLIMLERLQSKLQEVTHQGENTKEDPSLKDVEDTMVETIALCQRNSHNLNQQQREALWFPLLEAMMAPQKLSSSAIPHLHSEALKSLTMQVLNSMAAFIALPSILQRILQDPVYGKGKLGEIQGLILGMLDTFNYEQTLLETTTSLLNQDLHWSLCNLRASVTRGLNPKQDYCSICLQQYKRRQEMADEIIVFSCGHLYHSFCLQNKECTVEFEGQTRWTCYKCSSSNKVGKLSENSSEIKKGRITPSQVKMSPSYHQSKGDPTAKKGTSEPVLDPQQIQAFDQLCRLYRGSSRLALLTELSQNRSSESYRPFSGSQSAPAFNSIFQNENFQLQLIPPPVTED

SEQ ID NO: 96261 - protein, 164 aa, Homo sapiens
  Payload ID: 19215
  Gene Name: vacuolar protein sorting 8 homolog (S. cerevisiae)
  ENSP ID: ENSP00000389480
MENEPDHENVEQSLCAKTSEEELNKSFNLEASLSKFSYIDMDKELEFKNDLIDDKEFDIPQVDTPPTLESILNETDDEDESFILEDPTLLNIDTIDSHSYDTSSVASSDSGDRTNLKRKKKLPDSFSLHGSVMRHSLLKGISAQIVSAADKVDAGLPTAIVSIL

SEQ ID NO: 96262 - protein, 57 aa, Homo sapiens
  Payload ID: 19215
  Gene Name: vacuolar protein sorting 8 homolog (S. cerevisiae)
  ENSP ID: ENSP00000393070
  MOD_RES (1)..(1): Any amino acid
XAEASPEEEIYPYIRTLLHFDTREFLNVLALTFEDFKNDKQAVEYQQRIVDILLKHA

SEQ ID NO: 96263 - protein, 74 aa, Homo sapiens
  Payload ID: 19215
  Gene Name: vacuolar protein sorting 8 homolog (S. cerevisiae)
  ENSP ID: ENSP00000394018
MENEPDHENVEQSLCAKTSEEELNKSFNLEASLSKFSYIDMDKELEFKNDLIDDKEFDIPQVDTPPTLESILNE

SEQ ID NO: 96264 - protein, 68 aa, Homo sapiens
  Payload ID: 19215
  Gene Name: vacuolar protein sorting 8 homolog (S. cerevisiae)
  ENSP ID: ENSP00000397553
MENEPDHENVEQSLCAKTSEEELNKSFNLEASLSKFSYIDMDKELEFKNDLGLTLLSRLEYSGANMAH

SEQ ID NO: 96265 - protein, 59 aa, Homo sapiens
  Payload ID: 19215
  Gene Name: vacuolar protein sorting 8 homolog (S. cerevisiae)
  ENSP ID: ENSP00000400267
DRMVEILFHYADRALKKCPDQGKIQVMEQHFQAIGMAYRNDWFLNIEPVLHPGINLTWS

SEQ ID NO: 96266 - protein, 1426 aa, Homo sapiens
  Payload ID: 19215
  Gene Name: vacuolar protein sorting 8 homolog (S. cerevisiae)
  Uniprot ID: Q8N3P4
  ENSP ID: ENSP00000404704
MENEPDHENVEQSLCAKTSEEELNKSFNLEASLSKFSYIDMDKELEFKNDLIDDKEFDIPQVDTPPTLESILNETDDEDESFILEDPTLLNIDTIDSHSYDTSSVASSDSGDRTNLKRKKKLPDSFSLHGSVMRHSLLKGISAQIVSAADKVDAGLPTAIAVSSLIAVGTSHGLALIFDQNQALRLCLGSTSVGGQYGAISALSINNDCSRLLCGFAKGQITMWDLASGKLLRSITDAHPPGTAILHIKFTDDPTLAICNDSGGSVFELTFKRVMGVRTCESRCLFSGSKGEVCCIEPLHSKPELKDHPITQFSLLAMASLTKILVIGLKPSLKVWMTFPYGRMDPSSVPLLAWHFVAVQNYVNPMLAFCRGDVVHFLLVKRDESGAIHVTKQKHLHLYYDLINFTWINSRTVVLLDSVEKLHVIDRQTQEELETVEISEVQLVYNSSHFKSLATGGNVSQALALVGEKACYQSISSYGGQIFYLGTKSVYVMMLRSWRERVDHLLKQDCLTEALALAWSFHEGKAKAVVGLSGDASKRKAIVADRMVEILFHYADRALKKCPDQGKIQVMEQHFQDMVPVIVDYCLLLQRKDLLFSQMYDKLSENSVAKGVFLECLEPYILSDKLVGITPQVMKDLIVHFQDKKLMENVEALIVHMDITSLDIQQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDHIEELVSLKPCKAAELVATHFSGHIETVIKKLQNQVLLFKFLRSLLDPREGIHVNQELLQISPCITEQFIELLCQFNPTQVIETLQVLECYRLEETIQITQKYQLHEVTAYLLEKKGDIHGAFLIMLERLQSKLQEVTHQGENTKEDPSLKDVEDTMVETIALCQRNSHNLNQQQREALWFPLLEAMMAPQKLSSSAIPHLHSEALKSLTMQVLNSMAAFIALPSILQRILQDPVYGKGKLGEIQGLILGMLDTFNYEQTLLETTTSLLNQDLHWSLCNLRASVTRGLNPKQDYCSICLQQYKRRQEMADEIIVFSCGHLYHSFCLQNKECTVEFEGQTRWTCYKCSSSNKVGKLSENSSEIKKGRITPSQVKMSPSYHQSKGDPTAKKGTSEPVLDPQQIQAFDQLCRLYRGSSRLALLTELSQNRSSESYRPFSGSQSAPAFNSIFQNENFQLQLIPPPVTED

SEQ ID NO: 96267 - protein, 1336 aa, Homo sapiens
  Payload ID: 19215
  Gene Name: vacuolar protein sorting 8 homolog (S. cerevisiae)
  Uniprot ID: Q8N3P4
  ENSP ID: ENSP00000405483
MENEPDHENVEQSLCAKTSEEELNKSFNLEASLSKFSYIDMDKELEFKNDLIDDKEFDIPQVDTPPTLESILNETDDEDESFILEDPTLLNIDTIDSHSYDTSSVASSDSGDRTNLKRKKKLPDSFSLHGSVMRHSLLKGISAQIVSAADKVDAGLPTAIAVSSLIAVGTSHGLALIFDQNQALRLCLGSTSVGGQYGAISALSINNDCSRLLCGFAKGQITMWDLASGKLLRSITDAHPPGTAILHIKFTDDPTLAICNDSGGSVFELTFKRVMGVRTCESRCLFSGSKGEVCCIEPLHSKPELKDHPITQFSLLAMASLTKILVIGLKPSLKVWMTFPYGRMDPSSVPLLAWHFVAVQNYVNPMLAFCRGDVVHFLLVKRDESGAIHVTKQKHLHLYYDLINFTWINSRTVVLLDSVEKLHVIDRQTQEELETVEISEVQLVYNSSHFKSLATGGNVSQALALVGEKACYQSISSYGGQIFYLGTKSVYVMMLRSWRERVDHLLKQDCLTEALALAWSFHEGKAKAVVGLSGDASKRKAIVADRMVEILFHYADRALKKCPDQGKIQVMEQHFQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDHIEELVSLKPCKAAELVATHFSGHIETVIKKLQNQVLLFKFLRSLLDPREGIHVNQELLQISPCITEQFIELLCQFNPTQVIETLQVLECYRLEETIQITQKYQLHEVTAYLLEKKGDIHGAFLIMLERLQSKLQEVTHQGENTKEDPSLKDVEDTMVETIALCQRNSHNLNQQQREALWFPLLEAMMAPQKLSSSAIPHLHSEALKSLTMQVLNSMAAFIALPSILQRILQDPVYGKGKLGEIQGLILGMLDTFNYEQTLLETTTSLLNQDLHWSLCNLRASVTRGLNPKQDYCSICLQQYKRRQEMADEIIVFSCGHLYHSFCLQNKECTVEFEGQTRWTCYKCSSSNKVGKLSENSSEIKKGRITPSQVKMSPSYHQSKGDPTAKKGTSEPVLDPQQIQAFDQLCRLYRGSSRLALLTELSQNRSSESYRPFSGSQSAPAFNSIFQNENFQLQLIPPPVTED

SEQ ID NO: 96268 - protein, 108 aa, Homo sapiens
  Payload ID: 19215
  Gene Name: vacuolar protein sorting 8 homolog (S. cerevisiae)
  ENSP ID: ENSP00000409115
  MOD_RES (1)..(1): Any amino acid
XALAWSFHEGKAKAVVGLSGDASKRKAIVADRMVEILFHYADRALKKCPDQGKIQVMEQHFQDMVPVIVDYCLLLQRKTSDESKPHPSPFRSFLDVFVELVMKDHTCE

SEQ ID NO: 96269 - protein, 140 aa, Homo sapiens
  Payload ID: 19215
  Gene Name: vacuolar protein sorting 8 homolog (S. cerevisiae)
  ENSP ID: ENSP00000409957
MENEPDHENVEQSLCAKTSEEELNKSFNLEASLSKFSYIDMDKELEFKNDLIDDKEFDIPQVDTPPTLESILNETDDEDESFILEDPTLLNIDTIDSHSYDTSSVASSDSGDRTNLKRKKKLPDSFSLHGSVMRHSLLKG

SEQ ID NO: 96270 - protein, 202 aa, Homo sapiens
  Payload ID: 19215
  Gene Name: vacuolar protein sorting 8 homolog (S. cerevisiae)
  ENSP ID: ENSP00000415161
MENEPDHENVEQSLCAKTSEEELNKSFNLEASLSKFSYIDMDKELEFKNDLIDDKEFDIPQVDTPPTLESILNETDDEDESFILEDPTLLNIDTIDSHSYDTSSVASSDSGDRTNLKRKKKLPDSFSLHGSVMRHSLLKGISAQIVSAADKVDAGLPTAIAVSSLIAVGTSHGLALIFDQNQALRLCLGSTSVGGQYGAISA

SEQ ID NO: 96271 - protein, 62 aa, Homo sapiens
  Payload ID: 19215
  Gene Name: vacuolar protein sorting 8 homolog (S. cerevisiae)
  ENSP ID: ENSP00000416101
  MOD_RES (1)..(1): Any amino acid
XLHGSVMRHSLLKGISAQIVSAAVESNSYLLEWEPPVEDYISMTFSEFNPYDKVDAGLPTAI

SEQ ID NO: 96272 - protein, 121 aa, Homo sapiens
  Payload ID: 19215
  Gene Name: vacuolar protein sorting 8 homolog (S. cerevisiae)
  ENSP ID: ENSP00000416150
MENEPDHENVEQSLCAKTSEEELNKSFNLEASLSKFSYIDMDKELEFKNDLIDDKEFDIPQVDTPPTLESILNETDDEDESFILEDPTLLNIDTIDSHSYDTSSVASSDSGDRTNLKRKKK

SEQ ID NO: 96273 - protein, 68 aa, Homo sapiens; identical to SEQ ID NO: 96264
  Payload ID: 19215
  Gene Name: vacuolar protein sorting 8 homolog (S. cerevisiae)
  ENSP ID: ENSP00000487080

SEQ ID NO: 96274 - protein, 1428 aa, Homo sapiens
  Payload ID: 19215
  Gene Name: vacuolar protein sorting 8 homolog (S. cerevisiae)
  Uniprot ID: Q8N3P4
  ENSP ID: ENSP00000487164
MENEPDHENVEQSLCAKTSEEELNKSFNLEASLSKFSYIDMDKELEFKNDLIDDKEFDIPQVDTPPTLESILNETDDEDESFILEDPTLLNIDTIDSHSYDTSSVASSDSGDRTNLKRKKKLPDSFSLHGSVMRHSLLKGISAQIVSAADKVDAGLPTAIAVSSLIAVGTSHGLALIFGKDQNQALRLCLGSTSVGGQYGAISALSINNDCSRLLCGFAKGQITMWDLASGKLLRSITDAHPPGTAILHIKFTDDPTLAICNDSGGSVFELTFKRVMGVRTCESRCLFSGSKGEVCCIEPLHSKPELKDHPITQFSLLAMASLTKILVIGLKPSLKVWMTFPYGRMDPSSVPLLAWHFVAVQNYVNPMLAFCRGDVVHFLLVKRDESGAIHVTKQKHLHLYYDLINFTWINSRTVVLLDSVEKLHVIDRQTQEELETVEISEVQLVYNSSHFKSLATGGNVSQALALVGEKACYQSISSYGGQIFYLGTKSVYVMMLRSWRERVDHLLKQDCLTEALALAWSFHEGKAKAVVGLSGDASKRKAIVADRMVEILFHYADRALKKCPDQGKIQVMEQHFQDMVPVIVDYCLLLQRKDLLFSQMYDKLSENSVAKGVFLECLEPYILSDKLVGITPQVMKDLIVHFQDKKLMENVEALIVHMDITSLDIQQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDHIEELVSLKPCKAAELVATHFSGHIETVIKKLQNQVLLFKFLRSLLDPREGIHVNQELLQISPCITEQFIELLCQFNPTQVIETLQVLECYRLEETIQITQKYQLHEVTAYLLEKKGDIHGAFLIMLERLQSKLQEVTHQGENTKEDPSLKDVEDTMVETIALCQRNSHNLNQQQREALWFPLLEAMMAPQKLSSSAIPHLHSEALKSLTMQVLNSMAAFIALPSILQRILQDPVYGKGKLGEIQGLILGMLDTFNYEQTLLETTTSLLNQDLHWSLCNLRASVTRGLNPKQDYCSICLQQYKRRQEMADEIIVFSCGHLYHSFCLQNKECTVEFEGQTRWTCYKCSSSNKVGKLSENSSEIKKGRITPSQVKMSPSYHQSKGDPTAKKGTSEPVLDPQQIQAFDQLCRLYRGSSRLALLTELSQNRSSESYRPFSGSQSAPAFNSIFQNENFQLQLIPPPVTED

SEQ ID NO: 96275 - protein, 406 aa, Homo sapiens
  Payload ID: 19216
  Gene Name: vacuole membrane protein 1
  Uniprot ID: Q96GC9
  ENSP ID: ENSP00000262291
MAENGKNCDQRRVAMNKEHHNGNFTDPSSVNEKKRREREERQNIVLWRQPLITLQYFSLEILVILKEWTSKLWHRQSIVVSFLLLLAVLIATYYVEGVHQQYVQRIEKQFLLYAYWIGLGILSSVGLGTGLHTFLLYLGPHIASVTLAAYECNSVNFPEPPYPDQIICPDEEGTEGTISLWSIISKVRIEACMWGIGTAIGELPPYFMARAARLSGAEPDDEEYQEFEEMLEHAESAQDFASRAKLAVQKLVQKVGFFGILACASIPNPLFDLAGITCGHFLVPFWTFFGATLIGKAIIKMHIQKIFVIITFSKHIVEQMVAFIGAVPGIGPSLQKPFQEYLEAQRQKLHHKSEMGTPQGENWLSWMFEKLVVVMVCYFILSIINSMAQSYAKRIQQRLNSEEKTK

SEQ ID NO: 96276 - protein, 92 aa, Homo sapiens
  Payload ID: 19216
  Gene Name: vacuole membrane protein 1
  ENSP ID: ENSP00000465397
MAENGKNCDQRRVAMNKEHHNGNFTDPSSVNEKKRREREERQNIVLWRQPLITLQYFSLEILVILKEWTSKLWHRQSIVVSFLLLLAVLIAT

SEQ ID NO: 96277 - protein, 58 aa, Homo sapiens
  Payload ID: 19216
  Gene Name: vacuole membrane protein 1
  ENSP ID: ENSP00000465911
  MOD_RES (1)..(1): Any amino acid
XPSSVNEKKRREREERQNIVLWRQPLITLQYFSLEILVILKEWTSKTLPPGPNWQFKN

SEQ ID NO: 96278 - protein, 75 aa, Homo sapiens
  Payload ID: 19216
  Gene Name: vacuole membrane protein 1
  ENSP ID: ENSP00000465947
MAENGKNCDQRRVAMNKEHHNGNFTDPSSVNEKKRREREERQNIVLWRQPLITLQYFSLEILVILKEWTSNMCNV

SEQ ID NO: 96279 - protein, 74 aa, Homo sapiens
  Payload ID: 19216
  Gene Name: vacuole membrane protein 1
  ENSP ID: ENSP00000465972
MAENGKNCDQRRVAMNKEHHNGNFTDPSSVNEKKRREREERQNIVLWRQPLITLQYFSLEILVILKEWTSKVHI

SEQ ID NO: 96280 - protein, 167 aa, Homo sapiens
  Payload ID: 19216
  Gene Name: vacuole membrane protein 1
  ENSP ID: ENSP00000466198
MAENGKNCDQRRVAMNKEHHNGNFTDPSSVNEKKRREREERQNIVLWRQPLITLQYFSLEILVILKEWTSKLWHRQSIVVSFLLLLAVLIATYYVEGVHQQYVQRIEKQFLLYAYWIGLGILSSVGLGTGLHTFLLYLIICPDEEGTEGTISLWSIISKVRIEACMW

SEQ ID NO: 96281 - protein, 44 aa, Homo sapiens
  Payload ID: 19216
  Gene Name: vacuole membrane protein 1
  ENSP ID: ENSP00000466413
MWGIGTAIGELPPYFMARAARLSGAEPDDEEYQEFEEMLEHAES

SEQ ID NO: 96282 - protein, 138 aa, Homo sapiens
  Payload ID: 19216
  Gene Name: vacuole membrane protein 1
  ENSP ID: ENSP00000466511
MAENGKNCDQRRVAMNKEHHNGNFTDPSSVNEKKRREREERQNIVLWRQPLITLQYFSLEILVILKEWTSKLWHRQSIVVSFLLLLAVLIATYYVEGVHQQYVQRIEKQFLLYAYWIGLGILSSVGLGTGLHTFLLYL

SEQ ID NO: 96283 - protein, 44 aa, Homo sapiens
  Payload ID: 19216
  Gene Name: vacuole membrane protein 1
  ENSP ID: ENSP00000466579
MAENGKNCDQRRVAMNKEHHNGNFTDYGIVKALWCLFYCCLLCL

SEQ ID NO: 96284 - protein, 78 aa, Homo sapiens
  Payload ID: 19216
  Gene Name: vacuole membrane protein 1
  ENSP ID: ENSP00000467093
MAENGKNCDQRRVAMNKEHHNGNFTDPSSVNEKKRREREERQNIVLWRQPLITLQYFSLEILVILKEWTSKLWHRQSI

SEQ ID NO: 96285 - protein, 225 aa, Homo sapiens
  Payload ID: 19216
  Gene Name: vacuole membrane protein 1
  ENSP ID: ENSP00000467350
GIGTAIGELPPYFMARAARLSGAEPDDEEYQEFEEMLEHAESAQDFASRAKLAVQKLVQKVGFFGILACASIPNPLFDLAGITCGHFLVPFWTFFGATLIGKAIIKMHIQKIFVIITFSKHIVEQMVAFIGLEDNGALQPPPPSAVPGIGPSLQKPFQEYLEAQRQKLHHKSEMGTPQGENWLSWMFEKLVVVMVCYFILSIINSMAQSYAKRIQQRLNSEEKTK

SEQ ID NO: 96286 - protein, 480 aa, Homo sapiens [sequence omitted]

SEQ ID NO: 96287 - protein, 480 aa, Homo sapiens [sequence omitted]

SEQ ID NO: 96288 - protein, 480 aa, Homo sapiens [sequence omitted]

SEQ ID NO: 96289 - protein, 184 aa, Homo sapiens
  Payload ID: 19217
  Gene Name: v-akt murine thymoma viral oncogene homolog 1
  ENSP ID: ENSP00000450681
  MOD_RES (1)..(1): Any amino acid
XHSEKNVVYRDLKLENLMLDKDGHIKITDFGLCKEGIKDGATMKTFCGTPEYLAPEDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQDDSMECVDSERRPHFPQFSYSASGTA

SEQ ID NO: 96290 - protein, 480 aa, Homo sapiens [sequence omitted]

SEQ ID NO: 96291 - protein, 480 aa, Homo sapiens [sequence omitted]

SEQ ID NO: 96292 - protein, 170 aa, Homo sapiens
  Payload ID: 19217
  Gene Name: v-akt murine thymoma viral oncogene homolog 1
  ENSP ID: ENSP00000451470
  MOD_RES (1)..(1): Any amino acid
XGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQVLGDCPTGSLPLR

SEQ ID NO: 96293 - protein, 91 aa, Homo sapiens
  Payload ID: 19217
  Gene Name: v-akt murine thymoma viral oncogene homolog 1
  ENSP ID: ENSP00000451824
MSDVAIVKEGWLHKRGEYIKTWRPRYFLLKNDGTFIGYKERPQDVDQREAPLNNFSVAQCQLMKTERPRPNTFIIRCLQWTTVIERTFHVE

SEQ ID NO: 96294 - protein, 480 aa, Homo sapiens [sequence omitted]

SEQ ID NO: 96295 - protein, 146 aa, Homo sapiens
  Payload ID: 19217
  Gene Name: v-akt murine thymoma viral oncogene homolog 1
  ENSP ID: ENSP00000481526
LENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKGP

SEQ ID NO: 96296 - protein, 438 aa, Homo sapiens
  Payload ID: 19218
  Gene Name: v-akt murine thymoma viral oncogene homolog 2
  Uniprot ID: P31751
  ENSP ID: ENSP00000309428
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 96297 - protein, 125 aa, Homo sapiens
  Payload ID: 19218
  Gene Name: v-akt murine thymoma viral oncogene homolog 2
  ENSP ID: ENSP00000351095
MNEVSVIKEGWLHKRGEYIKTWRPRYFLLKSDGSFIGYKERPEAPDQTLPPLNNFSVAAPCCLFPLPAECQLMKTERPRPNTFVIRCLQWTTVIERTFHVDSPDEREEWMRAIQMVANSLKQRAP

SEQ ID NO: 96298 - protein, 69 aa, Homo sapiens
  Payload ID: 19218
  Gene Name: v-akt murine thymoma viral oncogene homolog 2
  ENSP ID: ENSP00000375719
MPADEDREAATQHLCHTLPAVDHSHREDLPRGFSRREGGVDAGHPDGRQQPQAAGPRRGPHGLQVWLPQ

SEQ ID NO: 96299 - protein, 133 aa, Homo sapiens
  Payload ID: 19218
  Gene Name: v-akt murine thymoma viral oncogene homolog 2
  ENSP ID: ENSP00000375891
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTT

SEQ ID NO: 96300 - protein, 481 aa, Homo sapiens
  Payload ID: 19218
  Gene Name: v-akt murine thymoma viral oncogene homolog 2
  Uniprot ID: P31751
  ENSP ID: ENSP00000375892
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 96301 - protein, 95 aa, Homo sapiens
  Payload ID: 19218
  Gene Name: v-akt murine thymoma viral oncogene homolog 2
  ENSP ID: ENSP00000392458
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDE

SEQ ID NO: 96302 - protein, 107 aa, Homo sapiens
  Payload ID: 19218
  Gene Name: v-akt murine thymoma viral oncogene homolog 2
  ENSP ID: ENSP00000396532
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVA

SEQ ID NO: 96303 - protein, 184 aa, Homo sapiens
  Payload ID: 19218
  Gene Name: v-akt murine thymoma viral oncogene homolog 2
  ENSP ID: ENSP00000396968
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILR

SEQ ID NO: 96304 - protein, 438 aa, Homo sapiens; identical to SEQ ID NO: 96296
  Payload ID: 19218
  Gene Name: v-akt murine thymoma viral oncogene homolog 2
  Uniprot ID: P31751
  ENSP ID: ENSP00000399532

SEQ ID NO: 96305 - protein, 119 aa, Homo sapiens
  Payload ID: 19218
  Gene Name: v-akt murine thymoma viral oncogene homolog 2
  ENSP ID: ENSP00000403842
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDP

SEQ ID NO: 96306 - protein, 67 aa, Homo sapiens
  Payload ID: 19218
  Gene Name: v-akt murine thymoma viral oncogene homolog 2
  ENSP ID: ENSP00000403890
MNEVSVIKEGWLHKRGEYIKTWRPRYFLLKSDGSFIGYKERPEAPDQTLPPLNNFSVAECQLMKTER

SEQ ID NO: 96307 - protein, 134 aa, Homo sapiens
  Payload ID: 19218
  Gene Name: v-akt murine thymoma viral oncogene homolog 2
  ENSP ID: ENSP00000404083
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTE

SEQ ID NO: 96308 - protein, 132 aa, Homo sapiens
  Payload ID: 19218
  Gene Name: v-akt murine thymoma viral oncogene homolog 2
  ENSP ID: ENSP00000407999
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSST

SEQ ID NO: 96309 - protein, 130 aa, Homo sapiens
  Payload ID: 19218
  Gene Name: v-akt murine thymoma viral oncogene homolog 2
  ENSP ID: ENSP00000462022
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDS

SEQ ID NO: 96310 - protein, 69 aa, Homo sapiens; identical to SEQ ID NO: 96298
  Payload ID: 19218
  Gene Name: v-akt murine thymoma viral oncogene homolog 2
  ENSP ID: ENSP00000462469

SEQ ID NO: 96311 - protein, 99 aa, Homo sapiens
  Payload ID: 19218
  Gene Name: v-akt murine thymoma viral oncogene homolog 2
  ENSP ID: ENSP00000462715
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEW

SEQ ID NO: 96312 - protein, 69 aa, Homo sapiens; identical to SEQ ID NO: 96298
  Payload ID: 19218
  Gene Name: v-akt murine thymoma viral oncogene homolog 2
  ENSP ID: ENSP00000462776

SEQ ID NO: 96313 - protein, 53 aa, Homo sapiens
  Payload ID: 19218
  Gene Name: v-akt murine thymoma viral oncogene homolog 2
  ENSP ID: ENSP00000462919
  MOD_RES (1)..(1): Any amino acid
XLVREKATGRYYAMKILRKEVIIAKLENLMLDKDGHIKITDFGLCKEGISDGA

SEQ ID NO: 96314 - protein, 51 aa, Homo sapiens
  Payload ID: 19218
  Gene Name: v-akt murine thymoma viral oncogene homolog 2
  ENSP ID: ENSP00000463086
  MOD_RES (1)..(1): Any amino acid
XQTLPPLNNFSVAECQLMKTERPRPNTFVIRCLQWTTVIERTFHVDSPDES

SEQ ID NO: 96315 - protein, 292 aa, Homo sapiens
  Payload ID: 19218
  Gene Name: v-akt murine thymoma viral oncogene homolog 2
  ENSP ID: ENSP00000463262
KCGSPSDSSTTEEMEVAVSKARAKVTMNDFDYLKLLGKGTFGKVILVREKATGRYYAMKILRKEVIIAKALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDT

SEQ ID NO: 96316 - protein, 106 aa, Homo sapiens
  Payload ID: 19218
  Gene Name: v-akt murine thymoma viral oncogene homolog 2
  ENSP ID: ENSP00000463368
DWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTR

SEQ ID NO: 96317 - protein, 157 aa, Homo sapiens
  Payload ID: 19218
  Gene Name: v-akt murine thymoma viral oncogene homolog 2
  ENSP ID: ENSP00000463686
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKL

SEQ ID NO: 96318 - protein, 95 aa, Homo sapiens; identical to SEQ ID NO: 96301
  Payload ID: 19218
  Gene Name: v-akt murine thymoma viral oncogene homolog 2
  ENSP ID: ENSP00000463806

SEQ ID NO: 96319 - protein, 151 aa, Homo sapiens
  Payload ID: 19218
  Gene Name: v-akt murine thymoma viral oncogene homolog 2
  ENSP ID: ENSP00000470604
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMND

SEQ ID NO: 96320 - protein, 56 aa, Homo sapiens
  Payload ID: 19218
  Gene Name: v-akt murine thymoma viral oncogene homolog 2
  ENSP ID: ENSP00000470822
  MOD_RES (1)..(1): Any amino acid
XGRLPFYNQDHERLFELILMEEIRFPRTLSPEAKSLLAGLLKKDPKQSGLWSRQNH

SEQ ID NO: 96321 - protein, 450 aa, Homo sapiens
  Payload ID: 19218
  Gene Name: v-akt murine thymoma viral oncogene homolog 2
  ENSP ID: ENSP00000471369
MKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRCECLGPPRWCACPRGGGMGSALNSLLKEGPRRPPLHVWEISPSLLSGPFAVGPLWTW

SEQ ID NO: 96322 - protein, 129 aa, Homo sapiens
  Payload ID: 19218
  Gene Name: v-akt murine thymoma viral oncogene homolog 2
  ENSP ID: ENSP00000472371
VDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKSVCRMKSLTQSPRAGSSRTPGTRSSLR

SEQ ID NO: 96323 - protein, 117 aa, Homo sapiens
  Payload ID: 19218
  Gene Name: v-akt murine thymoma viral oncogene homolog 2
  ENSP ID: ENSP00000472382
  MOD_RES (1)..(1): Any amino acid
XPRTLSPEAKSLLAGLLKKDPKQRLGGGPSDAKEVMEHRFFLSINWQDVVQKKLLPPFKPQVTSEVDTRYFDDEFTAQSITITPPDRFREGFLEEEANVSAGRRNDVWDASNGRSMA

SEQ ID NO: 96324 - protein, 479 aa, Homo sapiens
  Payload ID: 19219
  Gene Name: v-akt murine thymoma viral oncogene homolog 3
  Uniprot ID: Q9Y243
  ENSP ID: ENSP00000263826
MSDVTIVKEGWVQKRGEYIKNWRPRYFLLKTDGSFIGYKEKPQDVDLPYPLNNFSVAKCQLMKTERPKPNTFIIRCLQWTTVIERTFHVDTPEEREEWTEAIQAVADRLQRQEEERMNCSPTSQIDNIGEEEMDASTTHHKRKTMNDFDYLKLLGKGTFGKVILVREKASGKYYAMKILKKEVIIAKDEVAHTLTESRVLKNTRHPFLTSLKYSFQTKDRLCFVMEYVNGGELFFHLSRERVFSEDRTRFYGAEIVSALDYLHSGKIVYRDLKLENLMLDKDGHIKITDFGLCKEGITDAATMKTFCGTPEYLAPEVLEDNDYGRAVDWWGLGVVMYEMMCGRLPFYNQDHEKLFELILMEDIKFPRTLSSDAKSLLSGLLIKDPNKRLGGGPDDAKEIMRHSFFSGVNWQDVYDKKLVPPFKPQVTSETDTRYFDEEFTAQTITITPPEKYDEDGMDCMDNERRPHFPQFSYSASGRE

SEQ ID NO: 96325 - protein, 465 aa, Homo sapiens
  Payload ID: 19219
  Gene Name: v-akt murine thymoma viral oncogene homolog 3
  Uniprot ID: Q9Y243
  ENSP ID: ENSP00000336943
MSDVTIVKEGWVQKRGEYIKNWRPRYFLLKTDGSFIGYKEKPQDVDLPYPLNNFSVAKCQLMKTERPKPNTFIIRCLQWTTVIERTFHVDTPEEREEWTEAIQAVADRLQRQEEERMNCSPTSQIDNIGEEEMDASTTHHKRKTMNDFDYLKLLGKGTFGKVILVREKASGKYYAMKILKKEVIIAKDEVAHTLTESRVLKNTRHPFLTSLKYSFQTKDRLCFVMEYVNGGELFFHLSRERVFSEDRTRFYGAEIVSALDYLHSGKIVYRDLKLENLMLDKDGHIKITDFGLCKEGITDAATMKTFCGTPEYLAPEVLEDNDYGRAVDWWGLGVVMYEMMCGRLPFYNQDHEKLFELILMEDIKFPRTLSSDAKSLLSGLLIKDPNKRLGGGPDDAKEIMRHSFFSGVNWQDVYDKKLVPPFKPQVTSETDTRYFDEEFTAQTITITPPEKCQQSDCGMLGNWKK

SEQ ID NO: 96326 - protein, 479 aa, Homo sapiens; identical to SEQ ID NO: 96324
  Payload ID: 19219
  Gene Name: v-akt murine thymoma viral oncogene homolog 3
  Uniprot ID: Q9Y243
  ENSP ID: ENSP00000355497

SEQ ID NO: 96327 - protein, 465 aa, Homo sapiens; identical to SEQ ID NO: 96325
  Payload ID: 19219
  Gene Name: v-akt murine thymoma viral oncogene homolog 3
  Uniprot ID: Q9Y243
  ENSP ID: ENSP00000355498

SEQ ID NO: 96328 - protein, 139 aa, Homo sapiens
  Payload ID: 19219
  Gene Name: v-akt murine thymoma viral oncogene homolog 3
  ENSP ID: ENSP00000447820
MSDVTIVKEGWVQKRGEYIKNWRPRYFLLKTDGSFIGYKEKPQDVDLPYPLNNFSVAKCQLMKTERPKPNTFIIRCLQWTTVIERTFHVDTPEEREEWTEAIQAVADRLQRQEEERMNCSPTSQIDNIGEEEMDASTTH

SEQ ID NO: 96329 - protein, 479 aa, Homo sapiens; identical to SEQ ID NO: 96324
  Payload ID: 19219
  Gene Name: v-akt murine thymoma viral oncogene homolog 3
  Uniprot ID: Q9Y243
  ENSP ID: ENSP00000479081

SEQ ID NO: 96330 - protein, 465 aa, Homo sapiens; identical to SEQ ID NO: 96325
  Payload ID: 19219
  Gene Name: v-akt murine thymoma viral oncogene homolog 3
  Uniprot ID: Q9Y243
  ENSP ID: ENSP00000479922

SEQ ID NO: 96331 - protein, 465 aa, Homo sapiens; identical to SEQ ID NO: 96325
  Payload ID: 19219
  Gene Name: v-akt murine thymoma viral oncogene homolog 3
  Uniprot ID: Q9Y243
  ENSP ID: ENSP00000483054

SEQ ID NO: 96332 - protein, 139 aa, Homo sapiens; identical to SEQ ID NO: 96328
  Payload ID: 19219
  Gene Name: v-akt murine thymoma viral oncogene homolog 3
  ENSP ID: ENSP00000487523

SEQ ID NO: 96333 - protein, 806 aa, Homo sapiens
  Payload ID: 19220
  Gene Name: valosin containing protein
  Uniprot ID: P55072
  ENSP ID: ENSP00000351777
MASGADSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKREDEEESLNEVGYDDIGGCRKQLAQIKEMVELPLRHPALFKAIGVKPPRGILLYGPPGTGKTLIARAVANETGAFFFLINGPEIMSKLAGESESNLRKAFEEAEKNAPAIIFIDELDAIAPKREKTHGEVERRIVSQLLTLMDGLKQRAHVIVMAATNRPNSIDPALRRFGRFDREVDIGIPDATGRLEILQIHTKNMKLADDVDLEQVANETHGHVGADLAALCSEAALQAIRKKMDLIDLEDETIDAEVMNSLAVTMDDFRWALSQSNPSALRETVVEVPQVTWEDIGGLEDVKRELQELVQYPVEHPDKFLKFGMTPSKGVLFYGPPGCGKTLLAKAIANECQANFISIKGPELLTMWFGESEANVREIFDKARQAAPCVLFFDELDSIAKARGGNIGDGGGAADRVINQILTEMDGMSTKKNVFIIGATNRPDIIDPAILRPGRLDQLIYIPLPDEKSRVAILKANLRKSPVAKDVDLEFLAKMTNGFSGADLTEICQRACKLAIRESIESEIRRERERQTNPSAMEVEEDDPVPEIRRDHFEEAMRFARRSVSDNDIRKYEMFAQTLQQSRGFGSFRFPSGNQGGAGPSQGSGGGTGGSVYTEDNDDDLYG

SEQ ID NO: 96334 - protein, 160 aa, Homo sapiens
  Payload ID: 19220
  Gene Name: valosin containing protein
  ENSP ID: ENSP00000392088
MDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKREDEEESLNEVGYDD

SEQ ID NO: 96335 - protein, 115 aa, Homo sapiens
  Payload ID: 19220
  Gene Name: valosin containing protein
  ENSP ID: ENSP00000399456
MDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRA

SEQ ID NO: 96336 - protein, 1222 aa, Homo sapiens
  Payload ID: 19221
  Gene Name: valosin containing protein (p97)/p47 complex interacting protein 1
  Uniprot ID: Q96JH7
  ENSP ID: ENSP00000309031
MSQPPPPPPPLPPPPPPPEAPQTPSSLASAAASGGLLKRRDRRILSGSCPDPKCQARLFFPASGSVSIECTECGQRHEQQQLLGVEEVTDPDVVLHNLLRNALLGVTGAPKKNTELVKVMGLSNYHCKLLSPILARYGMDKQTGRAKLLRDMNQGELFDCALLGDRAFLIEPEHVNTVGYGKDRSGSLLYLHDTLEDIKRANKSQECLIPVHVDGDGHCLVHAVSRALVGRELFWHALRENLKQHFQQHLARYQALFHDFIDAAEWEDIINECDPLFVPPEGVPLGLRNIHIFGLANVLHRPIILLDSLSGMRSSGDYSATFLPGLIPAEKCTGKDGHLNKPICIAWSSSGRNHYIPLVGIKGAALPKLPMNLLPKAWGVPQDLIKKYIKLEEDGGCVIGGDRSLQDKYLLRLVAAMEEVFMDKHGIHPSLVADVHQYFYRRTGVIGVQPEEVTAAAKKAVMDNRLHKCLLCGALSELHVPPEWLAPGGKLYNLAKSTHGQLRTDKNYSFPLNNLVCSYDSVKDVLVPDYGMSNLTACNWCHGTSVRKVRGDGSIVYLDGDRTNSRSTGGKCGCGFKHFWDGKEYDNLPEAFPITLEWGGRVVRETVYWFQYESDSSLNSNVYDVAMKLVTKHFPGEFGSEILVQKVVHTILHQTAKKNPDDYTPVNIDGAHAQRVGDVQGQESESQLPTKIILTGQKTKTLHKEELNMSKTERTIQQNITEQASVMQKRKTEKLKQEQKGQPRTVSPSTIRDGPSSAPATPTKAPYSPTTSKEKKIRITTNDGRQSMVTLKSSTTFFELQESIAREFNIPPYLQCIRYGFPPKELMPPQAGMEKEPVPLQHGDRITIEILKSKAEGGQSAAAHSAHTVKQEDIAVTGKLSSKELQEQAEKEMYSLCLLATLMGEDVWSYAKGLPHMFQQGGVFYSIMKKTMGMADGKHCTFPHLPGKTFVYNASEDRLELCVDAAGHFPIGPDVEDLVKEAVSQVRAEATTRSRESSPSHGLLKLGSGGVVKKKSEQLHNVTAFQGKGHSLGTASGNPHLDPRARETSVVRKHNTGTDFSNSSTKTEPSVFTASSSNSELIRIAPGVVTMRDGRQLDPDLVEAQRKKLQEMVSSIQASMDRHLRDQSTEQSPSDLPQRKTEVVSSSAKSGSLQTGLPESFPLTGGTENLNTETTDGCVADALGAAFATRSKAQRGNSVEELEEMDSQDAEMTNTTEPMDHS

SEQ ID NO: 96337 - protein, 194 aa, Homo sapiens
  Payload ID: 19222
  Gene Name: valosin containing protein lysine (K) methyltransferase
  Uniprot ID: Q9H867
  ENSP ID: ENSP00000379200
MADTLESSLEDPLRSFVRVLEKRDGTVLRLQQYSSGGVGCVVWDAAIVLSKYLETPEFSGDGAHALSRRSVLELGSGTGAVGLMAATLGADVVVTDLEELQDLLKMNINMNKHLVTGSVQAKVLKWGEEIEGFPSPPDFILMADCIYYEESLEPLLKTLKDISGFETCIICCYEQRTMGKNPEIEKKYFEKFPS

SEQ ID NO: 96338 - protein, 229 aa, Homo sapiens
  Payload ID: 19222
  Gene Name: valosin containing protein lysine (K) methyltransferase
  Uniprot ID: Q9H867
  ENSP ID: ENSP00000379201
MADTLESSLEDPLRSFVRVLEKRDGTVLRLQQYSSGGVGCVVWDAAIVLSKYLETPEFSGDGAHALSRRSVLELGSGTGAVGLMAATLGADVVVTDLEELQDLLKMNINMNKHLVTGSVQAKVLKWGEEIEGFPSPPDFILMADCIYYEESLEPLLKTLKDISGFETCIICCYEQRTMGKNPEIEKKYFELLQLDFDFEKIPLEKHDEEYRSEDIHIIYIRKKKSKFPS

SEQ ID NO: 96339 - protein, 144 aa, Homo sapiens
  Payload ID: 19222
  Gene Name: valosin containing protein lysine (K) methyltransferase
  Uniprot ID: Q9H867
  ENSP ID: ENSP00000437113
MADTLESSLEDPLRSFVRVLEKRDGTVLRLQQYSSGGVGCVVWDAAIVLSKYLETPEFSGDGAHALSRRSVLELGSGTGAVGLMAATLGADVVVTDLEELQDLLKMNINMNKHLVTGSVQAKGGRNRRLSFSTRLHTDGRLHIL

SEQ ID NO: 96340 - protein, 1264 aa, Homo sapiens
  Payload ID: 19223
  Gene Name: valyl-tRNA synthetase
  Uniprot ID: P26640
  ENSP ID: ENSP00000211402
MSTLYVSPHPDAFPSLRALIAARYGEAGEGPGWGGAHPRICLQPPPTSRTPFPPPRLPALEQGPGGLWVWGATAVAQLLWPAGLGGPGGSRAAVLVQQWVSYADTELIPAACGATLPALGLRSSAQDPQAVLGALGRALSPLEEWLRLHTYLAGEAPTLADLAAVTALLLPFRYVLDPPARRIWNNVTRWFVTCVRQPEFRAVLGEVVLYSGARPLSHQPGPEAPALPKTAAQLKKEAKKREKLEKFQQKQKIQQQQPPPGEKKPKPEKREKRDPGVITYDLPTPPGEKKDVSGPMPDSYSPRYVEAAWYPWWEQQGFFKPEYGRPNVSAANPRGVFMMCIPPPNVTGSLHLGHALTNAIQDSLTRWHRMRGETTLWNPGCDHAGIATQVVVEKKLWREQGLSRHQLGREAFLQEVWKWKEEKGDRIYHQLKKLGSSLDWDRACFTMDPKLSAAVTEAFVRLHEEGIIYRSTRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLGLPRFEARKAVLVALKERGLFRGIEDNPMVVPLCNRSKDVVEPLLRPQWYVRCGEMAQAASAAVTRGDLRILPEAHQRTWHAWMDNIREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 96341 - protein, 1264 aa, Homo sapiens; identical to SEQ ID NO: 96340
  Payload ID: 19223
  Gene Name: valyl-tRNA synthetase
  Uniprot ID: P26640
  ENSP ID: ENSP00000364815

SEQ ID NO: 96342 - protein, 95 aa, Homo sapiens
  Payload ID: 19223
  Gene Name: valyl-tRNA synthetase
  ENSP ID: ENSP00000387684
  MOD_RES (1)..(1): Any amino acid
XPAGLGGPGGSRAAVLVQQWVSYADTELIPAACGATLPALGLRSSAQDPQAVLGALGRALSPLEEWLRLHTYLAGEAPTLADLAAVTALLLPFRY

SEQ ID NO: 96343 - protein, 288 aa, Homo sapiens
  Payload ID: 19223
  Gene Name: valyl-tRNA synthetase
  ENSP ID: ENSP00000389027
  MOD_RES (1)..(1): Any amino acid
XKERGLFRGIEDNPMVVPLCNRSKDVVEPLLRPQWEWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVP

SEQ ID NO: 96344 - protein, 1183 aa, Homo sapiens
  Payload ID: 19223
  Gene Name: valyl-tRNA synthetase
  ENSP ID: ENSP00000390673
  MOD_RES (1)..(1): Any amino acid
XGLGGPGGSRAAVLVQQWVSYADTELIPAACGATLPALGLRSSAQDPQAVLGALGRALSPLEEWLRLHTYLAGEAPTLADLAAVTALLLPFRYVLDPPARRIWNNVTRWFVTCVRQPEFRAVLGEVVLYSGARPLSHQPGPEAPALPKTAAQLKKEAKKREKLEKFQQKQKIQQQQPPPGEKKPKPEKREKRDPGVITYDLPTPPGEKKDVSGPMPDSYSPRYVEAAWYPWWEQQGFFKPEYGRPNVSAANPRGVFMMCIPPPNVTGSLHLGHALTNAIQDSLTRWHRMRGETTLWNPGCDHAGIATQVVVEKKLWREQGLSRHQLGREAFLQEVWKWKEEKGDRIYHQLKKLGSSLDWDRACFTMDPKLSAAVTEAFVRLHEEGIIYRSTRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLGLPRFEARKAVLVALKERGLFRGIEDNPMVVPLCNRSKDVVEPLLRPQWYVRCGEMAQAASAAVTRGDLRILPEAHQRTWHAWMDNIREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 96345 - protein, 366 aa, Homo sapiens
  Payload ID: 19223
  Gene Name: valyl-tRNA synthetase
  ENSP ID: ENSP00000392396
MSTLYVSPHPDAFPSLRALIAARYGEAGEGPGWGGAHPRICLQPPPTSRTPFPPPRLPALEQGPGGLWVWGATAVAQLLWPAGLGGPGGSRAAVLVQQWVSYADTELIPAACGATLPALGLRSSAQDPQAVLGALGRALSPLEEWLRLHTYLAGEAPTLADLAAVTALLLPFRYVLDPPARRIWNNVTRWFVTCVRQPEFRAVLGEVVLYSGARPLSHQPGPEAPALPKTAAQLKKEAKKREKLEKFQQKQKIQQQQPPPGEKKPKPEKREKRDPGVITYDLPTPPGEKKDVSGPMPDSYSPRYVEAAWYPWWEQQGFFKPEYGRPNVSAANPRGVFMMCIPPPNVTGSLHLGHALTNAIQDSLTR

SEQ ID NO: 96346 - protein, 288 aa, Homo sapiens; identical to SEQ ID NO: 96343
  Payload ID: 19223
  Gene Name: valyl-tRNA synthetase
  ENSP ID: ENSP00000394771
  MOD_RES (1)..(1): Any amino acid

SEQ ID NO: 96347 - protein, 1264 aa, Homo sapiens [sequence omitted]

SEQ ID NO: 96348 - protein, 1264 aa, Homo sapiens; identical to SEQ ID NO: 96340
  Payload ID: 19223
  Gene Name: valyl-tRNA synthetase
  Uniprot ID: P26640
  ENSP ID: ENSP00000403359

SEQ ID NO: 96349 - protein, 174 aa, Homo sapiens
  Payload ID: 19223
  Gene Name: valyl-tRNA synthetase
  ENSP ID: ENSP00000403464
MSTLYVSPHPDAFPSLRALIAARYGEAGEGPGWGGAHPRICLQPPPTSRTSFPPPRLPALEQGPGGLWVWGATAVAQLLWPAGLGGPGGSRAAVLVQQWVSYADTELIPAACGATLPALGLRSSAQDPQAVLGALGRALSPLEEWLRLHTYLAGEAPTLADLAAVTALLLPFRY

SEQ ID NO: 96350 - protein, 288 aa, Homo sapiens; identical to SEQ ID NO: 96343
  Payload ID: 19223
  Gene Name: valyl-tRNA synthetase
  ENSP ID: ENSP00000405822
  MOD_RES (1)..(1): Any amino acid

SEQ ID NO: 96351 - protein, 288 aa, Homo sapiens; identical to SEQ ID NO: 96343
  Payload ID: 19223
  Gene Name: valyl-tRNA synthetase
  ENSP ID: ENSP00000405843
  MOD_RES (1)..(1): Any amino acid

SEQ ID NO: 96352 - protein, 174 aa, Homo sapiens; identical to SEQ ID NO: 96349
  Payload ID: 19223
  Gene Name: valyl-tRNA synthetase
  ENSP ID: ENSP00000411088

SEQ ID NO: 96353 - protein, 174 aa, Homo sapiens
  Payload ID: 19223
  Gene Name: valyl-tRNA synthetase
  ENSP ID: ENSP00000413365
MSTLYVSPHPDAFPSLRALIAARYGEAGEGPGWGGAHPRICLQPPPTSRTPFPPPRLPALEQGPGGLWVWGATAVAQLLWPAGLGGPGGSRAAVLVQQWVSYADTELIPAACGATLPALGLRSSAQDPQAVLGALGRALSPLEEWLRLHTYLAGEAPTLADLAAVTALLLPFRY

SEQ ID NO: 96354 - protein, 174 aa, Homo sapiens; identical to SEQ ID NO: 96353
  Payload ID: 19223
  Gene Name: valyl-tRNA synthetase
  ENSP ID: ENSP00000413925

SEQ ID NO: 96355 - protein, 174 aa, Homo sapiens; identical to SEQ ID NO: 96353
  Payload ID: 19223
  Gene Name: valyl-tRNA synthetase
  ENSP ID: ENSP00000415275

SEQ ID NO: 96356 - protein, 1264 aa, Homo sapiens [sequence omitted]

SEQ ID NO: 96357 - protein, 288 aa, Homo sapiens; identical to SEQ ID NO: 96343
  Payload ID: 19223
  Gene Name: valyl-tRNA synthetase
  ENSP ID: ENSP00000415679
  MOD_RES (1)..(1): Any amino acid

SEQ ID NO: 96358 - protein, 174 aa, Homo sapiens; identical to SEQ ID NO: 96353
  Payload ID: 19223
  Gene Name: valyl-tRNA synthetase
  ENSP ID: ENSP00000415863

SEQ ID NO: 96359 - protein, 288 aa, Homo sapiens; identical to SEQ ID NO: 96343
  Payload ID: 19223
  Gene Name: valyl-tRNA synthetase
  ENSP ID: ENSP00000416833
  MOD_RES (1)..(1): Any amino acid

SEQ ID NO: 96360 - protein, 1063 aa, Homo sapiens
  Payload ID: 19224
  Gene Name: valyl-tRNA synthetase 2, mitochondrial
  Uniprot ID: Q5ST30
  ENSP ID: ENSP00000316092
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSEWGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQVLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 96361 - protein, 1063 aa, Homo sapiens
  Payload ID: 19224
  Gene Name: valyl-tRNA synthetase 2, mitochondrial
  ENSP ID: ENSP00000372860
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSEWGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQVLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLQQLMDEPPAPGSPEL

SEQ ID NO: 96362 - protein, 1063 aa, Homo sapiens
  Payload ID: 19224
  Gene Name: valyl-tRNA synthetase 2, mitochondrial
  ENSP ID: ENSP00000373032
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSERGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQLLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGTAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 96363 - protein, 326 aa, Homo sapiens
  Payload ID: 19224
  Gene Name: valyl-tRNA synthetase 2, mitochondrial
  ENSP ID: ENSP00000394190
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDG

SEQ ID NO: 96364 - protein, 115 aa, Homo sapiens
  Payload ID: 19224
  Gene Name: valyl-tRNA synthetase 2, mitochondrial
  ENSP ID: ENSP00000395255
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYP

SEQ ID NO: 96365 - protein, 1063 aa, Homo sapiens
  Payload ID: 19224
  Gene Name: valyl-tRNA synthetase 2, mitochondrial
  ENSP ID: ENSP00000396754
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSERGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQVLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALQATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 96366 - protein, 1063 aa, Homo sapiens; identical to SEQ ID NO: 96360
  Payload ID: 19224
  Gene Name: valyl-tRNA synthetase 2, mitochondrial
  ENSP ID: ENSP00000400867

SEQ ID NO: 96367 - protein, 115 aa, Homo sapiens; identical to SEQ ID NO: 96364
  Payload ID: 19224
  Gene Name: valyl-tRNA synthetase 2, mitochondrial
  ENSP ID: ENSP00000401775

SEQ ID NO: 96368 - protein, 326 aa, Homo sapiens; identical to SEQ ID NO: 96363
  Payload ID: 19224
  Gene Name: valyl-tRNA synthetase 2, mitochondrial
  ENSP ID: ENSP00000403749

SEQ ID NO: 96369 - protein, 326 aa, Homo sapiens; identical to SEQ ID NO: 96363
  Payload ID: 19224
  Gene Name: valyl-tRNA synthetase 2, mitochondrial
  ENSP ID: ENSP00000406721

SEQ ID NO: 96370 - protein, 1063 aa, Homo sapiens; identical to SEQ ID NO: 96362
  Payload ID: 19224
  Gene Name: valyl-tRNA synthetase 2, mitochondrial
  ENSP ID: ENSP00000407805

SEQ ID NO: 96371 - protein, 115 aa, Homo sapiens; identical to SEQ ID NO: 96364
  Payload ID: 19224
  Gene Name: valyl-tRNA synthetase 2, mitochondrial
  ENSP ID: ENSP00000407946

SEQ ID NO: 96372 - protein, 115 aa, Homo sapiens; identical to SEQ ID NO: 96364
  Payload ID: 19224
  Gene Name: valyl-tRNA synthetase 2, mitochondrial
  ENSP ID: ENSP00000408591

SEQ ID NO: 96373 - protein, 115 aa, Homo sapiens; identical to SEQ ID NO: 96364
  Payload ID: 19224
  Gene Name: valyl-tRNA synthetase 2, mitochondrial
  ENSP ID: ENSP00000414807

SEQ ID NO: 96374 - protein, 326 aa, Homo sapiens; identical to SEQ ID NO: 96363
  Payload ID: 19224
  Gene Name: valyl-tRNA synthetase 2, mitochondrial
  ENSP ID: ENSP00000415560

SEQ ID NO: 96375 - protein, 326 aa, Homo sapiens; identical to SEQ ID NO: 96363
  Payload ID: 19224
  Gene Name: valyl-tRNA synthetase 2, mitochondrial
  ENSP ID: ENSP00000415729

SEQ ID NO: 96376 - protein, 326 aa, Homo sapiens; identical to SEQ ID NO: 96363
  Payload ID: 19224
  Gene Name: valyl-tRNA synthetase 2, mitochondrial
  ENSP ID: ENSP00000415752

SEQ ID NO: 96377 - protein, 115 aa, Homo sapiens; identical to SEQ ID NO: 96364
  Payload ID: 19224
  Gene Name: valyl-tRNA synthetase 2, mitochondrial
  ENSP ID: ENSP00000416390

SEQ ID NO: 96378 - protein, 1061 aa, Homo sapiens
  Payload ID: 19224
  Gene Name: valyl-tRNA synthetase 2, mitochondrial
  ENSP ID: ENSP00000438200
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTVKVTPAHSPADAEMGARHGLSPLNVIAEDGTMTSLCGDWLQGLHRFVAREKIMSVLSEWGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQVLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 96379 - protein, 1093 aa, Homo sapiens
  Payload ID: 19224
  Gene Name: valyl-tRNA synthetase 2, mitochondrial
  Uniprot ID: Q5ST30
  ENSP ID: ENSP00000441000
MGGKAWPRRAVGTAGGPCAEQISAPFQTLLMPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSEWGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQVLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 96380 - protein, 1061 aa, Homo sapiens
  Payload ID: 19224
  Gene Name: valyl-tRNA synthetase 2, mitochondrial
  ENSP ID: ENSP00000446608
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTVKVTPAHSPADAEMGARHGLSPLNVIAEDGTMTSLCGDWLQGLHRFVAREKIMSVLSERGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQLLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGTAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 96381 - protein, 1093 aa, Homo sapiens; identical to SEQ ID NO: 96379
  Payload ID: 19224
  Gene Name: valyl-tRNA synthetase 2, mitochondrial
  ENSP ID: ENSP00000446839

SEQ ID NO: 96382 - protein, 1093 aa, Homo sapiens
  Payload ID: 19224
  Gene Name: valyl-tRNA synthetase 2, mitochondrial
  ENSP ID: ENSP00000447141
MGGKAWPRRAVGTAGGPCAEQISAPFQTLLMPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSEWGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQVLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLQQLMDEPPAPGSPEL

SEQ ID NO: 96383 - protein, 1093 aa, Homo sapiens
  Payload ID: 19224
  Gene Name: valyl-tRNA synthetase 2, mitochondrial
  ENSP ID: ENSP00000447179
MGGKAWPRRAVGTAGGPCAEQISAPFQTLLMPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSERGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQVLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALQATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 96384 - protein, 1061 aa, Homo sapiens; identical to SEQ ID NO: 96380
  Payload ID: 19224
  Gene Name: valyl-tRNA synthetase 2, mitochondrial
  ENSP ID: ENSP00000447478

SEQ ID NO: 96385 - protein, 1061 aa, Homo sapiens
  Payload ID: 19224
  Gene Name: valyl-tRNA synthetase 2, mitochondrial
  ENSP ID: ENSP00000447763
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTVKVTPAHSPADAEMGARHGLSPLNVIAEDGTMTSLCGDWLQGLHRFVAREKIMSVLSEWGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQVLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLQQLMDEPPAPGSPEL

SEQ ID NO: 96386 - protein, 1061 aa, Homo sapiens; identical to SEQ ID NO: 96378
  Payload ID: 19224
  Gene Name: valyl-tRNA synthetase 2, mitochondrial
  ENSP ID: ENSP00000448002

SEQ ID NO: 96387 - protein, 1093 aa, Homo sapiens
  Payload ID: 19224
  Gene Name: valyl-tRNA synthetase 2, mitochondrial
  ENSP ID: ENSP00000449382
MGGKAWPRRAVGTAGGPCAEQISAPFQTLLMPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSERGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQLLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGTAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 96388 - protein, 1061 aa, Homo sapiens
  Payload ID: 19224
  Gene Name: valyl-tRNA synthetase 2, mitochondrial
  ENSP ID: ENSP00000449456
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTVKVTPAHSPADAEMGARHGLSPLNVIAEDGTMTSLCGDWLQGLHRFVAREKIMSVLSERGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQVLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALQATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 96389 - protein, 1093 aa, Homo sapiens; identical to SEQ ID NO: 96387
  Payload ID: 19224
  Gene Name: valyl-tRNA synthetase 2, mitochondrial
  ENSP ID: ENSP00000449862

SEQ ID NO: 96390 - protein, 923 aa, Homo sapiens
  Payload ID: 19224
  Gene Name: valyl-tRNA synthetase 2, mitochondrial
  Uniprot ID: Q5ST30
  ENSP ID: ENSP00000485818
MCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSEWGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQVLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 96391 - protein, 294 aa, Homo sapiens
  Payload ID: 19225
  Gene Name: VAMP (vesicle-associated membrane protein)-associated protein A, 33kDa
  Uniprot ID: Q9P0L0
  ENSP ID: ENSP00000345656
MASASGAMAKHEQILVLDPPTDLKFKGPFTDVVTTNLKLRNPSDRKVCFKVKTTAPRRYCVRPNSGIIDPGSTVTVSVMLQPFDYDPNEKSKHKFMVQTIFAPPNTSDMEAVWKEAKPDELMDSKLRCVFEMPNENDKLGITPPGNAPTVTSMSSINNTVATPASYHTKDDPRGLSVLKQEKQKNDMEPSKAVPLNASKQDGPMPKPHSVSLNDTETRKLMEECKRLQGEMMKLSEENRHLRDEGLRLRKVAHSDKPGSTSTASFRDNVTSPLPSLLVVIAAIFIGFFLGKFIL

SEQ ID NO: 96392 - protein, 249 aa, Homo sapiens
  Payload ID: 19225
  Gene Name: VAMP (vesicle-associated membrane protein)-associated protein A, 33kDa
  Uniprot ID: Q9P0L0
  ENSP ID: ENSP00000382880
MASASGAMAKHEQILVLDPPTDLKFKGPFTDVVTTNLKLRNPSDRKVCFKVKTTAPRRYCVRPNSGIIDPGSTVTVSVMLQPFDYDPNEKSKHKFMVQTIFAPPNTSDMEAVWKEAKPDELMDSKLRCVFEMPNENDKLNDMEPSKAVPLNASKQDGPMPKPHSVSLNDTETRKLMEECKRLQGEMMKLSEENRHLRDEGLRLRKVAHSDKPGSTSTASFRDNVTSPLPSLLVVIAAIFIGFFLGKFIL

SEQ ID NO: 96393 - protein, 29 aa, Homo sapiens
  Payload ID: 19225
  Gene Name: VAMP (vesicle-associated membrane protein)-associated protein A, 33kDa
  ENSP ID: ENSP00000463155
MASASGAMAKHEQILVLDPPTDLKFKVIV

SEQ ID NO: 96394 - protein, 99 aa, Homo sapiens
  Payload ID: 19226
  Gene Name: VAMP (vesicle-associated membrane protein)-associated protein B and C
  Uniprot ID: O95292
  ENSP ID: ENSP00000379147
MAKVEQVLSLEPQHELKFRGPFTDVVTTNLKLGNPTDRNVCFKVKTTAPRRYCVRPNSGIIDAGASINVSGRRWTADEEDSAEQQPHFSISPNWEGRRP

SEQ ID NO: 96395 - protein, 243 aa, Homo sapiens
  Payload ID: 19226
  Gene Name: VAMP (vesicle-associated membrane protein)-associated protein B and C
  Uniprot ID: O95292
  ENSP ID: ENSP00000417175
MAKVEQVLSLEPQHELKFRGPFTDVVTTNLKLGNPTDRNVCFKVKTTAPRRYCVRPNSGIIDAGASINVSVMLQPFDYDPNEKSKHKFMVQSMFAPTDTSDMEAVWKEAKPEDLMDSKLRCVFELPAENDKPHDVEINKIISTTASKTETPIVSKSLSSSLDDTEVKKVMEECKRLQGEVQRLREENKQFKEEDGLRMRKTVQSNSPISALAPTGKEEGLSTRLLALVVLFFIVGVIIGKIAL

SEQ ID NO: 96396 - protein, 71 aa, Homo sapiens
  Payload ID: 19226
  Gene Name: VAMP (vesicle-associated membrane protein)-associated protein B and C
  ENSP ID: ENSP00000430426
MAKVEQVLSLEPQHELKFRGPFTDVVTTNLKLGNPTDRNVCFKVKTTAPRRYCVRPNSGIIDAGASINVSA

SEQ ID NO: 96397 - protein, 524 aa, Homo sapiens
  Payload ID: 19227
  Gene Name: VANGL planar cell polarity protein 1
  Uniprot ID: Q8TAA9
  ENSP ID: ENSP00000310800
MDTESTYSGYSYYSSHSKKSHRQGERTRERHKSPRNKDGRGSEKSVTIQPPTGEPLLGNDSTRTEEVQDDNWGETTTAITGTSEHSISQEDIARISKDMEDSVGLDCKRYLGLTVASFLGLLVFLTPIAFILLPPILWRDELEPCGTICEGLFISMAFKLLILLIGTWALFFRKRRADMPRVFVFRALLLVLIFLFVVSYWLFYGVRILDSRDRNYQGIVQYAVSLVDALLFIHYLAIVLLELRQLQPMFTLQVVRSTDGESRFYSLGHLSIQRAALVVLENYYKDFTIYNPNLLTASKFRAAKHMAGLKVYNVDGPSNNATGQSRAMIAAAARRRDSSHNELYYEEAEHERRVKKRKARLVVAVEEAFIHIQRLQAEEQQKAPGEVMDPREAAQAIFPSMARALQKYLRITRQQNYHSMESILQHLAFCITNGMTPKAFLERYLSAGPTLQYDKDRWLSTQWRLVSDEAVTNGLRDGIVFVLKCLDFSLVVNVKKIPFIILSEEFIDPKSHKFVLRLQSETSV

SEQ ID NO: 96398 - protein, 524 aa, Homo sapiens; identical to SEQ ID NO: 96397
  Payload ID: 19227
  Gene Name: VANGL planar cell polarity protein 1
  Uniprot ID: Q8TAA9
  ENSP ID: ENSP00000347672

SEQ ID NO: 96399 - protein, 524 aa, Homo sapiens; identical to SEQ ID NO: 96397
  Payload ID: 19227
  Gene Name: VANGL planar cell polarity protein 1
  Uniprot ID: Q8TAA9
  ENSP ID: ENSP00000358522

SEQ ID NO: 96400 - protein, 522 aa, Homo sapiens
  Payload ID: 19227
  Gene Name: VANGL planar cell polarity protein 1
  Uniprot ID: Q8TAA9
  ENSP ID: ENSP00000358523
MDTESTYSGYSYYSSHSKKSHRQGERTRERHKSPRNKDGRGSEKSVTIQPPTGEPLLGNDSTRTEEDDNWGETTTAITGTSEHSISQEDIARISKDMEDSVGLDCKRYLGLTVASFLGLLVFLTPIAFILLPPILWRDELEPCGTICEGLFISMAFKLLILLIGTWALFFRKRRADMPRVFVFRALLLVLIFLFVVSYWLFYGVRILDSRDRNYQGIVQYAVSLVDALLFIHYLAIVLLELRQLQPMFTLQVVRSTDGESRFYSLGHLSIQRAALVVLENYYKDFTIYNPNLLTASKFRAAKHMAGLKVYNVDGPSNNATGQSRAMIAAAARRRDSSHNELYYEEAEHERRVKKRKARLVVAVEEAFIHIQRLQAEEQQKAPGEVMDPREAAQAIFPSMARALQKYLRITRQQNYHSMESILQHLAFCITNGMTPKAFLERYLSAGPTLQYDKDRWLSTQWRLVSDEAVTNGLRDGIVFVLKCLDFSLVVNVKKIPFIILSEEFIDPKSHKFVLRLQSETSV

SEQ ID NO: 96401 - protein, 521 aa, Homo sapiens
  Payload ID: 19228
  Gene Name: VANGL planar cell polarity protein 2
  Uniprot ID: Q9ULK5
  ENSP ID: ENSP00000357040
MDTESQYSGYSYKSGHSRSSRKHRDRRDRHRSKSRDGGRGDKSVTIQAPGEPLLDNESTRGDERDDNWGETTTVVTGTSEHSISHDDLTRIAKDMEDSVPLDCSRHLGVAAGATLALLSFLTPLAFLLLPPLLWREELEPCGTACEGLFISVAFKLLILLLGSWALFFRRPKASLPRVFVLRALLMVLVFLLVVSYWLFYGVRILDARERSYQGVVQFAVSLVDALLFVHYLAVVLLELRQLQPQFTLKVVRSTDGASRFYNVGHLSIQRVAVWILEKYYHDFPVYNPALLNLPKSVLAKKVSGFKVYSLGEENSTNNSTGQSRAVIAAAARRRDNSHNEYYYEEAEHERRVRKRRARLVVAVEEAFTHIKRLQEEEQKNPREVMDPREAAQAIFASMARAMQKYLRTTKQQPYHTMESILQHLEFCITHDMTPKAFLERYLAAGPTIQYHKERWLAKQWTLVSEEPVTNGLKDGIVFLLKRQDFSLVVSTKKVPFFKLSEEFVDPKSHKFVMRLQSETSV

SEQ ID NO: 96402 - protein, 513 aa, Homo sapiens
  Payload ID: 19229
  Gene Name: vanin 1
  Uniprot ID: O95497
  ENSP ID: ENSP00000356905
MTTQLPAYVAILLFYVSRASCQDTFTAAVYEHAAILPNATLTPVSREEALALMNRNLDILEGAITSAADQGAHIIVTPEDAIYGWNFNRDSLYPYLEDIPDPEVNWIPCNNRNRFGQTPVQERLSCLAKNNSIYVVANIGDKKPCDTSDPQCPPDGRYQYNTDVVFDSQGKLVARYHKQNLFMGENQFNVPKEPEIVTFNTTFGSFGIFTCFDILFHDPAVTLVKDFHVDTIVFPTAWMNVLPHLSAVEFHSAWAMGMRVNFLASNIHYPSKKMTGSGIYAPNSSRAFHYDMKTEEGKLLLSQLDSHPSHSAVVNWTSYASSIEALSSGNKEFKGTVFFDEFTFVKLTGVAGNYTVCQKDLCCHLSYKMSENIPNEVYALGAFDGLHTVEGRYYLQICTLLKCKTTNLNTCGDSAETASTRFEMFSLSGTFGTQYVFPEVLLSENQLAPGEFQVSTDGRLFSLKPTSGPVLTVTLFGRLYEKDWASNASSGLTAQARIIMLIVIAPIVCSLSW

SEQ ID NO: 96403 - protein, 520 aa, Homo sapiens
  Payload ID: 19230
  Gene Name: vanin 2
  Uniprot ID: O95498
  ENSP ID: ENSP00000322276
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKYHLYSEPQFNVPEKPELVTFNTAFGRFGIFTCFDIFFYDPGVTLVKDFHVDTILFPTAWMNVLPLLTAIEFHSAWAMGMGVNLLVANTHHVSLNMTGSGIYAPNGPKVYHYDMKTELGKLLLSEVDSHPLSSLAYPTAVNWNAYATTIKPFPVQKNTFRGFISRDGFNFTELFENAGNLTVCQKELCCHLSYRMLQKEENEVYVLGAFTGLHGRRRREYWQVCTLLKCKTTNLTTCGRPVETASTRFEMFSLSGTFGTEYVFPEVLLTEIHLSPGKFEVLKDGRLVNKNGSSGPILTVSLFGRWYTKDSLYSSCGTSNSAITYLLIFILLMIIALQNIVML

SEQ ID NO: 96404 - protein, 290 aa, Homo sapiens
  Payload ID: 19230
  Gene Name: vanin 2
  ENSP ID: ENSP00000376190
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKYHLYSEPQFNVPEKPELVTFNTAFGRFGIFTCFDIFFYDPGVTLVKDFHVDTILFPTAWMNVLPLLTAIEFHSAWAMGMGVNLLVANTHHVSLNMTVVFMHQMVPKCIIMT

SEQ ID NO: 96405 - protein, 219 aa, Homo sapiens
  Payload ID: 19230
  Gene Name: vanin 2
  ENSP ID: ENSP00000387572
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKYHLYSEPQFNVPEKPELVTFNTAFGRKWYLCTKWSQSVSL

SEQ ID NO: 96406 - protein, 216 aa, Homo sapiens
  Payload ID: 19230
  Gene Name: vanin 2
  ENSP ID: ENSP00000406536
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKYHLYSEPQFNVPEKPELVTFNTAFGSLDERFAPFDSY

SEQ ID NO: 96407 - protein, 166 aa, Homo sapiens
  Payload ID: 19230
  Gene Name: vanin 2
  ENSP ID: ENSP00000431451
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVV

SEQ ID NO: 96408 - protein, 101 aa, Homo sapiens
  Payload ID: 19230
  Gene Name: vanin 2
  ENSP ID: ENSP00000431680
MVTSSFPISVAVFALITLQVGTQDSFIAAVYEHAVILPNKTETPVSQEDALNLMNENIDILETAIKQAAEQGARIIVTPEDALYGWKFTRETVFPYLEDIP

SEQ ID NO: 96409 - protein, 184 aa, Homo sapiens
  Payload ID: 19230
  Gene Name: vanin 2
  ENSP ID: ENSP00000432516
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKVGKSH

SEQ ID NO: 96410 - protein, 131 aa, Homo sapiens
  Payload ID: 19230
  Gene Name: vanin 2
  ENSP ID: ENSP00000432582
MNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKVGKSH

SEQ ID NO: 96411 - protein, 119 aa, Homo sapiens
  Payload ID: 19230
  Gene Name: vanin 2
  ENSP ID: ENSP00000433285
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRSAHC

SEQ ID NO: 96412 - protein, 192 aa, Homo sapiens
  Payload ID: 19230
  Gene Name: vanin 2
  Uniprot ID: O95498
  ENSP ID: ENSP00000434077
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKETLQSVKRSFAVI

SEQ ID NO: 96413 - protein, 102 aa, Homo sapiens
  Payload ID: 19230
  Gene Name: vanin 2
  ENSP ID: ENSP00000434210
MNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPP

SEQ ID NO: 96414 - protein, 467 aa, Homo sapiens
  Payload ID: 19230
  Gene Name: vanin 2
  Uniprot ID: O95498
  ENSP ID: ENSP00000436822
MNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKYHLYSEPQFNVPEKPELVTFNTAFGRFGIFTCFDIFFYDPGVTLVKDFHVDTILFPTAWMNVLPLLTAIEFHSAWAMGMGVNLLVANTHHVSLNMTGSGIYAPNGPKVYHYDMKTELGKLLLSEVDSHPLSSLAYPTAVNWNAYATTIKPFPVQKNTFRGFISRDGFNFTELFENAGNLTVCQKELCCHLSYRMLQKEENEVYVLGAFTGLHGRRRREYWQVCTLLKCKTTNLTTCGRPVETASTRFEMFSLSGTFGTEYVFPEVLLTEIHLSPGKFEVLKDGRLVNKNGSSGPILTVSLFGRWYTKDSLYSSCGTSNSAITYLLIFILLMIIALQNIVML

SEQ ID NO: 96415 - protein, 195 aa, Homo sapiens
  Payload ID: 19230
  Gene Name: vanin 2
  Uniprot ID: O95498
  ENSP ID: ENSP00000436863
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKEVVFMHQMVPKCIIMT

SEQ ID NO: 96416 - protein, 299 aa, Homo sapiens
  Payload ID: 19230
  Gene Name: vanin 2
  Uniprot ID: O95498
  ENSP ID: ENSP00000436935
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKVCTLLKCKTTNLTTCGRPVETASTRFEMFSLSGTFGTEYVFPEVLLTEIHLSPGKFEVLKDGRLVNKNGSSGPILTVSLFGRWYTKDSLYSSCGTSNSAITYLLIFILLMIIALQNIVML

SEQ ID NO: 96417 - protein, 274 aa, Homo sapiens
  Payload ID: 19231
  Gene Name: vanin 3
  Uniprot ID: Q9NY84
  ENSP ID: ENSP00000438024
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRFGNTPVQQRLSCLAKDNSIYVVANIGDKKPCNASDSQCPPDGRYQYNTDVVFDSQGKLLARYHKYNLFAPEIQFDFPKDSELVTFDTPFGKFGIFTCFDIFSHDPAVVVVDEFQLTAFSTPQHGTTRCPSSRLFPSIQHGPRPWESIYLLQIPTTPACT

SEQ ID NO: 96418 - protein, 117 aa, Homo sapiens
  Payload ID: 19231
  Gene Name: vanin 3
  Uniprot ID: Q9NY84
  ENSP ID: ENSP00000438175
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRNH

SEQ ID NO: 96419 - protein, 117 aa, Homo sapiens; identical to SEQ ID NO: 96418
  Payload ID: 19231
  Gene Name: vanin 3
  Uniprot ID: Q9NY84
  ENSP ID: ENSP00000439449

SEQ ID NO: 96420 - protein, 60 aa, Homo sapiens
  Payload ID: 19231
  Gene Name: vanin 3
  ENSP ID: ENSP00000439815
  MOD_RES (1)..(1): Any amino acid
XTRESIYPYLEDIPDPGVNWIPCRDPWRKSKKMNEPVSKELCYHCHSECNQYGQWKLYRT

SEQ ID NO: 96421 - protein, 169 aa, Homo sapiens
  Payload ID: 19231
  Gene Name: vanin 3
  ENSP ID: ENSP00000440245
MIISHFPKCVAVFALLALSVGALDTFIAAVYEHAVILPNRTETPVSKEEALLLMNKNIDVLEKAVKLAAKQQGAHIIVTPEDGIYGWIFTRESIYPYLEDIPDPGVNWIPCRDPWSMVQHAAPPLGCSLPFSMGQGHGSQSTCCKYPQHQHAHDREWNLRPRSSQGVPL

SEQ ID NO: 96422 - protein, 500 aa, Homo sapiens
  Payload ID: 19231
  Gene Name: vanin 3
  ENSP ID: ENSP00000440594
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRFGNTPVQQRLSCLAKDNSIYVVANIGDKKPCNASDSQCPPDGRYQYNTDVVFDSQGKLLARYHKYNLFAPEIQFDFPKDSELVTFDTPFGKFGIFTCFDIFSHDPAVVVVDESIDSILYPTAWYNTLPLLSAVPFHSAWAKAMGVNLLAANTHNTSMHMTGSGIYAPEAVKVYHYDMETESGQLLLSELKSRPRREPTYPAAVDWHAYASSVKPFSSEQSDFLGMIYFDEFTFTKLKRNTGNYTACQKDLCCHLTYKMSEKRTDEIYALGAFDGLHTVEGQYYLQICALLKCQTTDLETCGEPVGSAFTKFEDFSLSGTFGTRYVFPQIILSGSQLAPERHYEISRDGRLRSRSGAPLPVLVMALYGRVFEKDPPRLGQGSGKFQ

SEQ ID NO: 96423 - protein, 147 aa, Homo sapiens
  Payload ID: 19231
  Gene Name: vanin 3
  Uniprot ID: Q9NY84
  ENSP ID: ENSP00000441182
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRKSKKMNEPVSKELCYHCHSECNQYGQWKLYRT

SEQ ID NO: 96424 - protein, 117 aa, Homo sapiens; identical to SEQ ID NO: 96418
  Payload ID: 19231
  Gene Name: vanin 3
  Uniprot ID: Q9NY84
  ENSP ID: ENSP00000443073

SEQ ID NO: 96425 - protein, 129 aa, Homo sapiens
  Payload ID: 19231
  Gene Name: vanin 3
  Uniprot ID: Q9NY84
  ENSP ID: ENSP00000443901
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWREWNLRPRSSQGVPL

SEQ ID NO: 96426 - protein, 207 aa, Homo sapiens
  Payload ID: 19231
  Gene Name: vanin 3
  Uniprot ID: Q9NY84
  ENSP ID: ENSP00000444491
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRFGNTPVQQRLSCLAKDNSIYVVANIGDKKPCNASDSQCPPDGRYQYNTDVVFDSQGKLLARYHKGVESTPQKQSRCTTMTWKQRVVSCCYQN

SEQ ID NO: 96427 - protein, 133 aa, Homo sapiens
  Payload ID: 19231
  Gene Name: vanin 3
  Uniprot ID: Q9NY84
  ENSP ID: ENSP00000444505
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWSTIFLHLKFSLISPRIQNL

SEQ ID NO: 96428 - protein, 161 aa, Homo sapiens
  Payload ID: 19231
  Gene Name: vanin 3
  Uniprot ID: Q9NY84
  ENSP ID: ENSP00000463583
MIISHFPKCVAVFALLALSVGALDTFIAAVYEHAVILPNRTETPVSKEEALLLMNKNIDVLEKAVKLAAKQVLPFYTCKGDLQFGQRVFGIHDKLFCPTCFEQGAHIIVTPEDGIYGWIFTRESIYPYLEDIPDPGVNWIPCRDPWREWNLRPRSSQGVPL

SEQ ID NO: 96429 - protein, 129 aa, Homo sapiens; identical to SEQ ID NO: 96425
  Payload ID: 19231
  Gene Name: vanin 3
  Uniprot ID: Q9NY84
  ENSP ID: ENSP00000464241

SEQ ID NO: 96430 - protein, 186 aa, Homo sapiens
  Payload ID: 19232
  Gene Name: variable charge, X-linked
  ENSP ID: ENSP00000344144
MSPKPRASGPPAKATEAGKRKSSSQPSPSDPKKKTTKVAKKGKAVRRGRRGKKGAATKMAAVTAPEAESAPAAPGPSDQPSQELPQHELPPEEPVSEGTQHDPLSQEAELEEPLSQESEVEEPLSQESQVEEPLSQESEVEEPLSQESQVEEPLSQESEMEEPLSQESQVEEPPSQESEMEELPSV

SEQ ID NO: 96431 - protein, 206 aa, Homo sapiens
  Payload ID: 19232
  Gene Name: variable charge, X-linked
  Uniprot ID: Q9H320
  ENSP ID: ENSP00000370447
MSPKPRASGPPAKATEAGKRKSSSQPSPSDPKKKTTKVAKKGKAVRRGRRGKKGAATKMAAVTAPEAESAPAAPGPSDQPSQELPQHELPPEEPVSEGTQHDPLSQEAELEEPLSQESEVEEPLSQESQVEEPLSQESEVEEPLSQESQVEEPLSQESEVEEPLSQESQVEEPLSQESEMEEPLSQESQVEEPPSQESEMEELPSV

SEQ ID NO: 96432 - protein, 138 aa, Homo sapiens
  Payload ID: 19232
  Gene Name: variable charge, X-linked
  ENSP ID: ENSP00000484419
MSPKPRASGPPAKATEAGKRKSSSQPSPSDPKKKTTKVAKKGKAVRRGRRGKKGAATKMAAVTAPEAESAPAAPGPSDQPSQELPQHELPPEEPVSEGTQHDPLSQEAELEEPLSQESEVEEPLSVTAKYSPISESSD

SEQ ID NO: 96433 - protein, 139 aa, Homo sapiens [sequence omitted]

SEQ ID NO: 96434 - protein, 186 aa, Homo sapiens
  Payload ID: 19234
  Gene Name: variable charge, X-linked 3A
  Uniprot ID: Q9NNX9
  ENSP ID: ENSP00000370479
MSPKPRASGPPAKATEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQESEVEEPLSQESQVEEPLSQESEVEEPLSQESQVEEPLSQESEVEEPLSQESQVEEPLSQESEMEELPSV

SEQ ID NO: 96435 - protein, 166 aa, Homo sapiens
  Payload ID: 19234
  Gene Name: variable charge, X-linked 3A
  ENSP ID: ENSP00000381713
MSPKPRASGPPAKATEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQESEVEEPLSQESQVEEPLSQESEVEEPLSQESQVEEPLSQESEMEELPSV

SEQ ID NO: 96436 - protein, 138 aa, Homo sapiens
  Payload ID: 19234
  Gene Name: variable charge, X-linked 3A
  ENSP ID: ENSP00000478811
MSPKPRASGPPAKATEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQESEVEEPLSVTASYSPISESSD

SEQ ID NO: 96437 - protein, 214 aa, Homo sapiens
  Payload ID: 19235
  Gene Name: variable charge, X-linked 3B
  ENSP ID: ENSP00000370417
MSPKPRASGPPAKAKEAGKRKSSSQPSPSDPKKKTTKVAKKGKAVRRGRRGKKGAATKMAAVTAPEAESGPAAPGPSDQPSQELPQHELPPEEPVSEVEEPLSQESQVEEPLSQESEVEEPLSQESQVEEPLSQESEVEEPLSQESQVEEPLSQESEVEEPLSQESQVEEPLSQESEMEEPLSQESQVEEPLSQESEMEEPLSQESEMEELPSV

SEQ ID NO: 96438 - protein, 246 aa, Homo sapiens
  Payload ID: 19235
  Gene Name: variable charge, X-linked 3B
  Uniprot ID: Q9H321
  ENSP ID: ENSP00000370420
MSPKPRASGPPAKAKEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQESEVEEPLSQESQVEEPLSQESEVEEPLSQESQVEEPLSQESEVEEPLSQESEVEEPLSQESQVEEPLSQESEVEEPLSQESQVEEPLSQESEMEEPLSQESQVEEPLSQESEMEEPLSQESEMEELPSV

SEQ ID NO: 96439 - protein, 186 aa, Homo sapiens
  Payload ID: 19235
  Gene Name: variable charge, X-linked 3B
  ENSP ID: ENSP00000411785
MSPKPRASGPPAKAKEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQESEVEEPLSQESQVEEPLSQESEVEEPLSQESQVEEPLSQESEVEEPLSQESEVEEPLSQESEMEELPSV

SEQ ID NO: 96440 - protein, 138 aa, Homo sapiens
  Payload ID: 19235
  Gene Name: variable charge, X-linked 3B
  ENSP ID: ENSP00000414780
MSPKPRASGPPAKAKEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQESEVEEPLSVTAKYSPISESSD

SEQ ID NO: 96441 - protein, 125 aa, Homo sapiens
  Payload ID: 19236
  Gene Name: variable charge, Y-linked
  Uniprot ID: O14598
  ENSP ID: ENSP00000250825
MSPKPRASGPPAKAKETGKRKSSSQPSPSGPKKKTTKVAEKGEAVRGGRRGKKGAATKMAAVTAPEAESGPAAPGPSDQPSQELPQHELPPEEPVSEGTQHDPLSQESELEEPLSKGRPSTPLSP

SEQ ID NO: 96442 - protein, 125 aa, Homo sapiens; identical to SEQ ID NO: 96441
  Payload ID: 19237
  Gene Name: variable charge, Y-linked 1B
  Uniprot ID: O14598
  ENSP ID: ENSP00000250823

SEQ ID NO: 96443 - protein, 739 aa, Homo sapiens
  Payload ID: 19238
  Gene Name: vascular cell adhesion molecule 1
  Uniprot ID: P19320
  ENSP ID: ENSP00000294728
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAAQIGDSVMLTCSVMGCESPSFSWRTQIDSPLSGKVRSEGTNSTLTLSPVSFENEHSYLCTVTCGHKKLEKGIQVELYSFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 96444 - protein, 647 aa, Homo sapiens
  Payload ID: 19238
  Gene Name: vascular cell adhesion molecule 1
  Uniprot ID: P19320
  ENSP ID: ENSP00000304611
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQAFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 96445 - protein, 540 aa, Homo sapiens
  Payload ID: 19238
  Gene Name: vascular cell adhesion molecule 1
  ENSP ID: ENSP00000359133
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 96446 - protein, 677 aa, Homo sapiens
  Payload ID: 19238
  Gene Name: vascular cell adhesion molecule 1
  Uniprot ID: P19320
  ENSP ID: ENSP00000359137
MPGKMVVILGASNILWIMFAASQAFKIETTPESRYLAQIGDSVSLTCSTTGSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAAQIGDSVMLTCSVMGCESPSFSWRTQIDSPLSGKVRSEGTNSTLTLSPVSFENEHSYLCTVTCGHKKLEKGIQVELYSFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 96447 - protein, 163 aa, Homo sapiens
  Payload ID: 19239
  Gene Name: vascular endothelial growth factor A
  ENSP ID: ENSP00000230480
MAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 96448 - protein, 317 aa, Homo sapiens
  Payload ID: 19239
  Gene Name: vascular endothelial growth factor A
  ENSP ID: ENSP00000317598
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRCDKPRR

SEQ ID NO: 96449 - protein, 412 aa, Homo sapiens
  Payload ID: 19239
  Gene Name: vascular endothelial growth factor A
  ENSP ID: ENSP00000361125
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 96450 - protein, 327 aa, Homo sapiens
  Payload ID: 19239
  Gene Name: vascular endothelial growth factor A
  ENSP ID: ENSP00000361134
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKCDKPRR

SEQ ID NO: 96451 - protein, 371 aa, Homo sapiens
  Payload ID: 19239
  Gene Name: vascular endothelial growth factor A
  ENSP ID: ENSP00000361137
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 96452 - protein, 147 aa, Homo sapiens
  Payload ID: 19239
  Gene Name: vascular endothelial growth factor A
  Uniprot ID: P15692
  ENSP ID: ENSP00000361148
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKCDKPRR

SEQ ID NO: 96453 - protein, 395 aa, Homo sapiens
  Payload ID: 19239
  Gene Name: vascular endothelial growth factor A
  ENSP ID: ENSP00000388465
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVPCGPCSERRKHLFVQDPQTCKCSCKNTDSRCKARQLELNERTCRCDKPRR

SEQ ID NO: 96454 - protein, 354 aa, Homo sapiens
  Payload ID: 19239
  Gene Name: vascular endothelial growth factor A
  ENSP ID: ENSP00000388663
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKM

SEQ ID NO: 96455 - protein, 389 aa, Homo sapiens
  Payload ID: 19239
  Gene Name: vascular endothelial growth factor A
  ENSP ID: ENSP00000389864
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRPCGPCSERRKHLFVQDPQTCKCSCKNTDSRCKARQLELNERTCRCDKPRR

SEQ ID NO: 96456 - protein, 137 aa, Homo sapiens
  Payload ID: 19239
  Gene Name: vascular endothelial growth factor A
  Uniprot ID: P15692
  ENSP ID: ENSP00000409911
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRCDKPRR

SEQ ID NO: 96457 - protein, 371 aa, Homo sapiens
  Payload ID: 19239
  Gene Name: vascular endothelial growth factor A
  ENSP ID: ENSP00000421561
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRSLTRKD

SEQ ID NO: 96458 - protein, 215 aa, Homo sapiens
  Payload ID: 19239
  Gene Name: vascular endothelial growth factor A
  Uniprot ID: P15692
  ENSP ID: ENSP00000428321
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVPCGPCSERRKHLFVQDPQTCKCSCKNTDSRCKARQLELNERTCRCDKPRR

SEQ ID NO: 96459 - protein, 174 aa, Homo sapiens
  Payload ID: 19239
  Gene Name: vascular endothelial growth factor A
  Uniprot ID: P15692
  ENSP ID: ENSP00000429008
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKM

SEQ ID NO: 96460 - protein, 111 aa, Homo sapiens
  Payload ID: 19239
  Gene Name: vascular endothelial growth factor A
  ENSP ID: ENSP00000429592
APMAEGGGQNHHEVVKFMDVYQRSYCHPIETLVDIFQEYPDEIEYIFKPSCVPLMRCGGCCNDEGLECVPTEESNITMQTCKCSCKNTDSRCKARQLELNERTCRCDKPRR

SEQ ID NO: 96461 - protein, 191 aa, Homo sapiens
  Payload ID: 19239
  Gene Name: vascular endothelial growth factor A
  Uniprot ID: P15692
  ENSP ID: ENSP00000429643
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 96462 - protein, 191 aa, Homo sapiens
  Payload ID: 19239
  Gene Name: vascular endothelial growth factor A
  Uniprot ID: P15692
  ENSP ID: ENSP00000430002
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRSLTRKD

SEQ ID NO: 96463 - protein, 232 aa, Homo sapiens
  Payload ID: 19239
  Gene Name: vascular endothelial growth factor A
  Uniprot ID: P15692
  ENSP ID: ENSP00000430479
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 96464 - protein, 323 aa, Homo sapiens
  Payload ID: 19239
  Gene Name: vascular endothelial growth factor A
  ENSP ID: ENSP00000430594
  MOD_RES (1)..(1): Any amino acid
XRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVCDKPRR

SEQ ID NO: 96465 - protein, 209 aa, Homo sapiens
  Payload ID: 19239
  Gene Name: vascular endothelial growth factor A
  Uniprot ID: P15692
  ENSP ID: ENSP00000430829
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRPCGPCSERRKHLFVQDPQTCKCSCKNTDSRCKARQLELNERTCRCDKPRR

SEQ ID NO: 96466 - protein, 327 aa, Homo sapiens; identical to SEQ ID NO: 96450
  Payload ID: 19239
  Gene Name: vascular endothelial growth factor A
  ENSP ID: ENSP00000478034

SEQ ID NO: 96467 - protein, 412 aa, Homo sapiens; identical to SEQ ID NO: 96449
  Payload ID: 19239
  Gene Name: vascular endothelial growth factor A
  ENSP ID: ENSP00000478570

SEQ ID NO: 96468 - protein, 371 aa, Homo sapiens; identical to SEQ ID NO: 96451
  Payload ID: 19239
  Gene Name: vascular endothelial growth factor A
  ENSP ID: ENSP00000483241

SEQ ID NO: 96469 - protein, 317 aa, Homo sapiens; identical to SEQ ID NO: 96448
  Payload ID: 19239
  Gene Name: vascular endothelial growth factor A
  ENSP ID: ENSP00000484284

SEQ ID NO: 96470 - protein, 207 aa, Homo sapiens
  Payload ID: 19240
  Gene Name: vascular endothelial growth factor B
  Uniprot ID: P49765
  ENSP ID: ENSP00000311127
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDRAATPHHRPQPRSVPGWDSAPGAPSPADITHPTPAPGPSAHAAPSTTSALTPGPAAAAADAAASSVAKGGA

SEQ ID NO: 96471 - protein, 188 aa, Homo sapiens
  Payload ID: 19240
  Gene Name: vascular endothelial growth factor B
  Uniprot ID: P49765
  ENSP ID: ENSP00000401550
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDSPRPLCPRCTQHHQRPDPRTCRCRCRRRSFLRCQGRGLELNPDTCRCRKLRR

SEQ ID NO: 96472 - protein, 32 aa, Homo sapiens
  Payload ID: 19240
  Gene Name: vascular endothelial growth factor B
  ENSP ID: ENSP00000442526
  MOD_RES (1)..(1): Any amino acid
XHAAPSTTSALTPGPAAAAADAAASSVAKGGA

SEQ ID NO: 96473 - protein, 419 aa, Homo sapiens
  Payload ID: 19241
  Gene Name: vascular endothelial growth factor C
  Uniprot ID: P49767
  ENSP ID: ENSP00000480043
MHLLGFFSVACSLLAAALLPGPREAPAAAAAFESGLDLSDAEPDAGEATAYASKDLEEQLRSVSSVDELMTVLYPEYWKMYKCQLRKGGWQHNREQANLNSRTEETIKFAAAHYNTEILKSIDNEWRKTQCMPREVCIDVGKEFGVATNTFFKPPCVSVYRCGGCCNSEGLQCMNTSTSYLSKTLFEITVPLSQGPKPVTISFANHTSCRCMSKLDVYRQVHSIIRRSLPATLPQCQAANKTCPTNYMWNNHICRCLAQEDFMFSSDAGDDSTDGFHDICGPNKELDEETCQCVCRAGLRPASCGPHKELDRNSCQCVCKNKLFPSQCGANREFDENTCQCVCKRTCPRNQPLNPGKCACECTESPQKCLLKGKKFHHQTCSCYRRPCTNRQKACEPGFSYSEEVCRCVPSYWKRPQMS

SEQ ID NO: 96474 - protein, 340 aa, Homo sapiens
  Payload ID: 19242
  Gene Name: vascular endothelial zinc finger 1
  ENSP ID: ENSP00000258963
  MOD_RES (1)..(1): Any amino acid
XLNRHKLSHSDEKPFECPICNQRFKRKDRMTYHVRSHEGGITKPYTCSVCGKGFSRPDHLSCHVKHVHSTERPFKCQFSSLMQTCTAAFATKDRLRTHMVRHEGKVSCNICGKLLSAAYITSHLKTHGQSQSINCNTCKQGISKTCMSEETSNQKQQQQQQQQQQQQQQQQQQHVTSWPGKQVETLRLWEEAVKARKKEAANLCQTSTAATTPVTLTTPFSITSSVSSGTMSNPVTVAAAMSMRSPVNVSSAVNITSPMNIGHPVTITSPLSMTSPLTLTTPVNLPTPVTAPVNIAHPVTITSPMNLPTPMTLAAPLNIAMRPVESMPFLPQALPTSPPW

SEQ ID NO: 96475 - protein, 521 aa, Homo sapiens
  Payload ID: 19242
  Gene Name: vascular endothelial zinc finger 1
  Uniprot ID: Q14119
  ENSP ID: ENSP00000462337
MEANWTAFLFQAHEASHHQQQAAQNSLLPLLSSAVEPPDQKPLLPIPITQKPQGAPETLKDAIGIKKEKPKTSFVCTYCSKAFRDSYHLRRHESCHTGIKLVSRPKKTPTTVVPLISTIAGDSSRTSLVSTIAGILSTVTTSSSGTNPSSSASTTAMPVTQSVKKPSKPVKKNHACEMCGKAFRDVYHLNRHKLSHSDEKPFECPICNQRFKRKDRMTYHVRSHEGGITKPYTCSVCGKGFSRPDHLSCHVKHVHSTERPFKCQTCTAAFATKDRLRTHMVRHEGKVSCNICGKLLSAAYITSHLKTHGQSQSINCNTCKQGISKTCMSEETSNQKQQQQQQQQQQQQQQQQQQHVTSWPGKQVETLRLWEEAVKARKKEAANLCQTSTAATTPVTLTTPFSITSSVSSGTMSNPVTVAAAMSMRSPVNVSSAVNITSPMNIGHPVTITSPLSMTSPLTLTTPVNLPTPVTAPVNIAHPVTITSPMNLPTPMTLAAPLNIAMRPVESMPFLPQALPTSPPW

SEQ ID NO: 96476 - protein, 16 aa, Homo sapiens
  Payload ID: 19242
  Gene Name: vascular endothelial zinc finger 1
  ENSP ID: ENSP00000463631
MPVTQSVKKPSKPVKK

SEQ ID NO: 96477 - protein, 512 aa, Homo sapiens
  Payload ID: 19242
  Gene Name: vascular endothelial zinc finger 1
  ENSP ID: ENSP00000464687
MAAHEASHHQQQAAQNSLLPLLSSAVEPPDQKPLLPIPITQKPQGAPETLKDAIGIKKEKPKTSFVCTYCSKAFRDSYHLRRHESCHTGIKLVSRPKKTPTTVVPLISTIAGDSSRTSLVSTIAGILSTVTTSSSGTNPSSSASTTAMPVTQSVKKPSKPVKKNHACEMCGKAFRDVYHLNRHKLSHSDEKPFECPICNQRFKRKDRMTYHVRSHEGGITKPYTCSVCGKGFSRPDHLSCHVKHVHSTERPFKCQTCTAAFATKDRLRTHMVRHEGKVSCNICGKLLSAAYITSHLKTHGQSQSINCNTCKQGISKTCMSEETSNQKQQQQQQQQQQQQQQQQQQHVTSWPGKQVETLRLWEEAVKARKKEAANLCQTSTAATTPVTLTTPFSITSSVSSGTMSNPVTVAAAMSMRSPVNVSSAVNITSPMNIGHPVTITSPLSMTSPLTLTTPVNLPTPVTAPVNIAHPVTITSPMNLPTPMTLAAPLNIAMRPVESMPFLPQALPTSPPW

SEQ ID NO: 96478 - protein, 169 aa, Homo sapiens
  Payload ID: 19243
  Gene Name: vasoactive intestinal peptide
  Uniprot ID: P01282
  ENSP ID: ENSP00000356212
MDTRNKAQLLVLLTLLSVLFSQTSAWPLYRAPSALRLGDRIPFEGANEPDQVSLKEDIDMLQNALAENDTPYYDVSRNARHADGVFTSDFSKLLGQLSAKKYLESLMGKRVSNISEDPVPVKRHSDAVFTDNYTRLRKQMAVKKYLNSILNGKRSSEGESPDFPEELEK

SEQ ID NO: 96479 - protein, 170 aa, Homo sapiens
  Payload ID: 19243
  Gene Name: vasoactive intestinal peptide
  Uniprot ID: P01282
  ENSP ID: ENSP00000356213
MDTRNKAQLLVLLTLLSVLFSQTSAWPLYRAPSALRLGDRIPFEGANEPDQVSLKEDIDMLQNALAENDTPYYDVSRNARHADGVFTSDFSKLLGQLSAKKYLESLMGKRVSSNISEDPVPVKRHSDAVFTDNYTRLRKQMAVKKYLNSILNGKRSSEGESPDFPEELEK

SEQ ID NO: 96480 - protein, 119 aa, Homo sapiens
  Payload ID: 19243
  Gene Name: vasoactive intestinal peptide
  ENSP ID: ENSP00000410356
  MOD_RES (1)..(1): Any amino acid
XVSLKEDIDMLQNALAENDTPYYDVSRNARHADGVFTSDFSKLLGQLSAKKYLESLMGKRVSSNISEDPVPVKRHSDAVFTDNYTRLRKQMAVKKYLNSILNGKRSEGESPDFPEELEK

SEQ ID NO: 96481 - protein, 457 aa, Homo sapiens
  Payload ID: 19244
  Gene Name: vasoactive intestinal peptide receptor 1
  Uniprot ID: P32241
  ENSP ID: ENSP00000327246
MRPPSPLPARWLCVLAGALAWALGPAGGQAARLQEECDYVQMIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 96482 - protein, 45 aa, Homo sapiens
  Payload ID: 19244
  Gene Name: vasoactive intestinal peptide receptor 1
  ENSP ID: ENSP00000388479
MRPPSPLPARWLCVLAGALAWALGPAAAARCGTTSPAGQPPLGAR

SEQ ID NO: 96483 - protein, 45 aa, Homo sapiens; identical to SEQ ID NO: 96482
  Payload ID: 19244
  Gene Name: vasoactive intestinal peptide receptor 1
  ENSP ID: ENSP00000393215

SEQ ID NO: 96484 - protein, 416 aa, Homo sapiens
  Payload ID: 19244
  Gene Name: vasoactive intestinal peptide receptor 1
  Uniprot ID: P32241
  ENSP ID: ENSP00000394950
MIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 96485 - protein, 45 aa, Homo sapiens; identical to SEQ ID NO: 96482
  Payload ID: 19244
  Gene Name: vasoactive intestinal peptide receptor 1
  ENSP ID: ENSP00000396204

SEQ ID NO: 96486 - protein, 219 aa, Homo sapiens
  Payload ID: 19244
  Gene Name: vasoactive intestinal peptide receptor 1
  ENSP ID: ENSP00000403478
MRPPSPLPARWLCVLAGALAWALGPAGGQAARLQEECDYVQMIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRWAVRQPWSFSNIVSWLTSSGCWWRASTCTPCLPSPSSLSGSTSGGTYSSAG

SEQ ID NO: 96487 - protein, 45 aa, Homo sapiens; identical to SEQ ID NO: 96482
  Payload ID: 19244
  Gene Name: vasoactive intestinal peptide receptor 1
  ENSP ID: ENSP00000403680

SEQ ID NO: 96488 - protein, 126 aa, Homo sapiens
  Payload ID: 19244
  Gene Name: vasoactive intestinal peptide receptor 1
  ENSP ID: ENSP00000415013
MIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLF

SEQ ID NO: 96489 - protein, 247 aa, Homo sapiens
  Payload ID: 19244
  Gene Name: vasoactive intestinal peptide receptor 1
  Uniprot ID: P32241
  ENSP ID: ENSP00000415371
MTRQRVWMRWAVRQPWSFSNIVSWLTSSGCWWRASTCTPCLPSPSSLSGSTSGGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 96490 - protein, 409 aa, Homo sapiens
  Payload ID: 19244
  Gene Name: vasoactive intestinal peptide receptor 1
  Uniprot ID: P32241
  ENSP ID: ENSP00000445701
MRAGRRPRLGPWAGGCSKMWDNLTCWPATPRGQVVVLACPLIFKLFSSIQGRNVSRSCTDEGWTHLEPGPYPIACGLDDKAASLDEQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 96491 - protein, 438 aa, Homo sapiens
  Payload ID: 19245
  Gene Name: vasoactive intestinal peptide receptor 2
  Uniprot ID: P41587
  ENSP ID: ENSP00000262178
MRTLLPPALLTCWLLAPVNSIHPECRFHLEIQEEETKCAELLRSQTEKHKACSGVWDNITCWRPANVGETVTVPCPKVFSNFYSKAGNISKNCTSDGWSETFPDFVDACGYSDPEDESKITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 96492 - protein, 422 aa, Homo sapiens
  Payload ID: 19245
  Gene Name: vasoactive intestinal peptide receptor 2
  Uniprot ID: P41587
  ENSP ID: ENSP00000366860
MPLWEAPSDHPANPPATLQGHTSLPGCQEEPARDPQSGLPQITSESSSFSEGSLPSWSSGPAGAKLNASHEGIGSSSDGNGDSKAATERVVSAMDTVRRKHPEITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 96493 - protein, 579 aa, Homo sapiens
  Payload ID: 19245
  Gene Name: vasoactive intestinal peptide receptor 2
  ENSP ID: ENSP00000384497
MRTLLPPALLTCWLLAPVSAPATPAPRRLGPGSPLPRRALLPPVFAFLPGAGARAGSGRGSGVARGPELPPGEREALSSGPAGLRDSGWEAACALPRAPPSGVCWKRDRFFLDASTMSSFGAVPGAGSCGRLRGLRVSRGDRGWRWPQMPLGPSLYLLVNSIHPECRFHLEIQEEETKCAELLRSQTEKHKACSGVWDNITCWRPANVGETVTVPCPKVFSNFYSKAGNISKNCTSDGWSETFPDFVDACGYSDPEDESKITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 96494 - protein, 77 aa, Homo sapiens
  Payload ID: 19245
  Gene Name: vasoactive intestinal peptide receptor 2
  ENSP ID: ENSP00000402690
MRTLLPPALLTCWLLAPVNSIHPECRFHLEIQEEETKCAELLRSQTEKHKGHTKGFILIHAGGLKRILDPHTYPLAP

SEQ ID NO: 96495 - protein, 380 aa, Homo sapiens
  Payload ID: 19246
  Gene Name: vasodilator-stimulated phosphoprotein
  Uniprot ID: P50552
  ENSP ID: ENSP00000245932
MSETVICSSRATVMLYDDGNKRWLPAGTGPQAFSRVQIYHNPTANSFRVVGRKMQPDQQVVINCAIVRGVKYNQATPNFHQWRDARQVWGLNFGSKEDAAQFAAGMASALEALEGGGPPPPPALPTWSVPNGPSPEEVEQQKRQQPGPSEHIERRVSNAGGPPAPPAGGPPPPPGPPPPPGPPPPPGLPPSGVPAAAHGAGGGPPPAPPLPAAQGPGGGGAGAPGLAAAIAGAKLRKVSKQEEASGGPTAPKAESGRSGGGGLMEEMNAMLARRRKATQVGEKTPKDESANQEEPEARVPAQSESVRRPWEKNSTTLPRMKSSSSVTTSETQPCTPSSSDYSDLQRVKQELLEEVKKELQKVKEEIIEAFVQELRKRGSP

SEQ ID NO: 96496 - protein, 46 aa, Homo sapiens
  Payload ID: 19246
  Gene Name: vasodilator-stimulated phosphoprotein
  ENSP ID: ENSP00000464742
MSETVICSSRATVMLYDDGNKRWLPAGTGPQAWPQLLLEPNSGKSA

SEQ ID NO: 96497 - protein, 183 aa, Homo sapiens
  Payload ID: 19246
  Gene Name: vasodilator-stimulated phosphoprotein
  ENSP ID: ENSP00000466319
  MOD_RES (1)..(1): Any amino acid
XAKLRKVSKQEEASGGPTAPKAESGRSGGGGLMEEMNAMLARRRKATQVGEKTPKDESANQEEPEARVPAQSESVRRPWEKNSTTLPRMKSSSSVTTSETQPCTPSSSDYSDLQRVKQMSALNSFRTLTQLSITNWSWQEAGMRLPTLVLDVLQYFSGSKDPEFSPRILQSLCDLDSDVMVSM

SEQ ID NO: 96498 - protein, 103 aa, Homo sapiens
  Payload ID: 19246
  Gene Name: vasodilator-stimulated phosphoprotein
  ENSP ID: ENSP00000467005
MSETVICSSRATVMLYDDGNKRWLPAGTGPQAFSRVQIYHNPTANSFRVVGRKMQPDQQVVINCAIVRGVNWGPRPGRSYCWSQTQESQQAGGGLRGAHSPQS

SEQ ID NO: 96499 - protein, 59 aa, Homo sapiens
  Payload ID: 19246
  Gene Name: vasodilator-stimulated phosphoprotein
  ENSP ID: ENSP00000467061
MSETVICSSRATVMLYDDGNKRWLPAGTGPQAFSRVQIYHNPTANSFRVVGRKMQPDQQ

SEQ ID NO: 96500 - protein, 35 aa, Homo sapiens
  Payload ID: 19246
  Gene Name: vasodilator-stimulated phosphoprotein
  ENSP ID: ENSP00000467773
MRQQPGPSEHIERRVSNAGGPPAPPAGGPPPPPGP

SEQ ID NO: 96501 - protein, 365 aa, Homo sapiens
  Payload ID: 19247
  Gene Name: vasohibin 1
  Uniprot ID: Q7L8A9
  ENSP ID: ENSP00000167106
MPGGKKVAGGGSSGATPTSAAATAPSGVRRLETSEGTSAQRDEEPEEEGEEDLRDGGVPFFVNRGGLPVDEATWERMWKHVAKIHPDGEKVAQRIRGATDLPKIPIPSVPTFQPSTPVPERLEAVQRYIRELQYNHTGTQFFEIKKSRPLTGLMDLAKEMTKEALPIKCLEAVILGIYLTNSMPTLERFPISFKTYFSGNYFRHIVLGVNFAGRYGALGMSRREDLMYKPPAFRTLSELVLDFEAAYGRCWHVLKKVKLGQSVSHDPHSVEQIEWKHSVLDVERLGRDDFRKELERHARDMRLKIGKGTGPPSPTKDRKKDVSSPQRAQSSPHRRNSRSERRPSGDKKTSEPKAMPDLNGYQIRV

SEQ ID NO: 96502 - protein, 204 aa, Homo sapiens
  Payload ID: 19247
  Gene Name: vasohibin 1
  Uniprot ID: Q7L8A9
  ENSP ID: ENSP00000451613
MPGGKKVAGGGSSGATPTSAAATAPSGVRRLETSEGTSAQRDEEPEEEGEEDLRDGGVPFFVNRGGLPVDEATWERMWKHVAKIHPDGEKVAQRIRGATDLPKIPIPSVPTFQPSTPVPERLEAVQRYIRELQYNHTGTQFFEIKKSRPLTGLMDLAKEMTKEALPIKCLEAVILGMYPSSPEGEGSGLLWASASCSESEGGVG

SEQ ID NO: 96503 - protein, 91 aa, Homo sapiens
  Payload ID: 19247
  Gene Name: vasohibin 1
  ENSP ID: ENSP00000451908
MGPGEGNCWFCWCLCPWLLSGSWVHLISGKSPSLTRPVMGGGGGVEMFLQFCLPWQNLDPGKGKQGRSPSEKGLCSPLTRSLAQATSAPRA

SEQ ID NO: 96504 - protein, 169 aa, Homo sapiens
  Payload ID: 19248
  Gene Name: vasohibin 2
  Uniprot ID: Q86V25
  ENSP ID: ENSP00000355931
MTGSAADTHRCPHPKGAKGTRSRSSHARPVSLATSGGSEEEDKDGGVLFHVNKSGFPIDSHTWERMWMHVAKVHPKGGEMVGAIRNAAFLAKPSIPQVPNYRLSMTIPDWLQAIQNYMKTLQYNHTGTQFFEIRKMRPLSGLMETAKEMTRESLPIKCLEAVILGITHS

SEQ ID NO: 96505 - protein, 311 aa, Homo sapiens
  Payload ID: 19248
  Gene Name: vasohibin 2
  Uniprot ID: Q86V25
  ENSP ID: ENSP00000355932
MTGSAADTHRCPHPKGAKGTRSRSSHARPVSLATSGGSEEEDKDGGVLFHVNKSGFPIDSHTWERMWMHVAKVHPKGGEMVGAIRNAAFLAKPSIPQVPNYRLSMTIPDWLQAIQNYMKTLHYLTNGQPSIERFPISFKTYFSGNYFHHVVLGIYCNGRYGSLGMSRRAELMDKPLTFRTLSDLIFDFEDSYKKYLHTVKKVKIGLYVPHEPHSFQPIEWKQLVLNVSKMLRADIRKELEKYARDMRMKILKPASAHSPTQVRSRGKSLSPRRRQASPPRRLGRREKSPALPEKKVADLSTLNEVGYQIRI

SEQ ID NO: 96506 - protein, 290 aa, Homo sapiens
  Payload ID: 19248
  Gene Name: vasohibin 2
  Uniprot ID: Q86V25
  ENSP ID: ENSP00000355935
MWMHVAKVHPKGGEMVGAIRNAAFLAKPSIPQVPNYRLSMTIPDWLQAIQNYMKTLQYNHTGTQFFEIRKMRPLSGLMETAKEMTRESLPIKCLEAVILGIYLTNGQPSIERFPISFKTYFSGNYFHHVVLGIYCNGRYGSLGMSRRAELMDKPLTFRTLSDLIFDFEDSYKKYLHTVKKVKIGLYVPHEPHSFQPIEWKQLVLNVSKMLRADIRKELEKYARDMRMKILKPASAHSPTQVRSRGKSLSPRRRQASPPRRLGRREKSPALPEKKVADLSTLNEVGYQIRI

SEQ ID NO: 96507 - protein, 25 aa, Homo sapiens
  Payload ID: 19248
  Gene Name: vasohibin 2
  ENSP ID: ENSP00000419918
MWMHVAKVHPKGGEMVGAIRNAAFL

SEQ ID NO: 96508 - protein, 355 aa, Homo sapiens
  Payload ID: 19248
  Gene Name: vasohibin 2
  Uniprot ID: Q86V25
  ENSP ID: ENSP00000428324
MTGSAADTHRCPHPKGAKGTRSRSSHARPVSLATSGGSEEEDKDGGVLFHVNKSGFPIDSHTWERMWMHVAKVHPKGGEMVGAIRNAAFLAKPSIPQVPNYRLSMTIPDWLQAIQNYMKTLQYNHTGTQFFEIRKMRPLSGLMETAKEMTRESLPIKCLEAVILGIYLTNGQPSIERFPISFKTYFSGNYFHHVVLGIYCNGRYGSLGMSRRAELMDKPLTFRTLSDLIFDFEDSYKKYLHTVKKVKIGLYVPHEPHSFQPIEWKQLVLNVSKMLRADIRKELEKYARDMRMKILKPASAHSPTQVRSRGKSLSPRRRQASPPRRLGRREKSPALPEKKVADLSTLNEVGYQIRI

SEQ ID NO: 96509 - protein, 251 aa, Homo sapiens
  Payload ID: 19248
  Gene Name: vasohibin 2
  Uniprot ID: Q86V25
  ENSP ID: ENSP00000429040
MTIPDWLQAIQNYMKTLQYNHTGTQFFEIRKMRPLSGLMETAKEMTRESLPIKCLEAVILGIYLTNGQPSIERFPISFKTYFSGNYFHHVVLGIYCNGRYGSLGMSRRAELMDKPLTFRTLSDLIFDFEDSYKKYLHTVKKVKIGLYVPHEPHSFQPIEWKQLVLNVSKMLRADIRKELEKYARDMRMKILKPASAHSPTQVRSRGKSLSPRRRQASPPRRLGRREKSPALPEKKVADLSTLNEVGYQIRI

SEQ ID NO: 96510 - protein, 290 aa, Homo sapiens; identical to SEQ ID NO: 96506
  Payload ID: 19248
  Gene Name: vasohibin 2
  Uniprot ID: Q86V25
  ENSP ID: ENSP00000430319

SEQ ID NO: 96511 - protein, 673 aa, Homo sapiens
  Payload ID: 19249
  Gene Name: vasorin
  Uniprot ID: Q6EMK4
  ENSP ID: ENSP00000306864
MCSRVPLLLPLLLLLALGPGVQGCPSGCQCSQPQTVFCTARQGTTVPRDVPPDTVGLYVFENGITMLDAGSFAGLPGLQLLDLSQNQIASLPSGVFQPLANLSNLDLTANRLHEITNETFRGLRRLERLYLGKNRIRHIQPGAFDTLDRLLELKLQDNELRALPPLRLPRLLLLDLSHNSLLALEPGILDTANVEALRLAGLGLQQLDEGLFSRLRNLHDLDVSDNQLERVPPVIRGLRGLTRLRLAGNTRIAQLRPEDLAGLAALQELDVSNLSLQALPGDLSGLFPRLRLLAAARNPFNCVCPLSWFGPWVRESHVTLASPEETRCHFPPKNAGRLLLELDYADFGCPATTTTATVPTTRPVVREPTALSSSLAPTWLSPTEPATEAPSPPSTAPPTVGPVPQPQDCPPSTCLNGGTCHLGTRHHLACLCPEGFTGLYCESQMGQGTRPSPTPVTPRPPRSLTLGIEPVSPTSLRVGLQRYLQGSSVQLRSLRLTYRNLSGPDKRLVTLRLPASLAEYTVTQLRPNATYSVCVMPLGPGRVPEGEEACGEAHTPPAVHSNHAPVTQAREGNLPLLIAPALAAVLLAALAAVGAAYCVRRGRAMAAAAQDKGQVGPGAGPLELEGVKVPLEPGPKATEGGGEALPSGSECEVPLMGFPGPGLQSPLHAKPYI

SEQ ID NO: 96512 - protein, 673 aa, Homo sapiens; identical to SEQ ID NO: 96511
  Payload ID: 19249
  Gene Name: vasorin
  Uniprot ID: Q6EMK4
  ENSP ID: ENSP00000481884

SEQ ID NO: 96513 - protein, 823 aa, Homo sapiens
  Payload ID: 19250
  Gene Name: vav 1 guanine nucleotide exchange factor
  ENSP ID: ENSP00000302269
MELWRQCTHWLIQCRVLPPSHRVTWDGAQVCELAQALRDGVLLCQLLNNLLPHAINLREVNLRPQMSQFLCLKNIRTFLSTCCEKFGLKRSELFEAFDLFDVQDFGKVIYTLSALSWTPIAQNRGIMPFPTEEESVGDEDIYSGLSDQIDDTVEEDEDLYDCVENEEAEGDEIYEDLMRSEPVSMPPKMTEYDKRCCCLREIQQTEEKYTDTLGSIQQHFLKPLQRFLKPQDIEIIFINIEDLLRVHTHFLKEMKEALGTPGAANLYQVFIKYKERFLVYGRYCSQVESASKHLDRVAAAREDVQMKLEECSQRANNGRFTLRDLLMVPMQRVLKYHLLLQELVKHTQEAMEKENLRLALDAMRDLAQCVNEVKRDNETLRQITNFQLSIENLDQSLAHYGRPKIDGELKITSVERRSKMDRYAFLLDKALLICKRRGDSYDLKDFVNLHSFQVRDDSSGDRDNKKWSHMFLLIEDQGAQGYELFFKTRELKKKWMEQFEMAISNIYPENATANGHDFQMFSFEETTSCKACQMLLRGTFYQGYRCHRCRASAHKECLGRVPPCGRHGQDFPGTMKKDKLHRRAQDKKRNELGLPKMEVFQEYYGLPPPPGAIGPFLRLNPGDIVELTKAEAEQNWWEGPPQDLSVHLWYAGPMERAGAESILANRSDGTFLVRQRVKDAAEFAISIKYNVEVKHIKIMTAEGLYRITEKKAFRGLTELVEFYQQNSLKDCFKSLDTTLQFPFKEPEKRTISRPAVGSTKYFGTAKARYDFCARDRSELSLKEGDIIKILNKKGQQGWWRGEIYGRVGWFPANYVEEDYSEYC

SEQ ID NO: 96514 - protein, 789 aa, Homo sapiens
  Payload ID: 19250
  Gene Name: vav 1 guanine nucleotide exchange factor
  ENSP ID: ENSP00000443242
MIASLHSSLDNRFLCLKNIRTFLSTCCEKFGLKRSELFEAFDLFDVQDFGKVIYTLSALSWTPIAQNRGIMPFPTEEESVGDEDIYSGLSDQIDDTVEEDEDLYDCVENEEAEGDEIYEDLMRSEPVSMPPKMTEYDKRCCCLREIQQTEEKYTDTLGSIQQHFLKPLQRFLKPQDIEIIFINIEDLLRVHTHFLKEMKEALGTPGAANLYQVFIKYKERFLVYGRYCSQVESASKHLDRVAAAREDVQMKLEECSQRANNGRFTLRDLLMVPMQRVLKYHLLLQELVKHTQEAMEKENLRLALDAMRDLAQCVNEVKRDNETLRQITNFQLSIENLDQSLAHYGRPKIDGELKITSVERRSKMDRYAFLLDKALLICKRRGDSYDLKDFVNLHSFQVRDDSSGDRDNKKWSHMFLLIEDQGAQGYELFFKTRELKKKWMEQFEMAISNIYPENATANGHDFQMFSFEETTSCKACQMLLRGTFYQGYRCHRCRASAHKECLGRVPPCGRHGQDFPGTMKKDKLHRRAQDKKRNELGLPKMEVFQEYYGLPPPPGAIGPFLRLNPGDIVELTKAEAEQNWWEGRNTSTNEIGWFPCNRVKPYVHGPPQDLSVHLWYAGPMERAGAESILANRSDGTFLVRQRVKDAAEFAISIKYNVEVKHIKIMTAEGLYRITEKKAFRGLTELVEFYQQNSLKDCFKSLDTTLQFPFKEPEKRTISRPAVGSTKYFGTAKARYDFCARDRSELSLKEGDIIKILNKKGQQGWWRGEIYGRVGWFPANYVEEDYSEYC

SEQ ID NO: 96515 - protein, 813 aa, Homo sapiens
  Payload ID: 19250
  Gene Name: vav 1 guanine nucleotide exchange factor
  Uniprot ID: P15498
  ENSP ID: ENSP00000469450
MELWRQCTHWLIQCRVLPPSHRVTWDGAQVCELAQALRDGVLLCQLLNNLLPHAINLREVNLRPQMSQFLCLKNIRTFLSTCCEKFGLKRSELFEAFDLFDVQDFGKVIYTLSALSWTPIAQNRGIMPFPTEEESVGDEDIYSGLSDQIDDTVEEDEDLYDCVENEEAEGDEIYEDLMRSEPVSMPHFLKPLQRFLKPQDIEIIFINIEDLLRVHTHFLKEMKEALGTPGAANLYQVFIKYKERFLVYGRYCSQVESASKHLDRVAAAREDVQMKLEECSQRANNGRFTLRDLLMVPMQRVLKYHLLLQELVKHTQEAMEKENLRLALDAMRDLAQCVNEVKRDNETLRQITNFQLSIENLDQSLAHYGRPKIDGELKITSVERRSKMDRYAFLLDKALLICKRRGDSYDLKDFVNLHSFQVRDDSSGDRDNKKWSHMFLLIEDQGAQGYELFFKTRELKKKWMEQFEMAISNIYPENATANGHDFQMFSFEETTSCKACQMLLRGTFYQGYRCHRCRASAHKECLGRVPPCGRHGQDFPGTMKKDKLHRRAQDKKRNELGLPKMEVFQEYYGLPPPPGAIGPFLRLNPGDIVELTKAEAEQNWWEGRNTSTNEIGWFPCNRVKPYVHGPPQDLSVHLWYAGPMERAGAESILANRSDGTFLVRQRVKDAAEFAISIKYNVEVKHIKIMTAEGLYRITEKKAFRGLTELVEFYQQNSLKDCFKSLDTTLQFPFKEPEKRTISRPAVGSTKYFGTAKARYDFCARDRSELSLKEGDIIKILNKKGQQGWWRGEIYGRVGWFPANYVEEDYSEYC

SEQ ID NO: 96516 - protein, 790 aa, Homo sapiens
  Payload ID: 19250
  Gene Name: vav 1 guanine nucleotide exchange factor
  ENSP ID: ENSP00000472803
MIVLPLYSRLDKRFLCLKNIRTFLSTCCEKFGLKRSELFEAFDLFDVQDFGKVIYTLSALSWTPIAQNRGIMPFPTEEESVGDEDIYSGLSDQIDDTVEEDEDLYDCVENEEAEGDEIYEDLMRSEPVSMPPKMTEYDKRCCCLREIQQTEEKYTDTLGSIQQHFLKPLQRFLKPQDIEIIFINIEDLLRVHTHFLKEMKEALGTPGAANLYQVFIKYKERFLVYGRYCSQVESASKHLDRVAAAREDVQMKLEECSQRANNGRFTLRDLLMVPMQRVLKYHLLLQELVKHTQEAMEKENLRLALDAMRDLAQCVNEVKRDNETLRQITNFQLSIENLDQSLAHYGRPKIDGELKITSVERRSKMDRYAFLLDKALLICKRRGDSYDLKDFVNLHSFQVRDDSSGDRDNKKWSHMFLLIEDQGAQGYELFFKTRELKKKWMEQFEMAISNIYPENATANGHDFQMFSFEETTSCKACQMLLRGTFYQGYRCHRCRASAHKECLGRVPPCGRHGQDFPGTMKKDKLHRRAQDKKRNELGLPKMEVFQEYYGLPPPPGAIGPFLRLNPGDIVELTKAEAEQNWWEGRNTSTNEIGWFPCNRVKPYVHGPPQDLSVHLWYAGPMERAGAESILANRSDGTFLVRQRVKDAAEFAISIKYNVEVKHIKIMTAEGLYRITEKKAFRGLTELVEFYQQNSLKDCFKSLDTTLQFPFKEPEKRTISRPAVGSTKYFGTAKARYDFCARDRSELSLKEGDIIKILNKKGQQGWWRGEIYGRVGWFPANYVEEDYSEYC

SEQ ID NO: 96517 - protein, 845 aa, Homo sapiens
  Payload ID: 19250
  Gene Name: vav 1 guanine nucleotide exchange factor
  Uniprot ID: P15498
  ENSP ID: ENSP00000472929
MELWRQCTHWLIQCRVLPPSHRVTWDGAQVCELAQALRDGVLLCQLLNNLLPHAINLREVNLRPQMSQFLCLKNIRTFLSTCCEKFGLKRSELFEAFDLFDVQDFGKVIYTLSALSWTPIAQNRGIMPFPTEEESVGDEDIYSGLSDQIDDTVEEDEDLYDCVENEEAEGDEIYEDLMRSEPVSMPPKMTEYDKRCCCLREIQQTEEKYTDTLGSIQQHFLKPLQRFLKPQDIEIIFINIEDLLRVHTHFLKEMKEALGTPGAANLYQVFIKYKERFLVYGRYCSQVESASKHLDRVAAAREDVQMKLEECSQRANNGRFTLRDLLMVPMQRVLKYHLLLQELVKHTQEAMEKENLRLALDAMRDLAQCVNEVKRDNETLRQITNFQLSIENLDQSLAHYGRPKIDGELKITSVERRSKMDRYAFLLDKALLICKRRGDSYDLKDFVNLHSFQVRDDSSGDRDNKKWSHMFLLIEDQGAQGYELFFKTRELKKKWMEQFEMAISNIYPENATANGHDFQMFSFEETTSCKACQMLLRGTFYQGYRCHRCRASAHKECLGRVPPCGRHGQDFPGTMKKDKLHRRAQDKKRNELGLPKMEVFQEYYGLPPPPGAIGPFLRLNPGDIVELTKAEAEQNWWEGRNTSTNEIGWFPCNRVKPYVHGPPQDLSVHLWYAGPMERAGAESILANRSDGTFLVRQRVKDAAEFAISIKYNVEVKHIKIMTAEGLYRITEKKAFRGLTELVEFYQQNSLKDCFKSLDTTLQFPFKEPEKRTISRPAVGSTKYFGTAKARYDFCARDRSELSLKEGDIIKILNKKGQQGWWRGEIYGRVGWFPANYVEEDYSEYC

SEQ ID NO: 96518 - protein, 878 aa, Homo sapiens
  Payload ID: 19251
  Gene Name: vav 2 guanine nucleotide exchange factor
  Uniprot ID: P52735
  ENSP ID: ENSP00000360916
MEQWRQCGRWLIDCKVLPPNHRVVWPSAVVFDLAQALRDGVLLCQLLHNLSPGSIDLKDINFRPQMSQFLCLKNIRTFLKVCHDKFGLRNSELFDPFDLFDVRDFGKVISAVSRLSLHSIAQNKGIRPFPSEETTENDDDVYRSLEELADEHDLGEDIYDCVPCEDGGDDIYEDIIKVEVQQPMIRYMQKMGMTEDDKRNCCLLEIQETEAKYYRTLEDIEKNYMSPLRLVLSPADMAAVFINLEDLIKVHHSFLRAIDVSVMVGGSTLAKVFLDFKERLLIYGEYCSHMEHAQNTLNQLLASREDFRQKVEECTLKVQDGKFKLQDLLVVPMQRVLKYHLLLKELLSHSAERPERQQLKEALEAMQDLAMYINEVKRDKETLRKISEFQSSIENLQVKLEEFGRPKIDGELKVRSIVNHTKQDRYLFLFDKVVIVCKRKGYSYELKEIIELLFHKMTDDPMNNKDVKKSHGKMWSYGFYLIHLQGKQGFQFFCKTEDMKRKWMEQFEMAMSNIKPDKANANHHSFQMYTFDKTTNCKACKMFLRGTFYQGYMCTKCGVGAHKECLEVIPPCKFTSPADLDASGAGPGPKMVAMQNYHGNPAPPGKPVLTFQTGDVLELLRGDPESPWWEGRLVQTRKSGYFPSSSVKPCPVDGRPPISRPPSREIDYTAYPWFAGNMERQQTDNLLKSHASGTYLIRERPAEAERFAISIKFNDEVKHIKVVEKDNWIHITEAKKFDSLLELVEYYQCHSLKESFKQLDTTLKYPYKSRERSASRASSRSPASCASYNFSFLSPQGLSFASQGPSAPFWSVFTPRVIGTAVARYNFAARDMRELSLREGDVVRIYSRIGGDQGWWKGETNGRIGWFPSTYVEEEGIQ

SEQ ID NO: 96519 - protein, 868 aa, Homo sapiens
  Payload ID: 19251
  Gene Name: vav 2 guanine nucleotide exchange factor
  Uniprot ID: P52735
  ENSP ID: ENSP00000360917
MEQWRQCGRWLIDCKVLPPNHRVVWPSAVVFDLAQALRDGVLLCQLLHNLSPGSIDLKDINFRPQMSQFLCLKNIRTFLKVCHDKFGLRNSELFDPFDLFDVRDFGKVISAVSRLSLHSIAQNKGIRPFPSEETTENDDDVYRSLEELADEHDLGEDIYDCVPCEDGGDDIYEDIIKVEVQQPMKMGMTEDDKRNCCLLEIQETEAKYYRTLEDIEKNYMSPLRLVLSPADMAAVFINLEDLIKVHHSFLRAIDVSVMVGGSTLAKVFLDFKERLLIYGEYCSHMEHAQNTLNQLLASREDFRQKVEECTLKVQDGKFKLQDLLVVPMQRVLKYHLLLKELLSHSAERPERQQLKEALEAMQDLAMYINEVKRDKETLRKISEFQSSIENLQVKLEEFGRPKIDGELKVRSIVNHTKQDRYLFLFDKVVIVCKRKGYSYELKEIIELLFHKMTDDPMNNKDVKKWSYGFYLIHLQGKQGFQFFCKTEDMKRKWMEQFEMAMSNIKPDKANANHHSFQMYTFDKTTNCKACKMFLRGTFYQGYMCTKCGVGAHKECLEVIPPCKFTSPADLDASGAGPGPKMVAMQNYHGNPAPPGKPVLTFQTGDVLELLRGDPESPWWEGRLVQTRKSGYFPSSSVKPCPVDGRPPISRPPSREIDYTAYPWFAGNMERQQTDNLLKSHASGTYLIRERPAEAERFAISIKFNDEVKHIKVVEKDNWIHITEAKKFDSLLELVEYYQCHSLKESFKQLDTTLKYPYKSRERSASRASSRSPASCASYNFSFLSPQGLSFASQGPSAPFWSVFTPRVIGTAVARYNFAARDMRELSLREGDVVRIYSRIGGDQGWWKGETNGRIGWFPSTYVEEEGIQ

SEQ ID NO: 96520 - protein, 839 aa, Homo sapiens
  Payload ID: 19251
  Gene Name: vav 2 guanine nucleotide exchange factor
  Uniprot ID: P52735
  ENSP ID: ENSP00000385362
MEQWRQCGRWLIDCKVLPPNHRVVWPSAVVFDLAQALRDGVLLCQLLHNLSPGSIDLKDINFRPQMSQFLCLKNIRTFLKVCHDKFGLRNSELFDPFDLFDVRDFGKVISAVSRLSLHSIAQNKGIRPFPSEETTENDDDVYRSLEELADEHDLGEDIYDCVPCEDGGDDIYEDIIKVEVQQPMKMGMTEDDKRNCCLLEIQETEAKYYRTLEDIEKNYMSPLRLVLSPADMAAVFINLEDLIKVHHSFLRAIDVSVMVGGSTLAKVFLDFKERLLIYGEYCSHMEHAQNTLNQLLASREDFRQKVEECTLKVQDGKFKLQDLLVVPMQRVLKYHLLLKELLSHSAERPERQQLKEALEAMQDLAMYINEVKRDKETLRKISEFQSSIENLQVKLEEFGRPKIDGELKVRSIVNHTKQDRYLFLFDKVVIVCKRKGYSYELKEIIELLFHKMTDDPMNNKDVKKWSYGFYLIHLQGKQGFQFFCKTEDMKRKWMEQFEMAMSNIKPDKANANHHSFQMYTFDKTTNCKACKMFLRGTFYQGYMCTKCGVGAHKECLEVIPPCKFTSPADLDASGAGPGPKMVAMQNYHGNPAPPGKPVLTFQTGDVLELLRGDPESPWWEGRLVQTRKSGYFPSSSVKPCPVDGRPPISRPPSREIDYTAYPWFAGNMERQQTDNLLKSHASGTYLIRERPAEAERFAISIKFNDEVKHIKVVEKDNWIHITEAKKFDSLLELVEYYQCHSLKESFKQLDTTLKYPYKSRERSASRASSRSPVFTPRVIGTAVARYNFAARDMRELSLREGDVVRIYSRIGGDQGWWKGETNGRIGWFPSTYVEEEGIQ

SEQ ID NO: 96521 - protein, 847 aa, Homo sapiens
  Payload ID: 19252
  Gene Name: vav 3 guanine nucleotide exchange factor
  Uniprot ID: Q9UKW4
  ENSP ID: ENSP00000359073
MEPWKQCAQWLIHCKVLPTNHRVTWDSAQVFDLAQTLRDGVLLCQLLNNLRAHSINLKEINLRPQMSQFLCLKNIRTFLTACCETFGMRKSELFEAFDLFDVRDFGKVIETLSRLSRTPIALATGIRPFPTEESINDEDIYKGLPDLIDETLVEDEEDLYDCVYGEDEGGEVYEDLMKAEEAHQPKCPENDIRSCCLAEIKQTEEKYTETLESIEKYFMAPLKRFLTAAEFDSVFINIPELVKLHRNLMQEIHDSIVNKNDQNLYQVFINYKERLVIYGQYCSGVESAISSLDYISKTKEDVKLKLEECSKRANNGKFTLRDLLVVPMQRVLKYHLLLQELVKHTTDPTEKANLKLALDAMKDLAQYVNEVKRDNETLREIKQFQLSIENLNQPVLLFGRPQGDGEIRITTLDKHTKQERHIFLFDLAVIVCKRKGDNYEMKEIIDLQQYKIANNPTTDKENKKWSYGFYLIHTQGQNGLEFYCKTKDLKKKWLEQFEMALSNIRPDYADSNFHDFKMHTFTRVTSCKVCQMLLRGTFYQGYLCFKCGARAHKECLGRVDNCGRVNSGEQGTLKLPEKRTNGLRRTPKQVDPGLPKMQVIRNYSGTPPPALHEGPPLQLQAGDTVELLKGDAHSLFWQGRNLASGEVGFFPSDAVKPCPCVPKPVDYSCQPWYAGAMERLQAETELINRVNSTYLVRHRTKESGEYAISIKYNNEAKHIKILTRDGFFHIAENRKFKSLMELVEYYKHHSLKEGFRTLDTTLQFPYKEPEHSAGQRGNRAGNSLLSPKVLGIAIARYDFCARDMRELSLLKGDVVKIYTKMSANGWWRGEVNGRVGWFPSTYVEEDE

SEQ ID NO: 96522 - protein, 287 aa, Homo sapiens
  Payload ID: 19252
  Gene Name: vav 3 guanine nucleotide exchange factor
  Uniprot ID: Q9UKW4
  ENSP ID: ENSP00000394897
MPIFTFLSEQGTLKLPEKRTNGLRRTPKQVDPGLPKMQVIRNYSGTPPPALHEGPPLQLQAGDTVELLKGDAHSLFWQGRNLASGEVGFFPSDAVKPCPCVPKPVDYSCQPWYAGAMERLQAETELINRVNSTYLVRHRTKESGEYAISIKYNNEAKHIKILTRDGFFHIAENRKFKSLMELVEYYKHHSLKEGFRTLDTTLQFPYKEPEHSAGQRGNRAGNSLLSPKVLGIAIARYDFCARDMRELSLLKGDVVKIYTKMSANGWWRGEVNGRVGWFPSTYVEEDE

SEQ ID NO: 96523 - protein, 182 aa, Homo sapiens
  Payload ID: 19252
  Gene Name: vav 3 guanine nucleotide exchange factor
  ENSP ID: ENSP00000431544
  MOD_RES (1)..(1): Any amino acid
XYKIANNPTTDKENKKWSYGFYLIHTQGQNGLEFYCKTKDLKKKWLEQFEMALSNIRPDYADSNFHDFKMHTFTRVTSCKVCQMLLRGTFYQGYLCFKCGARAHKECLGRVDNCGRVNSGGLPKMQVIRNYSGTPPPALHEGPPLQLQAGDTVELLKGDAHSLFWQGRNLASGEVGFFPSDA

SEQ ID NO: 96524 - protein, 875 aa, Homo sapiens
  Payload ID: 19252
  Gene Name: vav 3 guanine nucleotide exchange factor
  Uniprot ID: Q9UKW4
  ENSP ID: ENSP00000432540
MEPWKQCAQWLIHCKVLPTNHRVTWDSAQVFDLAQTLRDGVLLCQLLNNLRAHSINLKEINLRPQMSQFLCLKNIRTFLTACCETFGMRKSELFEAFDLFDVRDFGKVIETLSRLSRTPIALATGIRPFPTEESINDEDIYKGLPDLIDETLVEDEEDLYDCVYGEDEGGEVYEDLMKAEEAHQPKCPENDIRSCCLAEIKQTEEKYTETLESIEKYFMAPLKRFLTAAEFDSVFINIPELVKLHRNLMQEIHDSIVNKNDQNLYQVFINYKERLVIYGQYCSGVESAISSLDYISKTKEDVKLKLEECSKRANNGKFTLRDLLVVPMQRVLKYHLLLQELVKHTTDPTEKANLKLALDAMKDLAQYVNEVKRDNETLREIKQFQLSIENLNQPVLLFGRPQGDGEIRITTLDKHTKQERHIFLFDLAVIVCKRKGDNYEMKEIIDLQQYKIANNPTTDKENKKWSYGFYLIHTQGQNGLEFYCKTKDLKKKWLEQFEMALSNIRPDYADSNFHDFKMHTFTRVTSCKVCQMLLRGTFYQGYLCFKCGARAHKECLGRVDNCGRVNSGEQGTLKLPEKRTNGLRRTPKQVDPGLPKMQVIRNYSGTPPPALHEGPPLQLQAGDTVELLKGDAHSLFWQGRNLASGEVGFFPSDAVKPCPCVPKPVDYSCQPWYAGAMERLQAETELINRVNSTYLVRHRTKESGEYAISIKYNNEAKHIKILTRDGFFHIAENRKFKSLMELVEYYKHHSLKEGFRTLDTTLQFPYKEPEHSAGQRGNRAGNSSPSLFCGFSFVTPPDYSFVPPSSTPFWSVLSPKVLGIAIARYDFCARDMRELSLLKGDVVKIYTKMSANGWWRGEVNGRVGWFPSTYVEEDE

SEQ ID NO: 96525 - protein, 52 aa, Homo sapiens
  Payload ID: 19252
  Gene Name: vav 3 guanine nucleotide exchange factor
  ENSP ID: ENSP00000432865
MPIFTFLSEQGTLKLPEVYQRCRSLGTILEHHPQLCMKDPLYSSRPGIPLNF

SEQ ID NO: 96526 - protein, 616 aa, Homo sapiens
  Payload ID: 19252
  Gene Name: vav 3 guanine nucleotide exchange factor
  ENSP ID: ENSP00000433559
  MOD_RES (1)..(1): Any amino acid
XCAQWLIHCKVLPTNHRVTWDSAQVFDLAQTLRDGVLLCQLLNNLRAHSINLKEINLRPQMSQFLCLKNIRTFLTACCETFGMRKSELFEAFDLFDVRDFGKVIETLSRLSRTPIALATGIRPFPTEESINDEDIYKGLPDLIDETLVEDEEDLYDCVYGEDEGGEVYEDLMKAEEAHQPKCPENDIRSCCLAEIKQTEEKYTETLESIEKYFMAPLKRFLTAAEFDSVFINIPELVKLHRNLMQEIHDSIVNKNDQNLYQVFINYKERLVIYGQYCSGVESAISSLDYISKTKEDVKLKLEECSKRANNGKFTLRDLLVVPMQRVLKYHLLLQELVKHTTDPTEKANLKLALDAMKDLAQYVNEVKRDNETLREIKQFQLSIENLNQPVLLFGRPQGDGEIRITTLDKHTKQERHIFLFDLAVIVCKRKGDNYEMKEIIDLQQYKIANNPTTDKENKKWSYGFYLIHTQGQNGLEFYCKTKDLKKKWLEQFEMALSNIRPDYADSNFHDFKMHTFTRVTSCKVCQMLLRGTFYQGYLCFKCGARAHKECLGRVDNCGRVNSGEQGTLKLPEKRTNGLRRTPKQVDPDVPCLLHFFISMAPATRSIVKSQKKNKKF

SEQ ID NO: 96527 - protein, 52 aa, Homo sapiens; identical to SEQ ID NO: 96525
  Payload ID: 19252
  Gene Name: vav 3 guanine nucleotide exchange factor
  ENSP ID: ENSP00000434944

SEQ ID NO: 96528 - protein, 189 aa, Homo sapiens
  Payload ID: 19253
  Gene Name: VCP-interacting membrane selenoprotein
  Uniprot ID: Q9BQE4
  ENSP ID: ENSP00000381282
  MOD_RES (188)..(188): Any amino acid
MERQEESLSARPALETEGLRFLHTTVGSLLATYGWYIVFSCILLYVVFQKLSARLRALRQRQLDRAAAAVEPDVVVKRQEALAAARLKMQEELNAQVEKHKEKLKQLEEEKRRQKIEMWDSMQEGKSYKGNAKKPQEEDSPGPSTSSVLKRKSDRKPLRGGGYNPLSGEGGGACSWRPGRRGPSSGGXG

SEQ ID NO: 96529 - protein, 189 aa, Homo sapiens; identical to SEQ ID NO: 96528
  Payload ID: 19253
  Gene Name: VCP-interacting membrane selenoprotein
  Uniprot ID: Q9BQE4
  ENSP ID: ENSP00000433541
  MOD_RES (188)..(188): Selenocysteine

SEQ ID NO: 96530 - protein, 166 aa, Homo sapiens
  Payload ID: 19253
  Gene Name: VCP-interacting membrane selenoprotein
  ENSP ID: ENSP00000433803
  MOD_RES (165)..(165): Selenocysteine
MMVGSLLATYGWYIVFSCILLYVVFQKLSARLRALRQRQLDRAAAAVEPDVVVKRQEALAAARLKMQEELNAQVEKHKEKLKQLEEEKRRQKIEMWDSMQEGKSYKGNAKKPQEEDSPGPSTSSVLKRKSDRKPLRGGGYNPLSGEGGGACSWRPGRRGPSSGGXG

SEQ ID NO: 96531 - protein, 218 aa, Homo sapiens
  Payload ID: 19253
  Gene Name: VCP-interacting membrane selenoprotein
  ENSP ID: ENSP00000434842
MMGGSSAAAPGAGAWEAWERSGVGAYADLGQQARTLRGGFSGAALPWAARLSLVCASLFCEPSPSLGSLLATYGWYIVFSCILLYVVFQKLSARLRALRQRQLDRAAAAVEPDVVVKRQEALAAARLKMQEELNAQVEKHKEKLKQLEEEKRRQKIEMWDSMQEGKSYKGNAKKPQEEDSPGPSTSSVLKRKSDRKPLRGGGYNPLSGEGGGACSWRP

SEQ ID NO: 96532 - protein, 304 aa, Homo sapiens
  Payload ID: 19254
  Gene Name: v-crk avian sarcoma virus CT10 oncogene homolog
  Uniprot ID: P46108
  ENSP ID: ENSP00000300574
MAGNFDSEERSSWYWGRLSRQEAVALLQGQRHGVFLVRDSSTSPGDYVLSVSENSRVSHYIINSSGPRPPVPPSPAQPPPGVSPSRLRIGDQEFDSLPALLEFYKIHYLDTTTLIEPVSRSRQGSGVILRQEEAEYVRALFDFNGNDEEDLPFKKGDILRIRDKPEEQWWNAEDSEGKRGMIPVPYVEKYRPASASVSALIGGNQEGSHPQPLGGPEPGPYAQPSVNTPLPNLQNGPIYARVIQKRVPNAYDKTALALEVGELVKVTKINVSGQWEGECNGKRGHFPFTHVRLLDQQNPDEDFS

SEQ ID NO: 96533 - protein, 204 aa, Homo sapiens
  Payload ID: 19254
  Gene Name: v-crk avian sarcoma virus CT10 oncogene homolog
  Uniprot ID: P46108
  ENSP ID: ENSP00000381942
MAGNFDSEERSSWYWGRLSRQEAVALLQGQRHGVFLVRDSSTSPGDYVLSVSENSRVSHYIINSSGPRPPVPPSPAQPPPGVSPSRLRIGDQEFDSLPALLEFYKIHYLDTTTLIEPVSRSRQGSGVILRQEEAEYVRALFDFNGNDEEDLPFKKGDILRIRDKPEEQWWNAEDSEGKRGMIPVPYVEKYRPASASVSALIGGR

SEQ ID NO: 96534 - protein, 223 aa, Homo sapiens
  Payload ID: 19254
  Gene Name: v-crk avian sarcoma virus CT10 oncogene homolog
  ENSP ID: ENSP00000459505
MAGNFDSEERSSWYWGRLSRQEAVALLQGQRHGVFLVRDSSTSPGDYVLSVSENSRVSHYIINSSGPRPPVPPSPAQPPPGVSPSRLRIGDQEFDSLPALLEFYKIHYLDTTTLIEPVSRSRQGSGVILRQEEECYTLLTLIYSVVLFSFWNHTIKWRQTVPFHPREVIMHRVNSIKQDCFHCMEHDQRVTHSDISDPKNSKNTTRSICSLLVNASYFFLGFF

SEQ ID NO: 96535 - protein, 303 aa, Homo sapiens
  Payload ID: 19255
  Gene Name: v-crk avian sarcoma virus CT10 oncogene homolog-like
  Uniprot ID: P46109
  ENSP ID: ENSP00000346300
MSSARFDSSDRSAWYMGPVSRQEAQTRLQGQRHGMFLVRDSSTCPGDYVLSVSENSRVSHYIINSLPNRRFKIGDQEFDHLPALLEFYKIHYLDTTTLIEPAPRYPSPPMGSVSAPNLPTAEDNLEYVRTLYDFPGNDAEDLPFKKGEILVIIEKPEEQWWSARNKDGRVGMIPVPYVEKLVRSSPHGKHGNRNSNSYGIPEPAHAYAQPQTTTPLPAVSGSPGAAITPLPSTQNGPVFAKAIQKRVPCAYDKTALALEVGDIVKVTRMNINGQWEGEVNGRKGLFPFTHVKIFDPQNPDENE

SEQ ID NO: 96536 - protein, 303 aa, Homo sapiens; identical to SEQ ID NO: 96535
  Payload ID: 19255
  Gene Name: v-crk avian sarcoma virus CT10 oncogene homolog-like
  Uniprot ID: P46109
  ENSP ID: ENSP00000396646

SEQ ID NO: 96537 - protein, 258 aa, Homo sapiens
  Payload ID: 19256
  Gene Name: VENT homeobox
  Uniprot ID: O95231
  ENSP ID: ENSP00000357556
MRLSSSPPRGPQQLSSFGSVDWLSQSSCSGPTHTPRPADFSLGSLPGPGQTSGAREPPQAVSIKEAAGSSNLPAPERTMAGLSKEPNTLRAPRVRTAFTMEQVRTLEGVFQHHQYLSPLERKRLAREMQLSEVQIKTWFQNRRMKHKRQMQDPQLHSPFSGSLHAPPAFYSTSSGLANGLQLLCPWAPLSGPQALMLPPGSFWGLCQVAQEALASAGASCCGQPLASHPPTPGRPSLGPALSTGPRGLCAMPQTGDAF

SEQ ID NO: 96538 - protein, 186 aa, Homo sapiens
  Payload ID: 19257
  Gene Name: ventral anterior homeobox 1
  Uniprot ID: Q5SQQ9
  ENSP ID: ENSP00000277905
MFGKPDKMDVRCHSDAEAARVSKNAHKESRESKGAEGNLPAAFLKEPQGAFSASGAAEDCNKSKSNSAADPDYCRRILVRDAKGSIREIILPKGLDLDRPKRTRTSFTAEQLYRLEMEFQRCQYVVGRERTELARQLNLSETQANSEENNERFKRGIKKQKKKRKKEPANDESRRGDSGGRGWQPL

SEQ ID NO: 96539 - protein, 334 aa, Homo sapiens
  Payload ID: 19257
  Gene Name: ventral anterior homeobox 1
  Uniprot ID: Q5SQQ9
  ENSP ID: ENSP00000358207
MFGKPDKMDVRCHSDAEAARVSKNAHKESRESKGAEGNLPAAFLKEPQGAFSASGAAEDCNKSKSNSAADPDYCRRILVRDAKGSIREIILPKGLDLDRPKRTRTSFTAEQLYRLEMEFQRCQYVVGRERTELARQLNLSETQVKVWFQNRRTKQKKDQGKDSELRSVVSETAATCSVLRLLEQGRLLSPPGLPALLPPCATGALGSALRGPSLPALGAGAAAGSAAAAAAAAPGPAGAASPHPPAVGGAPGPGPAGPGGLHAGAPAAGHSLFSLPVPSLLGSVASRLSSAPLTMAGSLAGNLQELSARYLSSSAFEPYSRTNNKEGAEKKALD

SEQ ID NO: 96540 - protein, 290 aa, Homo sapiens
  Payload ID: 19258
  Gene Name: ventral anterior homeobox 2
  Uniprot ID: Q9UIW0
  ENSP ID: ENSP00000234392
MGDGGAERDRGPARRAESGGGGGRCGDRSGAGDLRADGGGHSPTEVAGTSASSPAGSRESGADSDGQPGPGEADHCRRILVRDAKGTIREIVLPKGLDLDRPKRTRTSFTAEQLYRLEMEFQRCQYVVGRERTELARQLNLSETQVKVWFQNRRTKQKKDQSRDLEKRASSSASEAFATSNILRLLEQGRLLSVPRAPSLLALTPSLPGLPASHRGTSLGDPRNSSPRLNPLSSASASPPLPPPLPAVCFSSAPLLDLPAGYELGSSAFEPYSWLERKVGSASSCKKANT

SEQ ID NO: 96541 - protein, 833 aa, Homo sapiens
  Payload ID: 19259
  Gene Name: ventricular zone expressed PH domain-containing 1
  Uniprot ID: Q14D04
  ENSP ID: ENSP00000354919
MHQLFRLVLGQKDLSRAGDLFSLDDSEIEDSLTEALEQIKIISSSSDYQTNNNDQAVVEICITRITTAIRETESIEKHAKALVGLWDSCLEHNLRPFGKDEDTPHAKIASDIMSCILQNYNRPPVMALAIPIAVKFLHRGNKELCRNMSNYLSLAAITKADLLADHTEVIVKSILQGNTMLLRVLPAVYEKQPQPINRHLTELLALMSQLEQPEQYHLLRLLHVAAKKKQLEVVQKCIPFLIGHLKDSTHNDIILNILIEIAVYEPVALNSFLPMLKEIGERFPYLTGQMARIYGAVGHVDEERARSCLTYLVSQLANMEHSFHHILLLEIKSITDTFSSILGPQSRDIFRMSNSFTAIAKLLTRQLENTKAGSGRRKISTEIEFPEKLEETKLIVTENEDHEKLQVKIQAFEDKINAGSNTPGSIRRYSLGQVSKEERKNIRFNRSKSLAFHTMLTKGVGSDDGEDENRGDIPASISLSEIDPLGQGNDKLPFKTDTERSQLGESSVSYPNIIHIDSENLSETVKENSQEETPETTASPIEYQDKLYLHLKKNLSKVKAYAMEIGKKIPVPDQCTIEDTVRSCVAKLFFTCSLKGHYCLYSKSSFILISQEPQPWIQIMFLFQQSLFPEPLSIQSHSVQFLRALWEKTQAGGAHSFETAMMESTFPQQKDLDQVQLHLEEVRFFDVFGFSETAGAWQCFMCNNPEKATVVNQDGQPLIEGKLKEKQVRWKFIKRWKTRYFTLAGNQLLFQKGKSKDDPDDCPIELSKVQSVKAVAKKRRDRSLPRAFEIFTDNKTYVFKAKDEKNAEEWLQCINVAVAQAKERESREVTTYL

SEQ ID NO: 96542 - protein, 833 aa, Homo sapiens; identical to SEQ ID NO: 96541
  Payload ID: 19259
  Gene Name: ventricular zone expressed PH domain-containing 1
  Uniprot ID: Q14D04
  ENSP ID: ENSP00000376577

SEQ ID NO: 96543 - protein, 788 aa, Homo sapiens
  Payload ID: 19259
  Gene Name: ventricular zone expressed PH domain-containing 1
  Uniprot ID: Q14D04
  ENSP ID: ENSP00000376578
MHQLFRLVLGQKDLSRAGDLFSLDDSEIEDSLTEALEQIKIISSSSDYQTNNNDQAVVEICITRITTAIRETESIEKHAKALVGLWDSCLEHNLRPFGKDEDTPHAKIASDIMSCILQNYNRPPVMALAIPIAVKFLHRGNKELCRNMSNYLSLAAITKADLLADHTEVIVKSILQGNTMLLRVLPAVYEKQPQPINRHLTELLALMSQLEQPEQYHLLRLLHVAAKKKQLEVVQKCIPFLIGHLKDSTHNDIILNILIEIAVYEPVALNSFLPMLKEIGERFPYLTGQMARIYGAVGHVDEERARSCLTYLVSQLANMEHSFHHILLLEIKSITDTFSSILGPQSRDIFRMSNSFTAIAKLLTRQLENTKAGSGRRKISTEIEFPEKLEETKLIVTENEDHEKLQVKIQAFEDKINAGSNTPGSIRRYSLGQVSKEERKNIRFNRSKSLAFHTMLTKGVGSDDGEDENRGDIPASISLSEIDPLGQGNDKLPFKTDTERSQLGESSVSYPNIIHIDSENLSETVKENSQEETPETTASPIEYQDKLYLHLKKNLSKVKAYAMEIGKKIPVPDQCTIEDTVRSCVAKLFFTCSLKGHYCLYSKSSFILISQEPQPWIQIMFLFQQDLDQVQLHLEEVRFFDVFGFSETAGAWQCFMCNNPEKATVVNQDGQPLIEGKLKEKQVRWKFIKRWKTRYFTLAGNQLLFQKGKSKDDPDDCPIELSKVQSVKAVAKKRRDRSLPRAFEIFTDNKTYVFKAKDEKNAEEWLQCINVAVAQAKERESREVTTYL

SEQ ID NO: 96544 - protein, 62 aa, Homo sapiens
  Payload ID: 19259
  Gene Name: ventricular zone expressed PH domain-containing 1
  ENSP ID: ENSP00000417157
MHQLFRLVLGQKDLSRAGDLFSLDDSEIEDSLTEALEQIKIISSSSDYQTNNNDQAVVEICI

SEQ ID NO: 96545 - protein, 213 aa, Homo sapiens
  Payload ID: 19259
  Gene Name: ventricular zone expressed PH domain-containing 1
  Uniprot ID: Q14D04
  ENSP ID: ENSP00000417268
MHQLFRLVLGQKDLSRAGDLFSLDDSEIEDSLTEALEQIKIISSSSDYQTNNNDQAVVEICITRITTAIRETESIEKHAKALVGLWDSCLEHNLRPFGKDEDTPHAKIASDIMSCILQNYNRPPVMALAIPIAVKFLHRGNKELCRNMSNYLSLAAITKADLLADHTEVIVKSILQGMVRKLSLGTCFGRYLKVFSSSIYGLWEARPRVLEAN

SEQ ID NO: 96546 - protein, 55 aa, Homo sapiens
  Payload ID: 19259
  Gene Name: ventricular zone expressed PH domain-containing 1
  ENSP ID: ENSP00000417298
MHQLFRLVLGQKDLSRAGDLFSLDDSEIEDSLTEALEQIKIISSSSDYQTNNNDQ

SEQ ID NO: 96547 - protein, 52 aa, Homo sapiens
  Payload ID: 19259
  Gene Name: ventricular zone expressed PH domain-containing 1
  ENSP ID: ENSP00000417700
MHQLFRLVLGQKDLSRAGDLFSLDDSEIEDSLTEALEQIKIISSSSSVERQE

SEQ ID NO: 96548 - protein, 69 aa, Homo sapiens
  Payload ID: 19259
  Gene Name: ventricular zone expressed PH domain-containing 1
  ENSP ID: ENSP00000418175
MHQLFRLVLGQKDLSRAGDLFSLDDSEIEDSLTEALEQIKIISSSSKRRTGRDRLNCPFQLPAQKIAEK

SEQ ID NO: 96549 - protein, 120 aa, Homo sapiens
  Payload ID: 19259
  Gene Name: ventricular zone expressed PH domain-containing 1
  ENSP ID: ENSP00000418963
MSCILQNYNRPPVMALAIPIAVKFLHRGNKELCRNMSNYLSLAAITKADLLADHTEVIVKSILQGNTMLLRVLPAVYEKQPQPINRHLTELLALMSQLEQPEQYHLLRLLHVAAKKKQLE

SEQ ID NO: 96550 - protein, 213 aa, Homo sapiens; identical to SEQ ID NO: 96545
  Payload ID: 19259
  Gene Name: ventricular zone expressed PH domain-containing 1
  Uniprot ID: Q14D04
  ENSP ID: ENSP00000419193

SEQ ID NO: 96551 - protein, 165 aa, Homo sapiens
  Payload ID: 19259
  Gene Name: ventricular zone expressed PH domain-containing 1
  ENSP ID: ENSP00000420097
MHQLFRLVLGQKDLSRAGDLFSLDDSEIEDSLTEALEQIKIISSSSDYQTNNNDQAVVEICITRITTAIRETESIEKHAKALVGLWDSCLEHNLRPFGKDEDTPHAKIASDIMSCILQNYNRPPVMALAIPIAVKFLHRGNKELCRNMSNYLSLAAITKADLLAD

SEQ ID NO: 96552 - protein, 177 aa, Homo sapiens
  Payload ID: 19259
  Gene Name: ventricular zone expressed PH domain-containing 1
  Uniprot ID: Q14D04
  ENSP ID: ENSP00000443868
MHQLFRLVLGQKDLSRAGDLFSLDDSEIEDSLTEALEQIKIISSSSDYQTNNNDQAVVEICITRITTAIRETESIEKHAKALVGLWDSCLEHNLRPFGKDEDTPHAKIASDIMSCILQNYNRPPVMALAIPIAVKFLHRGNKELCRNMSNYLSLAAITKADLLADHTEVIVKSILQV

SEQ ID NO: 96553 - protein, 3396 aa, Homo sapiens
  Payload ID: 19260
  Gene Name: versican
  Uniprot ID: P13611
  ENSP ID: ENSP00000265077
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 96554 - protein, 2409 aa, Homo sapiens
  Payload ID: 19260
  Gene Name: versican
  Uniprot ID: P13611
  ENSP ID: ENSP00000340062
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 96555 - protein, 1642 aa, Homo sapiens
  Payload ID: 19260
  Gene Name: versican
  Uniprot ID: P13611
  ENSP ID: ENSP00000342768
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 96556 - protein, 655 aa, Homo sapiens
  Payload ID: 19260
  Gene Name: versican
  Uniprot ID: P13611
  ENSP ID: ENSP00000421362
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 96557 - protein, 1594 aa, Homo sapiens
  Payload ID: 19260
  Gene Name: versican
  ENSP ID: ENSP00000425959
MPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 96558 - protein, 1240 aa, Homo sapiens
  Payload ID: 19260
  Gene Name: versican
  ENSP ID: ENSP00000426251
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPI

SEQ ID NO: 96559 - protein, 354 aa, Homo sapiens
  Payload ID: 19260
  Gene Name: versican
  ENSP ID: ENSP00000426715
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRKCLIPF

SEQ ID NO: 96560 - protein, 702 aa, Homo sapiens
  Payload ID: 19261
  Gene Name: vertebrae development associated
  Uniprot ID: Q9H8Y1
  ENSP ID: ENSP00000256362
MTSRNQLVQKVLQELQEAVECEGLEGLIGASLEAKQVLSSFTLPTCREGGPGLQVLEVDSVALSLYPEDAPRNMLPLVCKGEGSLLFEAASMLLWGDAGLSLELRARTVVEMLLHRHYYLQGMIDSKVMLQAVRYSLCSEESPEMTSLPPATLEAIFDADVKASCFPSSFSNVWHLYALASVLQRNIYSIYPMRNLKIRPYFNRVIRPRRCDHVPSTLHIMWAGQPLTSHFFRHQYFAPVVGLEEVEAEGAPGVAPALPALAPLSSPAKTLELLNREPGLSYSHLCERYSVTKSTFYRWRRQSQEHRQKVAARFSAKHFLQDSFHRGGVVPLQQFLQRFPEISRSTYYAWKHELLGSGTCPALPPREVLGMEELEKLPEEQVAEEELECSALAVSSPGMVLMQRAKLYLEHCISLNTLVPYRCFKRRFPGISRSTYYNWRRKALRRNPSFKPAPALSAAGTPQLASVGEGAVIPWKSEAEEGAGNATGEDPPAPGELLPLRMPLSRWQRRLRRAARRQVLSGHLPFCRFRLRYPSLSPSAFWVWKSLARGWPRGLSKLQVPVPTLGKGGQEAEEKQEKEAGRDVTAVMAPPVGASSEDVEGGPSREGALQEGATAQGQPHSGPLLSQPVVAAAGGRDGRMLVMDMIATTKFKAQAKLFLQKRFQSKSFPSYKEFSALFPLTARSTYYMWKRALYDGLTLVDG

SEQ ID NO: 96561 - protein, 83 aa, Homo sapiens
  Payload ID: 19261
  Gene Name: vertebrae development associated
  ENSP ID: ENSP00000452158
MTSRNQLVQKVLQELQEAVECEGLEGLIGASLEAKQVLSSFTLPTCREGGPGLQVLEVDSVALSLYPEDAPRNMLPLVCKGEG

SEQ ID NO: 96562 - protein, 173 aa, Homo sapiens
  Payload ID: 19262
  Gene Name: very low density lipoprotein receptor
  ENSP ID: ENSP00000371528
MGTSALWALWLLLALCWAPRESGATGTGRKAKCEPSQFQCTNGRCITLLWKCDGDEDCVDGSDEKNCVKKTCAESDFVCNNGQCVPSRWKCDGDPDCEDGSDESPEQCRNITCSPDEFTCSSGRCISRNFVCNGQDDCSDGSDELDCAPPTCGAHEFQCSTSSCIPISWVCDD

SEQ ID NO: 96563 - protein, 845 aa, Homo sapiens
  Payload ID: 19262
  Gene Name: very low density lipoprotein receptor
  Uniprot ID: P98155
  ENSP ID: ENSP00000371531
MGTSALWALWLLLALCWAPRESGATGTGRKAKCEPSQFQCTNGRCITLLWKCDGDEDCVDGSDEKNCVKKTCAESDFVCNNGQCVPSRWKCDGDPDCEDGSDESPEQCHMRTCRIHEISCGAHSTQCIPVSWRCDGENDCDSGEDEENCGNITCSPDEFTCSSGRCISRNFVCNGQDDCSDGSDELDCAPPTCGAHEFQCSTSSCIPISWVCDDDADCSDQSDESLEQCGRQPVIHTKCPASEIQCGSGECIHKKWRCDGDPDCKDGSDEVNCPSRTCRPDQFECEDGSCIHGSRQCNGIRDCVDGSDEVNCKNVNQCLGPGKFKCRSGECIDISKVCNQEQDCRDWSDEPLKECHINECLVNNGGCSHICKDLVIGYECDCAAGFELIDRKTCGDIDECQNPGICSQICINLKGGYKCECSRGYQMDLATGVCKAVGKEPSLIFTNRRDIRKIGLERKEYIQLVEQLRNTVALDADIAAQKLFWADLSQKAIFSASIDDKVGRHVKMIDNVYNPAAIAVDWVYKTIYWTDAASKTISVATLDGTKRKFLFNSDLREPASIAVDPLSGFVYWSDWGEPAKIEKAGMNGFDRRPLVTADIQWPNGITLDLIKSRLYWLDSKLHMLSSVDLNGQDRRIVLKSLEFLAHPLALTIFEDRVYWIDGENEAVYGANKFTGSELATLVNNLNDAQDIIVYHELVQPSGKNWCEEDMENGGCEYLCLPAPQINDHSPKYTCSCPSGYNVEENGRDCQRINVTTAVSEVSVPPKGTSAAWAILPLLLLVMAAVGGYLMWRNWQHKNMKSMNFDNPVYLKTTEEDLSIDIGRHSASVGHTYPAISVVSTDDDLA

SEQ ID NO: 96564 - protein, 873 aa, Homo sapiens
  Payload ID: 19262
  Gene Name: very low density lipoprotein receptor
  Uniprot ID: P98155
  ENSP ID: ENSP00000371532
MGTSALWALWLLLALCWAPRESGATGTGRKAKCEPSQFQCTNGRCITLLWKCDGDEDCVDGSDEKNCVKKTCAESDFVCNNGQCVPSRWKCDGDPDCEDGSDESPEQCHMRTCRIHEISCGAHSTQCIPVSWRCDGENDCDSGEDEENCGNITCSPDEFTCSSGRCISRNFVCNGQDDCSDGSDELDCAPPTCGAHEFQCSTSSCIPISWVCDDDADCSDQSDESLEQCGRQPVIHTKCPASEIQCGSGECIHKKWRCDGDPDCKDGSDEVNCPSRTCRPDQFECEDGSCIHGSRQCNGIRDCVDGSDEVNCKNVNQCLGPGKFKCRSGECIDISKVCNQEQDCRDWSDEPLKECHINECLVNNGGCSHICKDLVIGYECDCAAGFELIDRKTCGDIDECQNPGICSQICINLKGGYKCECSRGYQMDLATGVCKAVGKEPSLIFTNRRDIRKIGLERKEYIQLVEQLRNTVALDADIAAQKLFWADLSQKAIFSASIDDKVGRHVKMIDNVYNPAAIAVDWVYKTIYWTDAASKTISVATLDGTKRKFLFNSDLREPASIAVDPLSGFVYWSDWGEPAKIEKAGMNGFDRRPLVTADIQWPNGITLDLIKSRLYWLDSKLHMLSSVDLNGQDRRIVLKSLEFLAHPLALTIFEDRVYWIDGENEAVYGANKFTGSELATLVNNLNDAQDIIVYHELVQPSGKNWCEEDMENGGCEYLCLPAPQINDHSPKYTCSCPSGYNVEENGRDCQSTATTVTYSETKDTNTTEISATSGLVPGGINVTTAVSEVSVPPKGTSAAWAILPLLLLVMAAVGGYLMWRNWQHKNMKSMNFDNPVYLKTTEEDLSIDIGRHSASVGHTYPAISVVSTDDDLA

SEQ ID NO: 96565 - protein, 249 aa, Homo sapiens
  Payload ID: 19263
  Gene Name: vesicle (multivesicular body) trafficking 1
  ENSP ID: ENSP00000356593
MTSETLWWLITLKKQLGDNEAITQEIVGCAHLENYALKMFLYADNEDRAGRFHKNMIKSFYTASLLIDVITVFGELTDENVKHRKYARWKATYIHNCLKNGETPQAGPVGIEEDNDIEENEDAGAASLPTQPTQPSSSSTYDPSNMPSGNYTGIQIPPGAHAPANTPAEVPHSTGVASNTIQPTPQTIPAIDPALFNTISQGDVRLTPEDFARAQKYCKYAGSALQYEDVSTAVQNLQKALKLLTTGRE

SEQ ID NO: 96566 - protein, 307 aa, Homo sapiens
  Payload ID: 19263
  Gene Name: vesicle (multivesicular body) trafficking 1
  Uniprot ID: Q9NP79
  ENSP ID: ENSP00000356602
MAALAPLPPLPAQFKSIQHHLRTAQEHDKRDPVVAYYCRLYAMQTGMKIDSKTPECRKFLSKLMDQLEALKKQLGDNEAITQEIVGCAHLENYALKMFLYADNEDRAGRFHKNMIKSFYTASLLIDVITVFGELTDENVKHRKYARWKATYIHNCLKNGETPQAGPVGIEEDNDIEENEDAGAASLPTQPTQPSSSSTYDPSNMPSGNYTGIQIPPGAHAPANTPAEVPHSTGVASNTIQPTPQTIPAIDPALFNTISQGDVRLTPEDFARAQKYCKYAGSALQYEDVSTAVQNLQKALKLLTTGRE

SEQ ID NO: 96567 - protein, 222 aa, Homo sapiens
  Payload ID: 19263
  Gene Name: vesicle (multivesicular body) trafficking 1
  Uniprot ID: Q9NP79
  ENSP ID: ENSP00000395767
MTSETLWWLITLKKQLGDNEAITQEIVGCAHLENYALKMFLYADNEDRAGRFHKNMIKSFYTASLLIDVITVFGELTDENVKHRKYARWKATYIHNCLKNGETPQAGPVGIEEDNDIEENEDAGAASLPTQPTQPSSSSTYDPSNMPSGNYTGIQIPPGAHAPANTPAEVPHSTGDVRLTPEDFARAQKYCKYAGSALQYEDVSTAVQNLQKALKLLTTGRE

SEQ ID NO: 96568 - protein, 280 aa, Homo sapiens
  Payload ID: 19263
  Gene Name: vesicle (multivesicular body) trafficking 1
  ENSP ID: ENSP00000481525
MAALAPLPPLPAQFKSIQHHLRTAQEHDKRDPVVAYYCRLYAMQTGMKIDSKTPECRKFLSKLMDQLEALKKQLGDNEAITQEIVGCAHLENYALKMFLYADNEDRAGRFHKNMIKSFYTASLLIDVITVFGELTDENVKHRKYARWKATYIHNCLKNGETPQAGPVGIEEDNDIEENEDAGAASLPTQPTQPSSSSTYDPSNMPSGNYTGIQIPPGAHAPANTPAEVPHSTGDVRLTPEDFARAQKYCKYAGSALQYEDVSTAVQNLQKALKLLTTGRE

SEQ ID NO: 96569 - protein, 393 aa, Homo sapiens
  Payload ID: 19264
  Gene Name: vesicle amine transport 1
  Uniprot ID: Q99536
  ENSP ID: ENSP00000347872
MSDEREVAEAATGEDASSPPPKTEAASDPQHPAASEGAAAAAASPPLLRCLVLTGFGGYDKVKLQSRPAAPPAPGPGQLTLRLRACGLNFADLMARQGLYDRLPPLPVTPGMEGAGVVIAVGEGVSDRKAGDRVMVLNRSGMWQEEVTVPSVQTFLIPEAMTFEEAAALLVNYITAYMVLFDFGNLQPGHSVLVHMAAGGVGMAAVQLCRTVENVTVFGTASASKHEALKENGVTHPIDYHTTDYVDEIKKISPKGVDIVMDPLGGSDTAKGYNLLKPMGKVVTYGMANLLTGPKRNLMALARTWWNQFSVTALQLLQANRAVCGFHLGYLDGEVELVSGVVARLLALYNQGHIKPHIDSVWPFEKVADAMKQMQEKKNVGKVLLVPGPEKEN

SEQ ID NO: 96570 - protein, 259 aa, Homo sapiens
  Payload ID: 19264
  Gene Name: vesicle amine transport 1
  Uniprot ID: Q99536
  ENSP ID: ENSP00000408553
MVLNRSGMWQEEVTVPSVQTFLIPEAMTFEEAAALLVNYITAYMVLFDFGNLQPGHSVLVHMAAGGVGMAAVQLCRTVENVTVFGTASASKHEALKENGVTHPIDYHTTDYVDEIKKISPKGVDIVMDPLGGSDTAKGYNLLKPMGKVVTYGMANLLTGPKRNLMALARTWWNQFSVTALQLLQANRAVCGFHLGYLDGEVELVSGVVARLLALYNQGHIKPHIDSVWPFEKVADAMKQMQEKKNVGKVLLVPGPEKEN

SEQ ID NO: 96571 - protein, 30 aa, Homo sapiens
  Payload ID: 19264
  Gene Name: vesicle amine transport 1
  ENSP ID: ENSP00000465239
  MOD_RES (1)..(1): Any amino acid
XEKVADAMKQMQEKKNVGKVLLVPGPEKEN

SEQ ID NO: 96572 - protein, 325 aa, Homo sapiens
  Payload ID: 19264
  Gene Name: vesicle amine transport 1
  Uniprot ID: Q99536
  ENSP ID: ENSP00000465946
MSDEREVAEAATGEDASSPPPKTEAASDPQHPAASEGAAAAAASPPLLRCLVLTGFGGYDKAGDRVMVLNRSGMWQEEVTVPSVQTFLIPEAMTFEEAAALLVNYITAYMVLFDFGNLQPGHSVLVHMAAGGVGMAAVQLCRTVENVTVFGTASASKHEALKENGVTHPIDYHTTDYVDEIKKISPKGVDIVMDPLGGSDTAKGYNLLKPMGKVVTYGMANLLTGPKRNLMALARTWWNQFSVTALQLLQANRAVCGFHLGYLDGEVELVSGVVARLLALYNQGHIKPHIDSVWPFEKVADAMKQMQEKKNVGKVLLVPGPEKEN

SEQ ID NO: 96573 - protein, 154 aa, Homo sapiens
  Payload ID: 19264
  Gene Name: vesicle amine transport 1
  ENSP ID: ENSP00000466322
MVLNRSGMWQEEVTVPSVQTFLIPEAMTFEEAAALLVNYITAYMVLFDFGNLQPGHSVLVHMAAGGVGMAAVQLCRTVENVTVFGTASASKHEALKENGVTHPIDYHTTDYVDEIKKISPKGVDIVMDPLGGSDTAKGYNLLKPMGKVVTYGEL

SEQ ID NO: 96574 - protein, 151 aa, Homo sapiens
  Payload ID: 19264
  Gene Name: vesicle amine transport 1
  ENSP ID: ENSP00000467131
MVLNRSGMWQEEVTVPSVQTFLIPEAMTFEEAAALLVNYITAYMVLFDFGNLQPGHSVLVHMAAGGVGMAAVQLCRTVENVTVFGTASASKHEALKENGVTHPIDYHTTDYVDEIKKISPKGVDIVMDPLGGSDTAKGYNLLKPMGKVVTY

SEQ ID NO: 96575 - protein, 92 aa, Homo sapiens
  Payload ID: 19264
  Gene Name: vesicle amine transport 1
  ENSP ID: ENSP00000468146
MVLNRSGMWQEEVTVPSVQTFLIPEAMTFEEAAALLVNYITAYMVLFDFGNLQPGHSVLVHMAAGGVGMAAVQLCRTVENVTVFGTASASKH

SEQ ID NO: 96576 - protein, 146 aa, Homo sapiens
  Payload ID: 19264
  Gene Name: vesicle amine transport 1
  ENSP ID: ENSP00000468401
MSDEREVAEAATGEDASSPPPKTEAASDPQHPAASEGAAAAAASPPLLRCLVLTGFGGYDKVKLQSRPAAPPAPGPGQLTLRLRACGLNFADLMARQGLYDRLPPLPVTPGMEGAGVVIAVGEGVSDRKAGDRVMVLNRSGMWQEE

SEQ ID NO: 96577 - protein, 125 aa, Homo sapiens
  Payload ID: 19264
  Gene Name: vesicle amine transport 1
  ENSP ID: ENSP00000468621
SPKGVDIVMDPLGGSDTAKGYNLLKPMGKVVTYGMANLLTGPKRNLMALARTWWNQFSVTALQLLQANRAVCGFHLGYLDGEVELVSGVVARLLALYNQGHIKPHIDSVWPFEKVNVRTLQGGLG

SEQ ID NO: 96578 - protein, 419 aa, Homo sapiens
  Payload ID: 19265
  Gene Name: vesicle amine transport 1-like
  Uniprot ID: Q9HCJ6
  ENSP ID: ENSP00000303129
MAKEGVEKAEETEQMIEKEAGKEPAEGGGGDGSHRLGDAQEMRAVVLAGFGGLNKLRLFRKAMPEPQDGELKIRVKACGLNFIDLMVRQGNIDNPPKTPLVPGFECSGIVEALGDSVKGYEIGDRVMAFVNYNAWAEVVCTPVEFVYKIPDDMSFSEAAAFPMNFVTAYVMLFEVANLREGMSVLVHSAGGGVGQAVAQLCSTVPNVTVFGTASTFKHEAIKDSVTHLFDRNADYVQEVKRISAEGVDIVLDCLCGDNTGKGLSLLKPLGTYILYGSSNMVTGETKSFFSFAKSWWQVEKVNPIKLYEENKVIAGFSLLNLLFKQGRAGLIRGVVEKLIGLYNQKKIKPVVDSLWALEEVKEAMQRIHDRGNIGKLILDVEKTPTPLMANDSTETSEAGEEEEDHEGDSENKERMPFIQ

SEQ ID NO: 96579 - protein, 217 aa, Homo sapiens
  Payload ID: 19266
  Gene Name: vesicle transport through interaction with t-SNAREs 1A
  Uniprot ID: Q96AJ9
  ENSP ID: ENSP00000376792
MSSDFEGYEQDFAVLTAEITSKIARVPRLPPDEKKQMVANVEKQLEEAKELLEQMDLEVREIPPQSRGMYSNRMRSYKQEMGKLETDFKRSRIAYSDEVRNELLGDDGNSSENQRAHLLDNTERLERSSRRLEAGYQIAVETEQIGQEMLENLSHDREKIQRARERLRETDANLGKSSRILTGMLRRIIQNRILLVILGIIVVITILMAITFSVRRH

SEQ ID NO: 96580 - protein, 203 aa, Homo sapiens
  Payload ID: 19266
  Gene Name: vesicle transport through interaction with t-SNAREs 1A
  Uniprot ID: Q96AJ9
  ENSP ID: ENSP00000395017
MSSDFEGYEQDFAVLTAEITSKIARVPRLPPDEKKQMVANVEKQLEEAKELLEQMDLEVREIPPQSRGMYSNRMRSYKQEMGKLETDFKRSRIAYSDEVRNELLGDDGNSSENQRAHLLDNTERLERSSRRLEAGYQIAVETEQIGQEMLENLSHDREKIQRARERLRETDANLGKSSRILTGMLRRGCSVKKQCNLSLAPKA

SEQ ID NO: 96581 - protein, 44 aa, Homo sapiens
  Payload ID: 19267
  Gene Name: vesicle transport through interaction with t-SNAREs 1B
  ENSP ID: ENSP00000216456
MASSAASSEHFEKLHEIFRGLHEDLQGVPERLLGTAGTGEISNF

SEQ ID NO: 96582 - protein, 232 aa, Homo sapiens
  Payload ID: 19267
  Gene Name: vesicle transport through interaction with t-SNAREs 1B
  Uniprot ID: Q9UEU0
  ENSP ID: ENSP00000450731
MASSAASSEHFEKLHEIFRGLHEDLQGVPERLLGTAGTEEKKKLIRDFDEKQQEANETLAEMEEELRYAPLSFRNPMMSKLRNYRKDLAKLHREVRSTPLTATPGGRGDMKYGIYAVENEHMNRLQSQRAMLLQGTESLNRATQSIERSHRIATETDQIGSEIIEELGEQRDQLERTKSRLVNTSENLSKSRKILRSMSRKVTTNKLLLSIIILLELAILGGLVYYKFFRSH

SEQ ID NO: 96583 - protein, 128 aa, Homo sapiens
  Payload ID: 19267
  Gene Name: vesicle transport through interaction with t-SNAREs 1B
  ENSP ID: ENSP00000451661
  MOD_RES (1)..(1): Any amino acid
XTPGGRGDMKYGIYAVENEHMNRLQSQRAMLLQGTESLNRATQSIERSHRIATETDQIGSEIIEELGEQRDQLERTKSRSDNQQAAAFHYHLTGARHPGRPGLLQILSQPLNFYREGFVDQNFDLVNA

SEQ ID NO: 96584 - protein, 103 aa, Homo sapiens
  Payload ID: 19267
  Gene Name: vesicle transport through interaction with t-SNAREs 1B
  ENSP ID: ENSP00000451759
  MOD_RES (1)..(1): Any amino acid
XRKDLAKLHREVRSTPLTATPGGRGDMKYGIYAVENEHMNRLQSQRAMLLQGTESLNRATQSIERSHRIATETDQIGSEIIEELGEQRDQLERTKSRVTGKHK

SEQ ID NO: 96585 - protein, 59 aa, Homo sapiens
  Payload ID: 19267
  Gene Name: vesicle transport through interaction with t-SNAREs 1B
  ENSP ID: ENSP00000452366
MASSAASSEHFEKLHEIFRGLHEDLQGVPERLLGTAGTAGRDGGGATLCTPVFPKPHDV

SEQ ID NO: 96586 - protein, 117 aa, Homo sapiens
  Payload ID: 19268
  Gene Name: vesicle-associated membrane protein 1 (synaptobrevin 1)
  Uniprot ID: P23763
  ENSP ID: ENSP00000355122
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGAICAIIVVVIVSKYR

SEQ ID NO: 96587 - protein, 118 aa, Homo sapiens
  Payload ID: 19268
  Gene Name: vesicle-associated membrane protein 1 (synaptobrevin 1)
  Uniprot ID: P23763
  ENSP ID: ENSP00000379602
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGAICAIIVVVIVIYFFT

SEQ ID NO: 96588 - protein, 116 aa, Homo sapiens
  Payload ID: 19268
  Gene Name: vesicle-associated membrane protein 1 (synaptobrevin 1)
  Uniprot ID: P23763
  ENSP ID: ENSP00000383702
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGAICAIIVVVIVRRD

SEQ ID NO: 96589 - protein, 116 aa, Homo sapiens
  Payload ID: 19268
  Gene Name: vesicle-associated membrane protein 1 (synaptobrevin 1)
  ENSP ID: ENSP00000444181
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGAICAIIVVVIVRRG

SEQ ID NO: 96590 - protein, 116 aa, Homo sapiens
  Payload ID: 19269
  Gene Name: vesicle-associated membrane protein 2 (synaptobrevin 2)
  Uniprot ID: P63027
  ENSP ID: ENSP00000314214
MSATAATAPPAAPAGEGGPPAPPPNLTSNRRLQQTQAQVDEVVDIMRVNVDKVLERDQKLSELDDRADALQAGASQFETSAAKLKRKYWWKNLKMMIILGVICAIILIIIIVYFST

SEQ ID NO: 96591 - protein, 118 aa, Homo sapiens
  Payload ID: 19269
  Gene Name: vesicle-associated membrane protein 2 (synaptobrevin 2)
  ENSP ID: ENSP00000418572
MDRSATAATAPPAAPAGEGGPPAPPPNLTSNRRLQQTQAQVDEVVDIMRVNVDKVLERDQKLSELDDRADALQAGASQFETSAAKLKRKYWWKNLKMMIILGVICAIILIIIIVYFST

SEQ ID NO: 96592 - protein, 68 aa, Homo sapiens
  Payload ID: 19269
  Gene Name: vesicle-associated membrane protein 2 (synaptobrevin 2)
  ENSP ID: ENSP00000466995
MRVNVDKVLERDQKLSELDDRADALQAGASQFETSAAKLKRKYWWKNLKMMIILGVICAIILIIIIGE

SEQ ID NO: 96593 - protein, 113 aa, Homo sapiens
  Payload ID: 19269
  Gene Name: vesicle-associated membrane protein 2 (synaptobrevin 2)
  ENSP ID: ENSP00000467399
MSATAATAPPAAPAGEGGPPAPPPNLTSNRRLQQTQAQVDEVVDIMRVNVDKVLERDQKLSELDDRADALQAGASQFETSAAKLKRKYWWKNLKMMIILGVICAIILIIIIGE

SEQ ID NO: 96594 - protein, 100 aa, Homo sapiens
  Payload ID: 19270
  Gene Name: vesicle-associated membrane protein 3
  Uniprot ID: Q15836
  ENSP ID: ENSP00000054666
MSTGPTAATGSNRRLQQTQNQVDEVVDIMRVNVDKVLERDQKLSELDDRADALQAGASQFETSAAKLKRKYWWKNCKMWAIGITVLVIFIIIIIVWVVSS

SEQ ID NO: 96595 - protein, 72 aa, Homo sapiens
  Payload ID: 19270
  Gene Name: vesicle-associated membrane protein 3
  ENSP ID: ENSP00000465820
MRVNVDKVLERDQKLSELDDRADALQAGASQFETSAAKLKRKYWWKNCKMWAIGITVLVIFIIIIIVWVVSS

SEQ ID NO: 96596 - protein, 141 aa, Homo sapiens
  Payload ID: 19271
  Gene Name: vesicle-associated membrane protein 4
  Uniprot ID: O75379
  ENSP ID: ENSP00000236192
MPPKFKRHLNDDDVTGSVKSERRNLLEDDSDEEEDFFLRGPSGPRFGPRNDKIKHVQNQVDEVIDVMQENITKVIERGERLDELQDKSESLSDNATAFSNRSKQLRRQMWWRGCKIKAIMALVAAILLLVIIILIVMKYRT

SEQ ID NO: 96597 - protein, 140 aa, Homo sapiens
  Payload ID: 19271
  Gene Name: vesicle-associated membrane protein 4
  Uniprot ID: O75379
  ENSP ID: ENSP00000356714
MPPKFKRHLNDDDVTGSVKSERRNLLEDDSDEEEDFFLGPSGPRFGPRNDKIKHVQNQVDEVIDVMQENITKVIERGERLDELQDKSESLSDNATAFSNRSKQLRRQMWWRGCKIKAIMALVAAILLLVIIILIVMKYRT

SEQ ID NO: 96598 - protein, 141 aa, Homo sapiens; identical to SEQ ID NO: 96596
  Payload ID: 19271
  Gene Name: vesicle-associated membrane protein 4
  Uniprot ID: O75379
  ENSP ID: ENSP00000435933

SEQ ID NO: 96599 - protein, 116 aa, Homo sapiens
  Payload ID: 19272
  Gene Name: vesicle-associated membrane protein 5
  Uniprot ID: O95183
  ENSP ID: ENSP00000305647
MAGIELERCQQQANEVTEIMRNNFGKVLERGVKLAELQQRSDQLLDMSSTFNKTTQNLAQKKCWENIRYRICVGLVVVGVLLIILIVLLVVFLPQSSDSSSAPRTQDAGIASGPGN

SEQ ID NO: 96600 - protein, 260 aa, Homo sapiens
  Payload ID: 19273
  Gene Name: vesicle-associated membrane protein 7
  Uniprot ID: P51809
  ENSP ID: ENSP00000262640
MAILFAVVARGTTILAKHAWCGGNFLEVTEQILAKIPSENNKLTYSHGNYLFHYICQDRIVYLCITDDDFERSRAFNFLNEIKKRFQTTYGSRAQTALPYAMNSEFSSVLAAQLKHHSENKGLDKVMETQAQVDELKGIMVRNIVCHLQNYQQKSCSSHVYEEPQAHYYHHHRINCVHLYHCFTSLWWIYMAKLCEEIGKKKLPLTKDMREQGVKSNPCDSSLSHTDRWYLPVSSTLFSLFKILFHASRFIFVLSTSLFL

SEQ ID NO: 96601 - protein, 220 aa, Homo sapiens
  Payload ID: 19273
  Gene Name: vesicle-associated membrane protein 7
  Uniprot ID: P51809
  ENSP ID: ENSP00000286448
MAILFAVVARGTTILAKHAWCGGNFLEVTEQILAKIPSENNKLTYSHGNYLFHYICQDRIVYLCITDDDFERSRAFNFLNEIKKRFQTTYGSRAQTALPYAMNSEFSSVLAAQLKHHSENKGLDKVMETQAQVDELKGIMVRNIDLVAQRGERLELLIDKTENLVDSSVTFKTTSRNLARAMCMKNLKLTIIIIIVSIVFIYIIVSPLCGGFTWPSCVKK

SEQ ID NO: 96602 - protein, 179 aa, Homo sapiens
  Payload ID: 19273
  Gene Name: vesicle-associated membrane protein 7
  Uniprot ID: P51809
  ENSP ID: ENSP00000427822
MAILFAVVARGTTILAKHAWCGGNFLEDFERSRAFNFLNEIKKRFQTTYGSRAQTALPYAMNSEFSSVLAAQLKHHSENKGLDKVMETQAQVDELKGIMVRNIDLVAQRGERLELLIDKTENLVDSSVTFKTTSRNLARAMCMKNLKLTIIIIIVSIVFIYIIVSPLCGGFTWPSCVKK

SEQ ID NO: 96603 - protein, 59 aa, Homo sapiens
  Payload ID: 19273
  Gene Name: vesicle-associated membrane protein 7
  ENSP ID: ENSP00000430039
MAILFAVVARGTTILAKHAWCGGNFLEVTEQILAKIPSENNKLTYSHGKILNVPEPLIF

SEQ ID NO: 96604 - protein, 100 aa, Homo sapiens
  Payload ID: 19274
  Gene Name: vesicle-associated membrane protein 8
  Uniprot ID: Q9BV40
  ENSP ID: ENSP00000263864
MEEASEGGGNDRVRNLQSEVEGVKNIMTQNVERILARGENLEHLRNKTEDLEATSEHFKTTSQKVARKFWWKNVKMIVLICVIVFIIILFIVLFATGAFS

SEQ ID NO: 96605 - protein, 99 aa, Homo sapiens
  Payload ID: 19274
  Gene Name: vesicle-associated membrane protein 8
  ENSP ID: ENSP00000387094
MEEASEGGGNDRVRNLQSEVEGVKNIMTQNVERILARGENLEHLRNKTEDLEATPGAEASCFREEVTPKLSKVWSLKFCVQRGGWLWLSESCVNSWLLV

SEQ ID NO: 96606 - protein, 74 aa, Homo sapiens
  Payload ID: 19274
  Gene Name: vesicle-associated membrane protein 8
  ENSP ID: ENSP00000407984
MTQNVERILARGENLEHLRNKTEDLEATSEHFKTTSQKVARKFWWKNVKMIVLICVIVFIIILFIVLFATGAFS

SEQ ID NO: 96607 - protein, 172 aa, Homo sapiens
  Payload ID: 19275
  Gene Name: vesicular, overexpressed in cancer, prosurvival protein 1
  Uniprot ID: Q96AW1
  ENSP ID: ENSP00000285279
MRRQPAKVAALLLGLLLECTEAKKHCWYFEGLYPTYYICRSYEDCCGSRCCVRALSIQRLWYFWFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 96608 - protein, 105 aa, Homo sapiens
  Payload ID: 19275
  Gene Name: vesicular, overexpressed in cancer, prosurvival protein 1
  ENSP ID: ENSP00000389601
MMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 96609 - protein, 155 aa, Homo sapiens
  Payload ID: 19275
  Gene Name: vesicular, overexpressed in cancer, prosurvival protein 1
  Uniprot ID: Q96AW1
  ENSP ID: ENSP00000393210
MCTEAKKHCWYFEGLYPTYYICRSYEDCCGSRCCVRALSIQRLWYFWFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 96610 - protein, 105 aa, Homo sapiens; identical to SEQ ID NO: 96608
  Payload ID: 19275
  Gene Name: vesicular, overexpressed in cancer, prosurvival protein 1
  ENSP ID: ENSP00000395533

SEQ ID NO: 96611 - protein, 170 aa, Homo sapiens
  Payload ID: 19275
  Gene Name: vesicular, overexpressed in cancer, prosurvival protein 1
  ENSP ID: ENSP00000407356
MRIRSLHPVQQTEPTTCTEAKKHCWYFEGLYPTYYICRSYEDCCGSRCCVRALSIQRLWYFWFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 96612 - protein, 96 aa, Homo sapiens
  Payload ID: 19275
  Gene Name: vesicular, overexpressed in cancer, prosurvival protein 1
  ENSP ID: ENSP00000407579
MMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPP

SEQ ID NO: 96613 - protein, 21 aa, Homo sapiens
  Payload ID: 19275
  Gene Name: vesicular, overexpressed in cancer, prosurvival protein 1
  ENSP ID: ENSP00000408161
MMGVLFCCGAGFFIRRRMYPP

SEQ ID NO: 96614 - protein, 109 aa, Homo sapiens
  Payload ID: 19275
  Gene Name: vesicular, overexpressed in cancer, prosurvival protein 1
  ENSP ID: ENSP00000411447
MFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 96615 - protein, 52 aa, Homo sapiens
  Payload ID: 19275
  Gene Name: vesicular, overexpressed in cancer, prosurvival protein 1
  ENSP ID: ENSP00000411737
MMGVLFCCGAGFFIRRRMYPPPLIEEPAFNVSYTRQPPNPGPGAQQPGPPYY

SEQ ID NO: 96616 - protein, 105 aa, Homo sapiens; identical to SEQ ID NO: 96608
  Payload ID: 19275
  Gene Name: vesicular, overexpressed in cancer, prosurvival protein 1
  ENSP ID: ENSP00000413948

SEQ ID NO: 96617 - protein, 163 aa, Homo sapiens
  Payload ID: 19275
  Gene Name: vesicular, overexpressed in cancer, prosurvival protein 1
  Uniprot ID: Q96AW1
  ENSP ID: ENSP00000415230
MRRTGSHAQCTEAKKHCWYFEGLYPTYYICRSYEDCCGSRCCVRALSIQRLWYFWFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 96618 - protein, 85 aa, Homo sapiens
  Payload ID: 19275
  Gene Name: vesicular, overexpressed in cancer, prosurvival protein 1
  ENSP ID: ENSP00000416530
MMGVLFCCGAGFFIRRRMYPPPLIEEPAFNVSYTRQPPNPGPGAQQPGPPYYTDPGGPGMNPVGNSMAMAFQVPPNSPQGSVACP

SEQ ID NO: 96619 - protein, 169 aa, Homo sapiens
  Payload ID: 19275
  Gene Name: vesicular, overexpressed in cancer, prosurvival protein 1
  Uniprot ID: Q96AW1
  ENSP ID: ENSP00000486983
MLSETLGYLSSVLLQCTEAKKHCWYFEGLYPTYYICRSYEDCCGSRCCVRALSIQRLWYFWFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 96620 - protein, 258 aa, Homo sapiens
  Payload ID: 19276
  Gene Name: vestigial-like family member 1
  Uniprot ID: Q99990
  ENSP ID: ENSP00000359668
MEEMKKTAIRLPKGKQKPIKTEWNSRCVLFTYFQGDISSVVDEHFSRALSNIKSPQELTPSSQSEGVMLKNDDSMSPNQWRYSSPWTKPQPEVPVTNRAANCNLHVPGPMAVNQFSPSLARRASVRPGELWHFSSLAGTSSLEPGYSHPFPARHLVPEPQPDGKREPLLSLLQQDRCLARPQESAARENGNPGQIAGSTGLLFNLPPGSVHYKKLYVSRGSASTSLPNETLSELETPGKYSLTPPNHWGHPHRYLQHL

SEQ ID NO: 96621 - protein, 60 aa, Homo sapiens
  Payload ID: 19276
  Gene Name: vestigial-like family member 1
  ENSP ID: ENSP00000388868
TPSSQSEGVMLKNDKKLYVSRGSASTSLPNETLSELETPGKYSLTPPNHWGHPHRYLQHL

SEQ ID NO: 96622 - protein, 162 aa, Homo sapiens
  Payload ID: 19276
  Gene Name: vestigial-like family member 1
  ENSP ID: ENSP00000398360
  MOD_RES (1)..(1): Any amino acid
XISSVVDEHFSRALSNIKSPQELTPSSQSEGVMLKNDDSMSPNQWRYSSPWTKPQPEVPVTNRAANCNLHVPGPMAVNQFSPSLARRASVRPGELWHFSSLAGTSSLEPGYSHPFPARHLVPEPQPDGKHKKLYVSRGSASTSLPNETLSELETPGKYSLTP

SEQ ID NO: 96623 - protein, 143 aa, Homo sapiens
  Payload ID: 19277
  Gene Name: vestigial-like family member 2
  Uniprot ID: Q8N8G2
  ENSP ID: ENSP00000305405
MSCLDVMYQVYGPPQPYFAAAYTPYHQKLAYYSKMQEAQECNASPSSSGSGSSSFSSQTPASIKEEEGSPEKERPPEAEYINSRCVLFTYFQGDISSVVDEHFSRALSQPSSYSPSCTSSKAPRSSGPWRARRYSLCGASLLS

SEQ ID NO: 96624 - protein, 317 aa, Homo sapiens
  Payload ID: 19277
  Gene Name: vestigial-like family member 2
  Uniprot ID: Q8N8G2
  ENSP ID: ENSP00000320957
MSCLDVMYQVYGPPQPYFAAAYTPYHQKLAYYSKMQEAQECNASPSSSGSGSSSFSSQTPASIKEEEGSPEKERPPEAEYINSRCVLFTYFQGDISSVVDEHFSRALSQPSSYSPSCTSSKAPRSSGPWRDCSFPMSQRSFPASFWNSAYQAPVPPPLGSPLATAHSELPFAAADPYSPAALHGHLHQGATEPWHHAHPHHAHPHHPYALGGALGAQAAPYPRPAAVHEVYAPHFDPRYGPLLMPAASGRPARLATAPAPAPGSPPCELSGKGEPAGAAWAGPGGPFASPSGDVAQGLGLSVDSARRYSLCGASLLS

SEQ ID NO: 96625 - protein, 320 aa, Homo sapiens
  Payload ID: 19278
  Gene Name: vestigial-like family member 3
  Uniprot ID: A8MV65
  ENSP ID: ENSP00000373199
MSCAEVMYHPQPYGASQYLPNPMAATTCPTAYYQPAPQPGQQKKLAVFSKMQDSLEVTLPSKQEEEDEEEEEEEKDQPAEMEYLNSRCVLFTYFQGDIGSVVDEHFSRALGQAITLHPESAISKSKMGLTPLWRDSSALSSQRNSFPTSFWTSSYQPPPAPCLGGVHPDFQVTGPPGTFSAADPSPWPGHNLHQTGPAPPPAVSESWPYPLTSQVSPSYSHMHDVYMRHHHPHAHMHHRHRHHHHHHHPPAGSALDPSYGPLLMPSVHAARIPAPQCDITKTEPTTVTSATSAWAGAFHGTVDIVPSVGFDTGWSAMARS

SEQ ID NO: 96626 - protein, 326 aa, Homo sapiens
  Payload ID: 19278
  Gene Name: vestigial-like family member 3
  Uniprot ID: A8MV65
  ENSP ID: ENSP00000381436
MSCAEVMYHPQPYGASQYLPNPMAATTCPTAYYQPAPQPGQQKKLAVFSKMQDSLEVTLPSKQEEEDEEEEEEEKDQPAEMEYLNSRCVLFTYFQGDIGSVVDEHFSRALGQAITLHPESAISKSKMGLTPLWRDSSALSSQRNSFPTSFWTSSYQPPPAPCLGGVHPDFQVTGPPGTFSAADPSPWPGHNLHQTGPAPPPAVSESWPYPLTSQVSPSYSHMHDVYMRHHHPHAHMHHRHRHHHHHHHPPAGSALDPSYGPLLMPSVHAARIPAPQCDITKTEPTTVTSATSAWAGAFHGTVDIVPSVGFDTGLQHQDKSKESPWY

SEQ ID NO: 96627 - protein, 208 aa, Homo sapiens
  Payload ID: 19278
  Gene Name: vestigial-like family member 3
  ENSP ID: ENSP00000419115
  MOD_RES (1)..(1): Any amino acid
XASQYLPNPMAATTCPTAYYQPAPQPGQQGDIGSVVDEHFSRALGQAITLHPESAISKSKMGLTPLWRDSSALSSQRNSFPTSFWTSSYQPPPAPCLGGVHPDFQVTGPPGTFSAADPSPWPGHNLHQTGPAPPPAVSESWPYPLTSQVSPSYSHMHDVYMRHHHPHAHMHHRHRHHHHHHHPPAGSALDPSYGPLLMPSVHAARIPA

SEQ ID NO: 96628 - protein, 290 aa, Homo sapiens
  Payload ID: 19279
  Gene Name: vestigial-like family member 4
  ENSP ID: ENSP00000273038
METPLDVLSRAASLVHADDEKREAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 96629 - protein, 81 aa, Homo sapiens
  Payload ID: 19279
  Gene Name: vestigial-like family member 4
  ENSP ID: ENSP00000391554
MEPGDEDLDCDNDHVSKMSRIFNPHLNKTANGDCRRDPRERSRSPIERAVAPTMSLHGSHLYTSLPSLGLEQPLALTKNSL

SEQ ID NO: 96630 - protein, 169 aa, Homo sapiens
  Payload ID: 19279
  Gene Name: vestigial-like family member 4
  ENSP ID: ENSP00000391932
METPLDVLSRAASLVHADDEKREAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQVGLCLGGWRG

SEQ ID NO: 96631 - protein, 60 aa, Homo sapiens
  Payload ID: 19279
  Gene Name: vestigial-like family member 4
  ENSP ID: ENSP00000393100
MEPGDEDLDCDNDHVSKMSRIFNPHLNKTANGDCRRDPRERSRSPIERAVAPTMSLHGSH

SEQ ID NO: 96632 - protein, 190 aa, Homo sapiens
  Payload ID: 19279
  Gene Name: vestigial-like family member 4
  ENSP ID: ENSP00000394123
MKDLKKRVALGYISTHTGEAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPAS

SEQ ID NO: 96633 - protein, 200 aa, Homo sapiens
  Payload ID: 19279
  Gene Name: vestigial-like family member 4
  ENSP ID: ENSP00000394439
METPLDVLSRAASLVHADDEKREAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPS

SEQ ID NO: 96634 - protein, 127 aa, Homo sapiens
  Payload ID: 19279
  Gene Name: vestigial-like family member 4
  ENSP ID: ENSP00000395557
METPLDVLSRAASLVHADDEKREAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSL

SEQ ID NO: 96635 - protein, 206 aa, Homo sapiens
  Payload ID: 19279
  Gene Name: vestigial-like family member 4
  Uniprot ID: Q14135
  ENSP ID: ENSP00000402878
MNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 96636 - protein, 296 aa, Homo sapiens
  Payload ID: 19279
  Gene Name: vestigial-like family member 4
  ENSP ID: ENSP00000404251
MLFMKMDLLNYQYLDKMNNNIGILCYEGEAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 96637 - protein, 231 aa, Homo sapiens
  Payload ID: 19279
  Gene Name: vestigial-like family member 4
  ENSP ID: ENSP00000404624
MEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 96638 - protein, 147 aa, Homo sapiens
  Payload ID: 19279
  Gene Name: vestigial-like family member 4
  ENSP ID: ENSP00000411670
MTENTHFDKIPESCALKSWRHPGLHHGEAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDA

SEQ ID NO: 96639 - protein, 223 aa, Homo sapiens
  Payload ID: 19279
  Gene Name: vestigial-like family member 4
  ENSP ID: ENSP00000412923
METPLDVLSRAASLVHADDEKREAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKE

SEQ ID NO: 96640 - protein, 295 aa, Homo sapiens
  Payload ID: 19279
  Gene Name: vestigial-like family member 4
  ENSP ID: ENSP00000413030
MTENTHFDKIPESCALKSWRHPGLHHGEAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 96641 - protein, 210 aa, Homo sapiens
  Payload ID: 19279
  Gene Name: vestigial-like family member 4
  Uniprot ID: Q14135
  ENSP ID: ENSP00000416615
MIKVRNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 96642 - protein, 59 aa, Homo sapiens
  Payload ID: 19279
  Gene Name: vestigial-like family member 4
  ENSP ID: ENSP00000485472
METPLDVLSRAASLVHADDEKREAALRGEPRIQTLPVASALSSHRTGPPPISPSKRKFS

SEQ ID NO: 96643 - protein, 479 aa, Homo sapiens
  Payload ID: 19280
  Gene Name: v-ets avian erythroblastosis virus E26 oncogene homolog
  Uniprot ID: P11308
  ENSP ID: ENSP00000288319
MASTIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTGGAAFIFPNTSVYPEATQRITTRPDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 96644 - protein, 363 aa, Homo sapiens
  Payload ID: 19280
  Gene Name: v-ets avian erythroblastosis virus E26 oncogene homolog
  Uniprot ID: P11308
  ENSP ID: ENSP00000381871
MVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 96645 - protein, 455 aa, Homo sapiens
  Payload ID: 19280
  Gene Name: v-ets avian erythroblastosis virus E26 oncogene homolog
  ENSP ID: ENSP00000381877
MASTIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 96646 - protein, 456 aa, Homo sapiens
  Payload ID: 19280
  Gene Name: v-ets avian erythroblastosis virus E26 oncogene homolog
  ENSP ID: ENSP00000381879
MASTIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTGGAAFIFPNTSVYPEATQRITTRPAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 96647 - protein, 463 aa, Homo sapiens
  Payload ID: 19280
  Gene Name: v-ets avian erythroblastosis virus E26 oncogene homolog
  ENSP ID: ENSP00000381881
MIQTVPDPAAHIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTGGAAFIFPNTSVYPEATQRITTRPAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 96648 - protein, 462 aa, Homo sapiens
  Payload ID: 19280
  Gene Name: v-ets avian erythroblastosis virus E26 oncogene homolog
  Uniprot ID: P11308
  ENSP ID: ENSP00000381882
MIQTVPDPAAHIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 96649 - protein, 486 aa, Homo sapiens
  Payload ID: 19280
  Gene Name: v-ets avian erythroblastosis virus E26 oncogene homolog
  Uniprot ID: P11308
  ENSP ID: ENSP00000381891
MIQTVPDPAAHIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTGGAAFIFPNTSVYPEATQRITTRPDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 96650 - protein, 462 aa, Homo sapiens; identical to SEQ ID NO: 96648
  Payload ID: 19280
  Gene Name: v-ets avian erythroblastosis virus E26 oncogene homolog
  Uniprot ID: P11308
  ENSP ID: ENSP00000394694

SEQ ID NO: 96651 - protein, 387 aa, Homo sapiens
  Payload ID: 19280
  Gene Name: v-ets avian erythroblastosis virus E26 oncogene homolog
  ENSP ID: ENSP00000396268
MVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTGGAAFIFPNTSVYPEATQRITTRPDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 96652 - protein, 486 aa, Homo sapiens; identical to SEQ ID NO: 96649
  Payload ID: 19280
  Gene Name: v-ets avian erythroblastosis virus E26 oncogene homolog
  Uniprot ID: P11308
  ENSP ID: ENSP00000414150

SEQ ID NO: 96653 - protein, 220 aa, Homo sapiens [sequence omitted]

SEQ ID NO: 96654 - protein, 441 aa, Homo sapiens
  Payload ID: 19281
  Gene Name: v-ets avian erythroblastosis virus E26 oncogene homolog 1
  Uniprot ID: P14921
  ENSP ID: ENSP00000324578
MKAAVDLKPTLTIIKTEKVDLELFPSPDMECADVPLLTPSSKEMMSQALKATFSGFTKEQQRLGIPKDPRQWTETHVRDWVMWAVNEFSLKGVDFQKFCMNGAALCALGKDCFLELAPDFVGDILWEHLEILQKEDVKPYQVNGVNPAYPESRYTSDYFISYGIEHAQCVPPSEFSEPSFITESYQTLHPISSEELLSLKYENDYPSVILRDPLQTDTLQNDYFAIKQEVVTPDNMCMGRTSRGKLGGQDSFESIESYDSCDRLTQSWSSQSSFNSLQRVPSYDSFDSEDYPAALPNHKPKGTFKDYVRDRADLNKDKPVIPAAALAGYTGSGPIQLWQFLLELLTDKSCQSFISWTGDGWEFKLSDPDEVARRWGKRKNKPKMNYEKLSRGLRYYYDKNIIHKTAGKRYVYRFVCDLQSLLGYTPEELHAMLDVKPDADE

SEQ ID NO: 96655 - protein, 485 aa, Homo sapiens
  Payload ID: 19281
  Gene Name: v-ets avian erythroblastosis virus E26 oncogene homolog 1
  Uniprot ID: P14921
  ENSP ID: ENSP00000376436
MSYFVDSAGSSPVPYSAPRPAVVRQGPSNTYEDPRMNCGFQSNYHQQRPCYPFWDEMATQEVPTGLEHCVSDMECADVPLLTPSSKEMMSQALKATFSGFTKEQQRLGIPKDPRQWTETHVRDWVMWAVNEFSLKGVDFQKFCMNGAALCALGKDCFLELAPDFVGDILWEHLEILQKEDVKPYQVNGVNPAYPESRYTSDYFISYGIEHAQCVPPSEFSEPSFITESYQTLHPISSEELLSLKYENDYPSVILRDPLQTDTLQNDYFAIKQEVVTPDNMCMGRTSRGKLGGQDSFESIESYDSCDRLTQSWSSQSSFNSLQRVPSYDSFDSEDYPAALPNHKPKGTFKDYVRDRADLNKDKPVIPAAALAGYTGSGPIQLWQFLLELLTDKSCQSFISWTGDGWEFKLSDPDEVARRWGKRKNKPKMNYEKLSRGLRYYYDKNIIHKTAGKRYVYRFVCDLQSLLGYTPEELHAMLDVKPDADE

SEQ ID NO: 96656 - protein, 354 aa, Homo sapiens
  Payload ID: 19281
  Gene Name: v-ets avian erythroblastosis virus E26 oncogene homolog 1
  Uniprot ID: P14921
  ENSP ID: ENSP00000433500
MKAAVDLKPTLTIIKTEKVDLELFPSPDMECADVPLLTPSSKEMMSQALKATFSGFTKEQQRLGIPKDPRQWTETHVRDWVMWAVNEFSLKGVDFQKFCMNGAALCALGKDCFLELAPDFVGDILWEHLEILQKEDVKPYQVNGVNPAYPESRYTSDYFISYGIEHAQCVPPSEFSEPSFITESYQTLHPISSEELLSLKYENDYPSVILRDPLQTDTLQNDYFAIKQEVVTPDNMCMGRTSRGSGPIQLWQFLLELLTDKSCQSFISWTGDGWEFKLSDPDEVARRWGKRKNKPKMNYEKLSRGLRYYYDKNIIHKTAGKRYVYRFVCDLQSLLGYTPEELHAMLDVKPDADE

SEQ ID NO: 96657 - protein, 272 aa, Homo sapiens
  Payload ID: 19281
  Gene Name: v-ets avian erythroblastosis virus E26 oncogene homolog 1
  Uniprot ID: P14921
  ENSP ID: ENSP00000435666
MKAAVDLKPTLTIIKTEKVDLELFPSPDMECADVPLLTPSSKEMMSQALKATFSGFTKEQQRLGIPKDPRQWTETHVRDWVMWAVNEFSLKGVDFQKFCMNGAALCALGKDCFLELAPDFVGDILWEHLEILQKEDVKPYQVNGVNPAYPESRYTSDYFISYGIEHAQCVPPSEFSEPSFITESYQTLHPISSEELLSLKYENDYPSVILRDPLQTDTLQNDYFAIKQEVVTPDNMCMGRTSRGKLGGQDSFESIESYDSCGQEMGKEEKQT

SEQ ID NO: 96658 - protein, 225 aa, Homo sapiens
  Payload ID: 19281
  Gene Name: v-ets avian erythroblastosis virus E26 oncogene homolog 1
  Uniprot ID: P14921
  ENSP ID: ENSP00000441430
MKAAVDLKPTLTIIKTEKVDLELFPSPGKLGGQDSFESIESYDSCDRLTQSWSSQSSFNSLQRVPSYDSFDSEDYPAALPNHKPKGTFKDYVRDRADLNKDKPVIPAAALAGYTGSGPIQLWQFLLELLTDKSCQSFISWTGDGWEFKLSDPDEVARRWGKRKNKPKMNYEKLSRGLRYYYDKNIIHKTAGKRYVYRFVCDLQSLLGYTPEELHAMLDVKPDADE

SEQ ID NO: 96659 - protein, 46 aa, Homo sapiens
  Payload ID: 19281
  Gene Name: v-ets avian erythroblastosis virus E26 oncogene homolog 1
  ENSP ID: ENSP00000476649
MECADVPLLTPSSKEMMSQALKATFSGFTKEQQRLGIPKDPRQWTE

SEQ ID NO: 96660 - protein, 469 aa, Homo sapiens
  Payload ID: 19282
  Gene Name: v-ets avian erythroblastosis virus E26 oncogene homolog 2
  Uniprot ID: P15036
  ENSP ID: ENSP00000353344
MNDFGIKNMDQVAPVANSYRGTLKRQPAFDTFDGSLFAVFPSLNEEQTLQEVPTGLDSISHDSANCELPLLTPCSKAVMSQALKATFSGFKKEQRRLGIPKNPWLWSEQQVCQWLLWATNEFSLVNVNLQRFGMNGQMLCNLGKERFLELAPDFVGDILWEHLEQMIKENQEKTEDQYEENSHLTSVPHWINSNTLGFGTEQAPYGMQTQNYPKGGLLDSMCPASTPSVLSSEQEFQMFPKSRLSSVSVTYCSVSQDFPGSNLNLLTNNSGTPKDHDSPENGADSFESSDSLLQSWNSQSSLLDVQRVPSFESFEDDCSQSLCLNKPTMSFKDYIQERSDPVEQGKPVIPAAVLAGFTGSGPIQLWQFLLELLSDKSCQSFISWTGDGWEFKLADPDEVARRWGKRKNKPKMNYEKLSRGLRYYYDKNIIHKTSGKRYVYRFVCDLQNLLGFTPEELHAILGVQPDTED

SEQ ID NO: 96661 - protein, 469 aa, Homo sapiens; identical to SEQ ID NO: 96660
  Payload ID: 19282
  Gene Name: v-ets avian erythroblastosis virus E26 oncogene homolog 2
  Uniprot ID: P15036
  ENSP ID: ENSP00000354194

SEQ ID NO: 96662 - protein, 168 aa, Homo sapiens
  Payload ID: 19282
  Gene Name: v-ets avian erythroblastosis virus E26 oncogene homolog 2
  ENSP ID: ENSP00000401273
MNDFGIKNMDQVAPVANSYRGTLKRQPAFDTFDGSLFAVFPSLNEEQTLQEVPTGLDSISHDSANCELPLLTPCSKAVMSQALKATFSGFKKEQRRLGIPKNPWLWSEQQVCQWLLWATNEFSLVNVNLQRFGMNGQMLCNLGKERFLELAPDFVGDILWEHLEQMIK

SEQ ID NO: 96663 - protein, 270 aa, Homo sapiens
  Payload ID: 19282
  Gene Name: v-ets avian erythroblastosis virus E26 oncogene homolog 2
  ENSP ID: ENSP00000411086
MNDFGIKNMDQVAPVANSYRGTLKRQPAFDTFDGSLFAVFPSLNEEQTLQEVPTGLDSISHDSANCELPLLTPCSKAVMSQALKATFSGFKKEQRRLGIPKNPWLWSEQQVCQWLLWATNEFSLVNVNLQRFGMNGQMLCNLGKERFLELAPDFVGDILWEHLEQMIKENQEKTEDQYEENSHLTSVPHWINSNTLGFGTEQAPYGMQTQNYPKGGLLDSMCPASTPSVLSSEQEFQMFPKSRLSSVSVTYCSVSQDFPGSNLNLLTNNS

SEQ ID NO: 96664 - protein, 460 aa, Homo sapiens [sequence omitted]

SEQ ID NO: 96665 - protein, 723 aa, Homo sapiens
  Payload ID: 19283
  Gene Name: vezatin, adherens junctions transmembrane protein
  ENSP ID: ENSP00000380894
MLKEWAIKQGILLKVAETIKSWIFFSQCNKKDDLLHKLDIGFRLDSLHTILQQEVLLQEDVELIELLDPSILSAGQSQQQENGHLPTLCSLATPNIWDLSMLFAFISLLVMLPTWWIVSSWLVWGVILFVYLVIRALRLWRTAKLQVTLKKYSVHLEDMATNSRAFTNLVRKALRLIQETEVISRGFTLLLDRVSAACPFNKAGQHPSQHLIGLRKAVYRTLRANFQAARLATLYMLKNYPLNSESDNVTNYICVVPFKELGLGLSEEQISEEEAHNFTDGFSLPALKVLFQLWVAQSSEFFRRLALLLSTANSPPGPLLTPALLPHRILSDVTQGLPHAHSACLEELKRSYEFYRYFETQHQSVPQCLSKTQQKSRELNNVHTAVRSLQLHLKALLNEVIILEDELEKLVCTKETQELVSEAYPILEQKLKLIQPHVQASNNCWEEAISQVDKLLRRNTDKKGKPEIACENPHCTVVPLKQPTLHIADKDPIPEEQELEAYVDDIDIDSDFRKDDFYYLSQEDKERQKREHEESKRVLQELKSVLGFKASEAERQKWKQLLFSDHAVLKSLSPVDPVEPISNSEPSMNSDMGKVSKNDTEEESNKSATTDNEISRTEYLCENSLEGKNKDNSSNEVFPQGAEERMCYQCESEDEPQADGSGLTTAPPTPRDSLQPSIKQRLARLQLSPDFTFTAGLAAEVAARSLSFTTMQEQTFGGEEEEQ

SEQ ID NO: 96666 - protein, 779 aa, Homo sapiens
  Payload ID: 19283
  Gene Name: vezatin, adherens junctions transmembrane protein
  Uniprot ID: Q9HBM0
  ENSP ID: ENSP00000410083
MTPEFDEEVVFENSPLYQYLQDLGHTDFEICSSLSPKTEKCTTEGQQKPPTRVLPKQGILLKVAETIKSWIFFSQCNKKDDLLHKLDIGFRLDSLHTILQQEVLLQEDVELIELLDPSILSAGQSQQQENGHLPTLCSLATPNIWDLSMLFAFISLLVMLPTWWIVSSWLVWGVILFVYLVIRALRLWRTAKLQVTLKKYSVHLEDMATNSRAFTNLVRKALRLIQETEVISRGFTLVSAACPFNKAGQHPSQHLIGLRKAVYRTLRANFQAARLATLYMLKNYPLNSESDNVTNYICVVPFKELGLGLSEEQISEEEAHNFTDGFSLPALKVLFQLWVAQSSEFFRRLALLLSTANSPPGPLLTPALLPHRILSDVTQGLPHAHSACLEELKRSYEFYRYFETQHQSVPQCLSKTQQKSRELNNVHTAVRSLQLHLKALLNEVIILEDELEKLVCTKETQELVSEAYPILEQKLKLIQPHVQASNNCWEEAISQVDKLLRRNTDKKGKPEIACENPHCTVVPLKQPTLHIADKDPIPEEQELEAYVDDIDIDSDFRKDDFYYLSQEDKERQKREHEESKRVLQELKSVLGFKASEAERQKWKQLLFSDHAVLKSLSPVDPVEPISNSEPSMNSDMGKVSKNDTEEESNKSATTDNEISRTEYLCENSLEGKNKDNSSNEVFPQGAEERMCYQCESEDEPQADGSGLTTAPPTPRDSLQPSIKQRLARLQLSPDFTFTAGLAAEVAARSLSFTTMQEQTFGGEEEEQIIEENKNEIEEK

SEQ ID NO: 96667 - protein, 99 aa, Homo sapiens
  Payload ID: 19283
  Gene Name: vezatin, adherens junctions transmembrane protein
  ENSP ID: ENSP00000446666
MTPEFDEEVVFENSPLYQYLQDLGHTDFEICSSLSPKTEKCTTEGQQKPPTRVLPKQGILLKVAETIKSWIFFSQCNKKDDLLHKLVEPSHSSVILGLW

SEQ ID NO: 96668 - protein, 79 aa, Homo sapiens
  Payload ID: 19283
  Gene Name: vezatin, adherens junctions transmembrane protein
  Uniprot ID: Q9HBM0
  ENSP ID: ENSP00000447010
MTPEFDEEVVFENSPLYQYLQDLGHTDFEICSSLSPKTEKCTTEGQQKPPTRVLPKYLGYSNHSMNINCTYWHAQGMGY

SEQ ID NO: 96669 - protein, 79 aa, Homo sapiens; identical to SEQ ID NO: 96668
  Payload ID: 19283
  Gene Name: vezatin, adherens junctions transmembrane protein
  Uniprot ID: Q9HBM0
  ENSP ID: ENSP00000447044

SEQ ID NO: 96670 - protein, 79 aa, Homo sapiens; identical to SEQ ID NO: 96668
  Payload ID: 19283
  Gene Name: vezatin, adherens junctions transmembrane protein
  Uniprot ID: Q9HBM0
  ENSP ID: ENSP00000447080

SEQ ID NO: 96671 - protein, 98 aa, Homo sapiens
  Payload ID: 19283
  Gene Name: vezatin, adherens junctions transmembrane protein
  ENSP ID: ENSP00000447151
MLKEWAIKDIGFRLDSLHTILQQEVLLQEDVELIELLDPSILSAGQSQQQENGHLPTLCSLATPNIWDLSMLFAFISLLVMLPTWWIVSSWLVWGVIL

SEQ ID NO: 96672 - protein, 65 aa, Homo sapiens
  Payload ID: 19283
  Gene Name: vezatin, adherens junctions transmembrane protein
  ENSP ID: ENSP00000447468
MTPEFDEEVVFENSPLYQYLQDLGHTDFEICSSLSPKTEKCTTEGQQKPPTRVLPKGSLNAICLH

SEQ ID NO: 96673 - protein, 152 aa, Homo sapiens
  Payload ID: 19283
  Gene Name: vezatin, adherens junctions transmembrane protein
  ENSP ID: ENSP00000447633
MTPEFDEEVVFEDLGHTDFEICSSLSPKTEKCTTEGQQKPPTRVLPKQGILLKVAETIKSWIFFSQCNKKDDLLHKLDIGFRLDSLHTILQQEVLLQEDVELIELLDPSILSAGQSQQQENGHLPTLCSLATPNIWDLSMLFAFISLLVMLP

SEQ ID NO: 96674 - protein, 79 aa, Homo sapiens; identical to SEQ ID NO: 96668
  Payload ID: 19283
  Gene Name: vezatin, adherens junctions transmembrane protein
  Uniprot ID: Q9HBM0
  ENSP ID: ENSP00000447786

SEQ ID NO: 96675 - protein, 65 aa, Homo sapiens; identical to SEQ ID NO: 96672
  Payload ID: 19283
  Gene Name: vezatin, adherens junctions transmembrane protein
  ENSP ID: ENSP00000447891

SEQ ID NO: 96676 - protein, 98 aa, Homo sapiens
  Payload ID: 19283
  Gene Name: vezatin, adherens junctions transmembrane protein
  ENSP ID: ENSP00000448019
MTPEFDEEVVFEVRPVGRTCRSEDGGKSARENSPLYQYLQDLGHTDFEICSSLSPKTEKCTTEGQQKPPTRVLPKYLGYSNHSMNINCTYWHAQGMGY

SEQ ID NO: 96677 - protein, 79 aa, Homo sapiens; identical to SEQ ID NO: 96668
  Payload ID: 19283
  Gene Name: vezatin, adherens junctions transmembrane protein
  Uniprot ID: Q9HBM0
  ENSP ID: ENSP00000448555

SEQ ID NO: 96678 - protein, 59 aa, Homo sapiens
  Payload ID: 19283
  Gene Name: vezatin, adherens junctions transmembrane protein
  ENSP ID: ENSP00000448724
MTPEFDEEVVFENSPLYQYLQDLGHTDFEICSSLSPKTEKCTTEGQQKPPTRVLPKVSC

SEQ ID NO: 96679 - protein, 34 aa, Homo sapiens
  Payload ID: 19283
  Gene Name: vezatin, adherens junctions transmembrane protein
  ENSP ID: ENSP00000448738
MTPEFDEEVVFEAAEPLLEASGMLLNFPACRTMS

SEQ ID NO: 96680 - protein, 65 aa, Homo sapiens; identical to SEQ ID NO: 96672
  Payload ID: 19283
  Gene Name: vezatin, adherens junctions transmembrane protein
  ENSP ID: ENSP00000448866

SEQ ID NO: 96681 - protein, 79 aa, Homo sapiens; identical to SEQ ID NO: 96668
  Payload ID: 19283
  Gene Name: vezatin, adherens junctions transmembrane protein
  Uniprot ID: Q9HBM0
  ENSP ID: ENSP00000449056

SEQ ID NO: 96682 - protein, 79 aa, Homo sapiens; identical to SEQ ID NO: 96668
  Payload ID: 19283
  Gene Name: vezatin, adherens junctions transmembrane protein
  Uniprot ID: Q9HBM0
  ENSP ID: ENSP00000449346

SEQ ID NO: 96683 - protein, 159 aa, Homo sapiens
  Payload ID: 19283
  Gene Name: vezatin, adherens junctions transmembrane protein
  ENSP ID: ENSP00000449591
MTPEFDEEVVFENSPLYQYLQDLGHTDFEICSSLSPKTEKCTTEGQQKPPTRVLPKDIGFRLDSLHTILQQEVLLQEDVELIELLDPSILSAGQSQQQENGHLPTLCSLATPNIWDLSMLFAFISLLVMLPTWWIVSSWLVWGVILFVYLVIRALRLWR

SEQ ID NO: 96684 - protein, 189 aa, Homo sapiens
  Payload ID: 19283
  Gene Name: vezatin, adherens junctions transmembrane protein
  ENSP ID: ENSP00000449701
MTPEFDEEVVFEVRPVGRTCRSEDGGKSARENSPLYQYLQDLGHTDFEICSSLSPKTEKCTTEGQQKPPTRVLPKQGILLKVAETIKSWIFFSQCNKKDDLLHKLDIGFRLDSLHTILQQEVLLQEDVELIELLDPSILSAGQSQQQENGHLPTLCSLATPNIWDLSMLFAFISLLVMLPTWWIVSSWL

SEQ ID NO: 96685 - protein, 89 aa, Homo sapiens
  Payload ID: 19283
  Gene Name: vezatin, adherens junctions transmembrane protein
  ENSP ID: ENSP00000450009
MLKEWAIKQGILLKVAETIKSWIFFSQCNKKDDLLHKLDIGFRLDSLHTILQQEVLLQEDVELIELLDPSILSAGQSQQQENGHLPTLC

SEQ ID NO: 96686 - protein, 615 aa, Homo sapiens
  Payload ID: 19284
  Gene Name: VGF nerve growth factor inducible
  Uniprot ID: O15240
  ENSP ID: ENSP00000249330
MKALRLSASALFCLLLINGLGAAPPGRPEAQPPPLSSEHKEPVAGDAVPGPKDGSAPEVRGARNSEPQDEGELFQGVDPRALAAVLLQALDRPASPPAPSGSQQGPEEEAAEALLTETVRSQTHSLPAPESPEPAAPPRPQTPENGPEASDPSEELEALASLLQELRDFSPSSAKRQQETAAAETETRTHTLTRVNLESPGPERVWRASWGEFQARVPERAPLPPPAPSQFQARMPDSGPLPETHKFGEGVSSPKTHLGEALAPLSKAYQGVAAPFPKARRPESALLGGSEAGERLLQQGLAQVEAGRRQAEATRQAAAQEERLADLASDLLLQYLLQGGARQRGLGGRGLQEAAEERESAREEEEAEQERRGGEERVGEEDEEAAEAEAEAEEAERARQNALLFAEEEDGEAGAEDKRSQEETPGHRRKEAEGTEEGGEEEDDEEMDPQTIDSLIELSTKLHLPADDVVSIIEEVEEKRKRKKNAPPEPVPPPRAAPAPTHVRSPQPPPPAPAPARDELPDWNEVLPPWDREEDEVYPPGPYHPFPNYIRPRTLQPPSALRRRHYHHALPPSRHYPGREAQARRAQEEAEAEERRLQEQEELENYIEHVLLRRP

SEQ ID NO: 96687 - protein, 615 aa, Homo sapiens; identical to SEQ ID NO: 96686
  Payload ID: 19284
  Gene Name: VGF nerve growth factor inducible
  Uniprot ID: O15240
  ENSP ID: ENSP00000400884

SEQ ID NO: 96688 - protein, 377 aa, Homo sapiens
  Payload ID: 19284
  Gene Name: VGF nerve growth factor inducible
  ENSP ID: ENSP00000480817
MKALRLSASALFCLLLINGLGAAPPGRPEAQPPPLSSEHKEPVAGDAVPGPKDGSAPEVRGARNSEPQDEGELFQGVDPRALAAVLLQALDRPASPPAPSGSQQGPEEEAAEALLTETVRSQTHSLPAPESPEPAAPPRPQTPENGPEASDPSEELEALASLLQELRDFSPSSAKRQQETAAAETETRTHTLTRVNLESPGPERVWRASWGEFQARVPERAPLPPPAPSQFQARMPDSGPLPETHKFGEGVSSPKTHLGEALAPLSKAYQGVAAPFPKARRPESALLGGSEAGERLLQQGLAQVEAGRRQAEATRQAAAQEERLADLASDLLLQFAAGRGPAARPCPLALPLSPGCVGTCQTPLPGPEPELPELTRG

SEQ ID NO: 96689 - protein, 827 aa, Homo sapiens
  Payload ID: 19285
  Gene Name: villin 1
  Uniprot ID: P09327
  ENSP ID: ENSP00000248444
MTKLSAQVKGSLNITTPGLQIWRIEAMQMVPVPSSTFGSFFDGDCYIILAIHKTASSLSYDIHYWIGQDSSLDEQGAAAIYTTQMDDFLKGRAVQHREVQGNESEAFRGYFKQGLVIRKGGVASGMKHVETNSYDVQRLLHVKGKRNVVAGEVEMSWKSFNRGDVFLLDLGKLIIQWNGPESTRMERLRGMTLAKEIRDQERGGRTYVGVVDGENELASPKLMEVMNHVLGKRRELKAAVPDTVVEPALKAALKLYHVSDSEGNLVVREVATRPLTQDLLSHEDCYILDQGGLKIYVWKGKKANEQEKKGAMSHALNFIKAKQYPPSTQVEVQNDGAESAVFQQLFQKWTASNRTSGLGKTHTVGSVAKVEQVKFDATSMHVKPQVAAQQKMVDDGSGEVQVWRIENLELVPVDSKWLGHFYGGDCYLLLYTYLIGEKQHYLLYVWQGSQASQDEITASAYQAVILDQKYNGEPVQIRVPMGKEPPHLMSIFKGRMVVYQGGTSRTNNLETGPSTRLFQVQGTGANNTKAFEVPARANFLNSNDVFVLKTQSCCYLWCGKGCSGDEREMAKMVADTISRTEKQVVVEGQEPANFWMALGGKAPYANTKRLQEENLVITPRLFECSNKTGRFLATEIPDFNQDDLEEDDVFLLDVWDQVFFWIGKHANEEEKKAAATTAQEYLKTHPSGRDPETPIIVVKQGHEPPTFTGWFLAWDPFKWSNTKSYEDLKAELGNSRDWSQITAEVTSPKVDVFNANSNLSSGPLPIFPLEQLVNKPVEELPEGVDPSRKEEHLSIEDFTQAFGMTPAAFSALPRWKQQNLKKEKGLF

SEQ ID NO: 96690 - protein, 516 aa, Homo sapiens
  Payload ID: 19285
  Gene Name: villin 1
  ENSP ID: ENSP00000375962
MSHALNFIKAKQYPPSTQVEVQNDGAESAVFQQLFQKWTASNRTSGLGKTHTVGSVAKVEQVKFDATSMHVKPQVAAQQKMVDDGSGEVQVWRIENLELVPVDSKWLGHFYGGDCYLLLYTYLIGEKQHYLLYVWQGSQASQDEITASAYQAVILDQKYNGEPVQIRVPMGKEPPHLMSIFKGRMVVYQGGTSRTNNLETGPSTRLFQVQGTGANNTKAFEVPARANFLNSNDVFVLKTQSCCYLWCGKGCSGDEREMAKMVADTISRTEKQVVVEGQEPANFWMALGGKAPYANTKRLQEENLVITPRLFECSNKTGRFLATEIPDFNQDDLEEDDVFLLDVWDQVFFWIGKHANEEEKKAAATTAQEYLKTHPSGRDPETPIIVVKQGHEPPTFTGWFLAWDPFKWSNTKSYEDLKAELGNSRDWSQITAEVTSPKVDVFNANSNLSSGPLPIFPLEQLVNKPVEELPEGVDPSRKEEHLSIEDFTQAFGMTPAAFSALPRWKQQNLKKEKGLF

SEQ ID NO: 96691 - protein, 213 aa, Homo sapiens
  Payload ID: 19285
  Gene Name: villin 1
  ENSP ID: ENSP00000394030
GAERKGGGLGLRLGLQGSQASQDEITASAYQAVILDQKYNGEPVQIRVPMGKEPPHLMSIFKGRMVVYQGGTSRTNNLETGPSTRLFQVQGTGANNTKAFEVPARANFLNSNDVFVLKTQSCCYLWCGKGCSGDEREMAKMVADTISRTEKQVVVEGQEPANFWMALGGKAPYANTKRLQEENLVITPRLFECSNKTGRFLATEIPDFNQDDL

SEQ ID NO: 96692 - protein, 421 aa, Homo sapiens
  Payload ID: 19285
  Gene Name: villin 1
  Uniprot ID: P09327
  ENSP ID: ENSP00000409270
MTKLSAQVKGSLNITTPGLQIWRIEAMQMVPVPSSTFGSFFDGDCYIILAIHKTASSLSYDIHYWIGQDSSLDEQGAAAIYTTQMDDFLKGRAVQHREVQGNESEAFRGYFKQGLVIRKGGVASGMKHVETNSYDVQRLLHVKGKRNVVAGEVEMSWKSFNRGDVFLLDLGKLIIQWNGPESTRMERLRGMTLAKEIRDQERGGRTYVGVVDGENELASPKLMEVMNHVLGKRRELKAAVPDTVVEPALKAALKLYHVSDSEGNLVVREVATRPLTQDLLSHEDCYILDQGGLKIYVWKGKKANEQEKKGAMSHALNFIKAKQYPPSTQVEVQNDGAESAVFQQLFQKWTASNRTSGLGKTHTVGSVGEGQAGAVREPGSRSWARRATWSTTHPPSLTCIFNEDFYAGSGLVLADGDVDKL

SEQ ID NO: 96693 - protein, 157 aa, Homo sapiens
  Payload ID: 19285
  Gene Name: villin 1
  ENSP ID: ENSP00000412657
MTKLSAQVKGSLNITTPGLQIWRIEAMQMVPVPSSTFGSFFDGDCYIILAIHKTASSLSYDIHYWIGQDSSLDEQGAAAIYTTQMDDFLKGRAVQHREVQGNESEAFRGYFKIRKGGVASGMKHVETNSYDVQRLLHVKGKRNVVAGEVEMSWKSFN

SEQ ID NO: 96694 - protein, 856 aa, Homo sapiens
  Payload ID: 19286
  Gene Name: villin-like
  Uniprot ID: O15195
  ENSP ID: ENSP00000283713
MDISKGLPGMQGGLHIWISENRKMVPVPEGAYGNFFEEHCYVILHVPQSPKATQGASSDLHYWVGKQAGAEAQGAAEAFQQRLQDELGGQTVLHREAQGHESDCFCSYFRPGIIYRKGGLASDLKHVETNLFNIQRLLHIKGRKHVSATEVELSWNSFNKGDIFLLDLGKMMIQWNGPKTSISEKARGLALTYSLRDRERGGGRAQIGVVDDEAKAPDLMQIMEAVLGRRVGSLRAATPSKDINQLQKANVRLYHVYEKGKDLVVLELATPPLTQDLLQEEDFYILDQGGFKIYVWQGRMSSLQERKAAFSRAVGFIQAKGYPTYTNVEVVNDGAESAAFKQLFRTWSEKRRRNQKLGGRDKSIHVKLDVGKLHTQPKLAAQLRMVDDGSGKVEVWCIQDLHRQPVDPKRHGQLCAGNCYLVLYTYQRLGRVQYILYLWQGHQATADEIEALNSNAEELDVMYGGVLVQEHVTMGSEPPHFLAIFQGQLVIFQERAGHHGKGQSASTTRLFQVQGTDSHNTRTMEVPARASSLNSSDIFLLVTASVCYLWFGKGCNGDQREMARVVVTVISRKNEETVLEGQEPPHFWEALGGRAPYPSNKRLPEEVPSFQPRLFECSSHMGCLVLAEVGFFSQEDLDKYDIMLLDTWQEIFLWLGEAASEWKEAVAWGQEYLKTHPAGRSPATPIVLVKQGHEPPTFIGWFFTWDPYKWTSHPSHKEVVDGSPAAASTISEITAEVNNLRLSRWPGNGRAGAVALQALKGSQDSSENDLVRSPKSAGSRTSSSVSSTSATINGGLRREQLMHQAVEDLPEGVDPARREFYLSDSDFQDIFGKSKEEFYSMATWRQRQEKKQLGFF

SEQ ID NO: 96695 - protein, 856 aa, Homo sapiens; identical to SEQ ID NO: 96694
  Payload ID: 19286
  Gene Name: villin-like
  Uniprot ID: O15195
  ENSP ID: ENSP00000373266

SEQ ID NO: 96696 - protein, 101 aa, Homo sapiens
  Payload ID: 19286
  Gene Name: villin-like
  ENSP ID: ENSP00000387659
  MOD_RES (1)..(1): Any amino acid
XMSSLQERKAAFSRAVGFIQAKGYPTYTNVEVVNDGAESAAFKQLFRTWSEKRRRNQKLGGRDKSIHVKLDVGKLHTQPKLAAQLRMVDDGSGKVEGLPGI

SEQ ID NO: 96697 - protein, 130 aa, Homo sapiens
  Payload ID: 19286
  Gene Name: villin-like
  ENSP ID: ENSP00000393661
MDISKGLPGMQGGLHIWISENRKMVPVPEGAYGNFFEEHCYVILHVPQSPKATQGASSDLHYWVGKQAGAEAQGAAEAFQQRLQDELGGQTVLHREAQGHESDCFCSYFRPGIIYRKGGLASDLKHVETN

SEQ ID NO: 96698 - protein, 574 aa, Homo sapiens
  Payload ID: 19286
  Gene Name: villin-like
  ENSP ID: ENSP00000422096
MALGTSSPSPPAPPSSPQHIYTNTRTLGPPEPEGHAGGGYPTYTNVEVVNDGAESAAFKQLFRTWSEKRRRNQKLGGRDKSIHVKLDVGKLHTQPKLAAQLRMVDDGSGKVEVWCIQDLHRQPVDPKRHGQLCAGNCYLVLYTYQRLGRVQYILYLWQGHQATADEIEALNSNAEELDVMYGGVLVQEHVTMGSEPPHFLAIFQGQLVIFQERAGHHGKGQSASTTRLFQVQGTDSHNTRTMEVPARASSLNSSDIFLLVTASVCYLWFGKGCNGDQREMARVVVTVISRKNEETVLEGQEPPHFWEALGGRAPYPSNKRLPEEVPSFQPRLFECSSHMGCLVLAEVGFFSQEDLDKYDIMLLDTWQEIFLWLGEAASEWKEAVAWGQEYLKTHPAGRSPATPIVLVKQGHEPPTFIGWFFTWDPYKWTSHPSHKEVVDGSPAAASTISEITAEVNNLRLSRWPGNGRAGAVALQALKGSQDSSENDLVRSPKSAGSRTSSSVSSTSATINGGLRREQLMHQAVEDLPEGVDPARREFYLSDSDFQDIFGKSKEEFYSMATWRQRQEKKQLGFF

SEQ ID NO: 96699 - protein, 187 aa, Homo sapiens
  Payload ID: 19286
  Gene Name: villin-like
  ENSP ID: ENSP00000427355
MDISKGLPGMQGGLHIWISENRKMVPVPEGAYGNFFEEHCYVILHVPQSPKATQGASSDLHYWVGKQAGAEAQGAAEAFQQRLQDELGGQTVLHREAQGHESDCFCSYFRPGIIYRKGGLASDLKHVETNLFNIQRLLHIKGRKHVSATEVELSWNSFNKGDIFLLDLGKMMIQWNGPKTSISEKAR

SEQ ID NO: 96700 - protein, 466 aa, Homo sapiens
  Payload ID: 19287
  Gene Name: vimentin
  Uniprot ID: P08670
  ENSP ID: ENSP00000224237
MSTRSVSSSSYRRMFGGPGTASRPSSSRSYVTTSTRTYSLGSALRPSTSRSLYASSPGGVYATRSSAVRLRSSVPGVRLLQDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRISLPLPNFSSLNLRETNLDSLPLVDTHSKRTLLIKTVETRDGQVINETSQHHDDLE

SEQ ID NO: 96701 - protein, 173 aa, Homo sapiens
  Payload ID: 19287
  Gene Name: vimentin
  ENSP ID: ENSP00000391842
GFLVPLWLMRNCFRLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTVSTNPAVKEGK

SEQ ID NO: 96702 - protein, 228 aa, Homo sapiens
  Payload ID: 19287
  Gene Name: vimentin
  ENSP ID: ENSP00000431702
MRNCFRLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESR

SEQ ID NO: 96703 - protein, 431 aa, Homo sapiens
  Payload ID: 19287
  Gene Name: vimentin
  ENSP ID: ENSP00000435613
MSTRSVSSSSYRRMFGGPGTASRPSSSRSYVTTSTRTYSLGSALRPSTSRSLYASSPGGVYATRSSAVRLRSSVPGVRLLQDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRISLPLPNFSSLNLRGKHFISL

SEQ ID NO: 96704 - protein, 466 aa, Homo sapiens; identical to SEQ ID NO: 96700
  Payload ID: 19287
  Gene Name: vimentin
  Uniprot ID: P08670
  ENSP ID: ENSP00000446007

SEQ ID NO: 96705 - protein, 169 aa, Homo sapiens
  Payload ID: 19288
  Gene Name: vimentin-type intermediate filament associated coiled-coil protein
  Uniprot ID: Q2NL98
  ENSP ID: ENSP00000343348
MSAPPALQIREANAHLAAVHRRAAELEARLDAAERTVHAQAERLALHDQQLRAALDELGRAKDREIATLQEQLMTSEATVHSLQATVHQRDELIRQLQPRAELLQDICRRRPPLAGLLDALAEAERLGPLPASDPGHPPPGGPGPPLDNSTGEEADRDHLQPAVFGTTV

SEQ ID NO: 96706 - protein, 1134 aa, Homo sapiens
  Payload ID: 19289
  Gene Name: vinculin
  Uniprot ID: P18206
  ENSP ID: ENSP00000211998
MPVFHTRTIESILEPVAQQISHLVIMHEEGEVDGKAIPDLTAPVAAVQAAVSNLVRVGKETVQTTEDQILKRDMPPAFIKVENACTKLVQAAQMLQSDPYSVPARDYLIDGSRGILSGTSDLLLTFDEAEVRKIIRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKERREILGTCKMLGQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVFDERAANFENHSGKLGATAEKAAAVGTANKSTVEGIQASVKTARELTPQVVSAARILLRNPGNQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKPGIPAAEVGIGVVAEADAADAAGFPVPPDMEDDYEPELLLMPSNQPVNQPILAAAQSLHREATKWSSKGNDIIAAAKRMALLMAEMSRLVRGGSGTKRALIQCAKDIAKASDEVTRLAKEVAKQCTDKRIRTNLLQVCERIPTISTQLKILSTVKATMLGRTNISDEESEQATEMLVHNAQNLMQSVKETVREAEAASIKIRTDAGFTLRWVRKTPWYQ

SEQ ID NO: 96707 - protein, 1066 aa, Homo sapiens
  Payload ID: 19289
  Gene Name: vinculin
  Uniprot ID: P18206
  ENSP ID: ENSP00000361841
MPVFHTRTIESILEPVAQQISHLVIMHEEGEVDGKAIPDLTAPVAAVQAAVSNLVRVGKETVQTTEDQILKRDMPPAFIKVENACTKLVQAAQMLQSDPYSVPARDYLIDGSRGILSGTSDLLLTFDEAEVRKIIRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKERREILGTCKMLGQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVFDERAANFENHSGKLGATAEKAAAVGTANKSTVEGIQASVKTARELTPQVVSAARILLRNPGNQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKGNDIIAAAKRMALLMAEMSRLVRGGSGTKRALIQCAKDIAKASDEVTRLAKEVAKQCTDKRIRTNLLQVCERIPTISTQLKILSTVKATMLGRTNISDEESEQATEMLVHNAQNLMQSVKETVREAEAASIKIRTDAGFTLRWVRKTPWYQ

SEQ ID NO: 96708 - protein, 806 aa, Homo sapiens
  Payload ID: 19289
  Gene Name: vinculin
  ENSP ID: ENSP00000415489
GQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVFDERAANFENHSGKLGATAEKAAAVGTANKSTVEGIQASVKTARELTPQVVSAARILLRNPGNQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKPGIPAAEVGIGVVAEADAADAAGFPVPPDMEDDYEPELLLMPSNQPVNQPILAAAQSLHREATKWSSKGNDIIAAAKRMALLMAEMSRLVRGGSGTKRALIQCAKDIAKASDEVTRLAKEVAKQCTDKRIRTNLLQVCERIPTISTQLKILSTVKATMLGRTNISDEESEQATEMLVHNAQNLMQSVKETVREAEAASIKIRTDAGFTLRWVRKTPWYQ

SEQ ID NO: 96709 - protein, 57 aa, Homo sapiens
  Payload ID: 19289
  Gene Name: vinculin
  ENSP ID: ENSP00000485551
MPVFHTRTIESILEPVAQQISHLVIMHEEGEVDGKAIPDLTAPVAAVQAAVSNLVRG

SEQ ID NO: 96710 - protein, 191 aa, Homo sapiens
  Payload ID: 19290
  Gene Name: visinin-like 1
  Uniprot ID: P62760
  ENSP ID: ENSP00000295156
MGKQNSKLAPEVMEDLVKSTEFNEHELKQWYKGFLKDCPSGRLNLEEFQQLYVKFFPYGDASKFAQHAFRTFDKNGDGTIDFREFICALSITSRGSFEQKLNWAFNMYDLDGDGKITRVEMLEIIEAIYKMVGTVIMMKMNEDGLTPEQRVDKIFSKMDKNKDDQITLDEFKEAAKSDPSIVLLLQCDIQK

SEQ ID NO: 96711 - protein, 191 aa, Homo sapiens; identical to SEQ ID NO: 96710
  Payload ID: 19290
  Gene Name: visinin-like 1
  Uniprot ID: P62760
  ENSP ID: ENSP00000384014

SEQ ID NO: 96712 - protein, 191 aa, Homo sapiens; identical to SEQ ID NO: 96710
  Payload ID: 19290
  Gene Name: visinin-like 1
  Uniprot ID: P62760
  ENSP ID: ENSP00000384719

SEQ ID NO: 96713 - protein, 104 aa, Homo sapiens
  Payload ID: 19290
  Gene Name: visinin-like 1
  ENSP ID: ENSP00000390124
MGKQNSKLAPEVMEDLVKSTEFNEHELKQWYKGFLKDCPSGRLNLEEFQQLYVKFFPYGDASKFAQHAFRTFDKNGDGTIDFREFICALSITSRGSFEQKLNWA

SEQ ID NO: 96714 - protein, 118 aa, Homo sapiens
  Payload ID: 19290
  Gene Name: visinin-like 1
  ENSP ID: ENSP00000405511
MGKQNSKLAPEVMEDLVKSTEFNEHELKQWYKGFLKDCPSGRLNLEEFQQLYVKFFPYGDASKFAQHAFRTFDKNGDGTIDFREFICALSITSRGSFEQKLNWAFNMYDLDGDGKITR

SEQ ID NO: 96715 - protein, 239 aa, Homo sapiens
  Payload ID: 19291
  Gene Name: visual system homeobox 1
  Uniprot ID: Q9NZR4
  ENSP ID: ENSP00000365897
MTGRDSLSDGRTSSRALVPGGSPRGSRPRGFAITDLLGLEAELPAPAGPGQGSGCEGPAVAPCPGPGLDGSSLARGALPLGLGLLCGFGTQPPAAARAPCLLLADVPFLPPRGPEPAAPLAPSRPPPALGRQKRSDSVSTSDEDSQSEDRNDLKASPTLGKRKKRRHRTVFTAHQLEELEKAFSEAHYPDVYAREMLAVKTELPEDRIQVSGVPFLRSKDTTENVSFPHSVSQSAVPSL

SEQ ID NO: 96716 - protein, 365 aa, Homo sapiens
  Payload ID: 19291
  Gene Name: visual system homeobox 1
  Uniprot ID: Q9NZR4
  ENSP ID: ENSP00000365899
MTGRDSLSDGRTSSRALVPGGSPRGSRPRGFAITDLLGLEAELPAPAGPGQGSGCEGPAVAPCPGPGLDGSSLARGALPLGLGLLCGFGTQPPAAARAPCLLLADVPFLPPRGPEPAAPLAPSRPPPALGRQKRSDSVSTSDEDSQSEDRNDLKASPTLGKRKKRRHRTVFTAHQLEELEKAFSEAHYPDVYAREMLAVKTELPEDRIQVWFQNRRAKWRKREKRWGGSSVMAEYGLYGAMVRHCIPLPDSVLNSAEGGLLGSCAPWLLGMHKKSMGMIRKPGSEDKLAGLWGSDHFKEGSSQSESGSQRGSDKVSPENGLEDVAIDLSSSARQETKKVHPGAGAQGGSNSTALEGPQPGKVGAT

SEQ ID NO: 96717 - protein, 280 aa, Homo sapiens
  Payload ID: 19291
  Gene Name: visual system homeobox 1
  Uniprot ID: Q9NZR4
  ENSP ID: ENSP00000386612
MTGRDSLSDGRTSSRALVPGGSPRGSRPRGFAITDLLGLEAELPAPAGPGQGSGCEGPAVAPCPGPGLDGSSLARGALPLGLGLLCGFGTQPPAAARAPCLLLADVPFLPPRGPEPAAPLAPSRPPPALGRQKRSDSVSTSDEDSQSEDRNDLKASPTLGKRKKRRHRTVFTAHQLEELEKAFSEAHYPDVYAREMLAVKTELPEDRIQVWFQNRRAKWRKREKRWGGSSVMAEYGLYGAMVRHCIPLPDSVLNSAEGGLLGSCAPWLLEGETLGCREMK

SEQ ID NO: 96718 - protein, 218 aa, Homo sapiens
  Payload ID: 19291
  Gene Name: visual system homeobox 1
  Uniprot ID: Q9NZR4
  ENSP ID: ENSP00000387069
MTGRDSLSDGRTSSRALVPGGSPRGSRPRGFAITDLLGLEAELPAPAGPGQGSGCEGPAVAPCPGPGLDGSSLARGALPLGLGLLCGFGTQPPAAARAPCLLLADVPFLPPRGPEPAAPLAPSRPPPALGRQKRSDSVSTSDEDSQSEDRNDLKASPTLGKRKKRRHRTVFTAHQLEELEKAFSEAHYPDVYAREMLAVKTELPEDRIQRVRHWAAEK

SEQ ID NO: 96719 - protein, 236 aa, Homo sapiens
  Payload ID: 19291
  Gene Name: visual system homeobox 1
  Uniprot ID: Q9NZR4
  ENSP ID: ENSP00000387720
MTGRDSLSDGRTSSRALVPGGSPRGSRPRGFAITDLLGLEAELPAPAGPGQGSGCEGPAVAPCPGPGLDGSSLARGALPLGLGLLCGFGTQPPAAARAPCLLLADVPFLPPRGPEPAAPLAPSRPPPALGRQKRSDSVSTSDEDSQSEDRNDLKASPTLGKRKKRRHRTVFTAHQLEELEKAFSEAHYPDVYAREMLAVKTELPEDRIQCKLLLLEAPVHWTLQETHRLPRPRGGA

SEQ ID NO: 96720 - protein, 301 aa, Homo sapiens
  Payload ID: 19291
  Gene Name: visual system homeobox 1
  Uniprot ID: Q9NZR4
  ENSP ID: ENSP00000401690
MTGRDSLSDGRTSSRALVPGGSPRGSRPRGFAITDLLGLEAELPAPAGPGQGSGCEGPAVAPCPGPGLDGSSLARGALPLGLGLLCGFGTQPPAAARAPCLLLADVPFLPPRGPEPAAPLAPSRPPPALGRQKRSDSVSTSDEDSQSEDRNDLKASPTLGKRKKRRHRTVFTAHQLEELEKAFSEAHYPDVYAREMLAVKTELPEDRIQVWFQNRRAKWRKREKRWGGSSVMAEYGLYGAMVRHCIPLPDSVLNSAEGGLLGSCAPWLLVQTSAPGGSRSLDFAGDTQAPQTPWWCLMTFS

SEQ ID NO: 96721 - protein, 361 aa, Homo sapiens
  Payload ID: 19292
  Gene Name: visual system homeobox 2
  Uniprot ID: P58304
  ENSP ID: ENSP00000261980
MTGKAGEALSKPKSETVAKSTSGGAPARCTGFGIQEILGLNKEPPSSHPRAALDGLAPGHLLAARSVLSPAGVGGMGLLGPGGLPGFYTQPTFLEVLSDPQSVHLQPLGRASGPLDTSQTASSDSEDVSSSDRKMSKSALNQTKKRKKRRHRTIFTSYQLEELEKAFNEAHYPDVYAREMLAMKTELPEDRIQVWFQNRRAKWRKREKCWGRSSVMAEYGLYGAMVRHSIPLPESILKSAKDGIMDSCAPWLLGMHKKSLEAAAESGRKPEGERQALPKLDKMEQDERGPDAQAAISQEELRENSIAVLRAKAQEHSTKVLGTVSGPDSLARSTEKPEEEEAMDEDRPAERLSPPQLEDMA

SEQ ID NO: 96722 - protein, 427 aa, Homo sapiens
  Payload ID: 19293
  Gene Name: vitamin D (1,25- dihydroxyvitamin D3) receptor
  Uniprot ID: P11473
  ENSP ID: ENSP00000229022
MEAMAASTSLPDPGDFDRNVPRICGVCGDRATGFHFNAMTCEGCKGFFRRSMKRKALFTCPFNGDCRITKDNRRHCQACRLKRCVDIGMMKEFILTDEEVQRKREMILKRKEEEALKDSLRPKLSEEQQRIIAILLDAHHKTYDPTYSDFCQFRPPVRVNDGGGSHPSRPNSRHTPSFSGDSSSSCSDHCITSSDMMDSSSFSNLDLSEEDSDDPSVTLELSQLSMLPHLADLVSYSIQKVIGFAKMIPGFRDLTSEDQIVLLKSSAIEVIMLRSNESFTMDDMSWTCGNQDYKYRVSDVTKAGHSLELIEPLIKFQVGLKKLNLHEEEHVLLMAICIVSPDRPGVQDAALIEAIQDRLSNTLQTYIRCRHPPPGSHLLYAKMIQKLADLRSLNEEHSKQYRCLSFQPECSMKLTPLVLEVFGNEIS

SEQ ID NO: 96723 - protein, 427 aa, Homo sapiens; identical to SEQ ID NO: 96722
  Payload ID: 19293
  Gene Name: vitamin D (1,25- dihydroxyvitamin D3) receptor
  Uniprot ID: P11473
  ENSP ID: ENSP00000378734

SEQ ID NO: 96724 - protein, 477 aa, Homo sapiens
  Payload ID: 19293
  Gene Name: vitamin D (1,25- dihydroxyvitamin D3) receptor
  Uniprot ID: P11473
  ENSP ID: ENSP00000447173
MEWRNKKRSDWLSMVLRTAGVEEAFGSEVSVRPHRRAPLGSTYLPPAPSGMEAMAASTSLPDPGDFDRNVPRICGVCGDRATGFHFNAMTCEGCKGFFRRSMKRKALFTCPFNGDCRITKDNRRHCQACRLKRCVDIGMMKEFILTDEEVQRKREMILKRKEEEALKDSLRPKLSEEQQRIIAILLDAHHKTYDPTYSDFCQFRPPVRVNDGGGSHPSRPNSRHTPSFSGDSSSSCSDHCITSSDMMDSSSFSNLDLSEEDSDDPSVTLELSQLSMLPHLADLVSYSIQKVIGFAKMIPGFRDLTSEDQIVLLKSSAIEVIMLRSNESFTMDDMSWTCGNQDYKYRVSDVTKAGHSLELIEPLIKFQVGLKKLNLHEEEHVLLMAICIVSPDRPGVQDAALIEAIQDRLSNTLQTYIRCRHPPPGSHLLYAKMIQKLADLRSLNEEHSKQYRCLSFQPECSMKLTPLVLEVFGNEIS

SEQ ID NO: 96725 - protein, 250 aa, Homo sapiens
  Payload ID: 19293
  Gene Name: vitamin D (1,25- dihydroxyvitamin D3) receptor
  ENSP ID: ENSP00000448659
MEAMAASTSLPDPGDFDRNVPRICGVCGDRATGFHFNAMTCEGCKGFFRRSMKRKALFTCPFNGDCRITKDNRRHCQACRLKRCVDIGMMKEFILTDEEVQRKREMILKRKEEEALKDSLRPKLSEEQQRIIAILLDAHHKTYDPTYSDFCQFRPPVRVNDGGGSHPSRPNSRHTPSFSGDSSSSCSDHCITSSDMMDSSSFSNLDLSEEDSDDPSVTLELSQLSMLPHLADLVSYSIQKVIGFAKMIPG

SEQ ID NO: 96726 - protein, 49 aa, Homo sapiens
  Payload ID: 19293
  Gene Name: vitamin D (1,25- dihydroxyvitamin D3) receptor
  ENSP ID: ENSP00000449074
MEAMAASTSLPDPGDFDRNVPRICGVCGDRATGFHFNAMTCEGCKGFFR

SEQ ID NO: 96727 - protein, 106 aa, Homo sapiens
  Payload ID: 19293
  Gene Name: vitamin D (1,25- dihydroxyvitamin D3) receptor
  ENSP ID: ENSP00000449561
MEAMAASTSLPDPGDFDRNVPRICGVCGDRATGFHFNAMTCEGCKGFFRRSMKRKALFTCPFNGDCRITKDNRRHCQACRLKRCVDIGMMKEFILTDEEVQRKREM

SEQ ID NO: 96728 - protein, 427 aa, Homo sapiens; identical to SEQ ID NO: 96722
  Payload ID: 19293
  Gene Name: vitamin D (1,25- dihydroxyvitamin D3) receptor
  Uniprot ID: P11473
  ENSP ID: ENSP00000449573

SEQ ID NO: 96729 - protein, 101 aa, Homo sapiens
  Payload ID: 19293
  Gene Name: vitamin D (1,25- dihydroxyvitamin D3) receptor
  ENSP ID: ENSP00000450105
MEAMAASTSLPDPGDFDRNVPRICGVCGDRATGFHFNAMTCEGCKGFFRRSMKRKALFTCPFNGDCRITKDNRRHCQACRLKRCVDIGMMKEFILTDEEVQ

SEQ ID NO: 96730 - protein, 149 aa, Homo sapiens
  Payload ID: 19294
  Gene Name: vitamin K epoxide reductase complex, subunit 1
  ENSP ID: ENSP00000300851
MGSTWGSPGWVRLALCLTGLVLSLYALHVKAARARDRDYRALCDVGTAISCSRVFSSRVQGTGLTVLTWFHPTPPLCQVGQGFRAGGACAGTGQHPQSIQQHIRLHLLHTTAIVRLPADTLGLCPDAAELPGVSRWFCLPGLDPVLRAL

SEQ ID NO: 96731 - protein, 156 aa, Homo sapiens
  Payload ID: 19294
  Gene Name: vitamin K epoxide reductase complex, subunit 1
  Uniprot ID: Q9BQB6
  ENSP ID: ENSP00000326135
MGSTWGSPGWVRLALCLTGLVLSLYALHVKAARARDRDYRALCDVGTAISCSRVFSSRWGRGFGLVEHVLGQDSILNQSNSIFGCIFYTLQLLLDGVSPCCPGWSQAICLPQPPKVLGGLQALPADTLGLCPDAAELPGVSRWFCLPGLDPVLRAL

SEQ ID NO: 96732 - protein, 92 aa, Homo sapiens
  Payload ID: 19294
  Gene Name: vitamin K epoxide reductase complex, subunit 1
  Uniprot ID: Q9BQB6
  ENSP ID: ENSP00000346969
MGSTWGSPGWVRLALCLTGLVLSLYALHVKAARARDRDYRALCDVGTAISCSRVFSSRLPADTLGLCPDAAELPGVSRWFCLPGLDPVLRAL

SEQ ID NO: 96733 - protein, 160 aa, Homo sapiens
  Payload ID: 19294
  Gene Name: vitamin K epoxide reductase complex, subunit 1
  ENSP ID: ENSP00000378422
MIILESGIGVPGERTRGWTARGVVAQGLSYPAILVFEIRVRGKGPDSAGDWDYSGDSHVNWMPRNNGDQERRGGRMAVEIDDGLKDGAQVGQGFRAGGACAGTGQHPQSIQQHIRLHLLHTTAIVRLPADTLGLCPDAAELPGVSRWFCLPGLDPVLRAL

SEQ ID NO: 96734 - protein, 163 aa, Homo sapiens
  Payload ID: 19294
  Gene Name: vitamin K epoxide reductase complex, subunit 1
  Uniprot ID: Q9BQB6
  ENSP ID: ENSP00000378426
MGSTWGSPGWVRLALCLTGLVLSLYALHVKAARARDRDYRALCDVGTAISCSRVFSSRWGRGFGLVEHVLGQDSILNQSNSIFGCIFYTLQLLLGCLRTRWASVLMLLSSLVSLAGSVYLAWILFFVLYDFCIVCITTYAINVSLMWLSFRKVQEPQGKAKRH

SEQ ID NO: 96735 - protein, 161 aa, Homo sapiens
  Payload ID: 19294
  Gene Name: vitamin K epoxide reductase complex, subunit 1
  ENSP ID: ENSP00000417662
MIVERLGYCQGCVWPKEWFCECMGERETDHQEALVRQDPGGWEAAARMVPEIVSGEMLGSRIGSPYSLDPLIRWSLGPGCCNSYNRTWHRVGQGFRAGGACAGTGQHPQSIQQHIRLHLLHTTAIVRLPADTLGLCPDAAELPGVSRWFCLPGLDPVLRAL

SEQ ID NO: 96736 - protein, 92 aa, Homo sapiens
  Payload ID: 19294
  Gene Name: vitamin K epoxide reductase complex, subunit 1
  ENSP ID: ENSP00000437064
  MOD_RES (1)..(1): Any amino acid
XQGCVWPKEWFCECMGERETDHQEALVRQDPGGWEAAARMVPEIVSGEMLGSRIGSPYSLDPLIRWSLGPGCCNSYNRTWHRVACGHAGPLS

SEQ ID NO: 96737 - protein, 43 aa, Homo sapiens
  Payload ID: 19294
  Gene Name: vitamin K epoxide reductase complex, subunit 1
  ENSP ID: ENSP00000458994
MLLSSLVSLAGSVYLAWILFFVLYDFCIVCITTYAINVSLMWL

SEQ ID NO: 96738 - protein, 176 aa, Homo sapiens
  Payload ID: 19295
  Gene Name: vitamin K epoxide reductase complex, subunit 1-like 1
  Uniprot ID: Q8N0U8
  ENSP ID: ENSP00000353998
MAAPVLLRVSVPRWERVARYAVCAAGILLSIYAYHVEREKERDPEHRALCDLGPWVKCSAALASRWGRGFGLLGSIFGKDGVLNQPNSVFGLIFYILQLLLGMTASAVAALILMTSSIMSVVGSLYLAYILYFVLKEFCIICIVTYVLNFLLLIINYKRLVYLNEAWKRQLQPKQD

SEQ ID NO: 96739 - protein, 177 aa, Homo sapiens
  Payload ID: 19295
  Gene Name: vitamin K epoxide reductase complex, subunit 1-like 1
  Uniprot ID: Q8N0U8
  ENSP ID: ENSP00000403077
MAAPVLLRVSVPRWERVARYAVCAAGILLSIYAYHVEREKERDPEHRALCDLGPWVKCSAALASRHDSKRCGGFDPHDVLHHVGRGVPVPGLHSVLCAEGVLHHLHRHVRAELPSSHYQLQTTSLLERGLEAAAATQAGLTPDRLHPNSLKPLSIQFILQQVFIIIIIIIIHNRHFP

SEQ ID NO: 96740 - protein, 202 aa, Homo sapiens
  Payload ID: 19296
  Gene Name: vitelline membrane outer layer 1 homolog (chicken)
  Uniprot ID: Q7Z5L0
  ENSP ID: ENSP00000328397
MERGAGAKLLPLLLLLRATGFTCAQTDGRNGYTAVIEVTSGGPWGDWAWPEMCPDGFFASGFSLKVEPPQGIPGDDTALNGIRLHCARGNVLGNTHVVESQSGSWGEWSEPLWCRGGAYLVAFSLRVEAPTTLGDNTAANNVRFRCSDGEELQGPGLSWGDFGDWSDHCPKGACGLQTKIQGPRGLGDDTALNDARLFCCRS

SEQ ID NO: 96741 - protein, 70 aa, Homo sapiens
  Payload ID: 19296
  Gene Name: vitelline membrane outer layer 1 homolog (chicken)
  Uniprot ID: Q7Z5L0
  ENSP ID: ENSP00000346133
MERGAGAKLLPLLLLLRATGFTCAQTDGRNGYTAVIEVTSGGPWGDWAWPEMCPDGFFASGFSLKLGRME

SEQ ID NO: 96742 - protein, 102 aa, Homo sapiens
  Payload ID: 19296
  Gene Name: vitelline membrane outer layer 1 homolog (chicken)
  Uniprot ID: Q7Z5L0
  ENSP ID: ENSP00000390450
MERGAGAKLLPLLLLLRATGFTCAQTDGRNGYTAVIEVTSGGPWGDWAWPEMCPDGFFASGFSLKVEPPQGIPGDDTALNGIRLHCARGNVLGNTHVLGRME

SEQ ID NO: 96743 - protein, 114 aa, Homo sapiens
  Payload ID: 19296
  Gene Name: vitelline membrane outer layer 1 homolog (chicken)
  Uniprot ID: Q7Z5L0
  ENSP ID: ENSP00000408166
MERGAGAKLLPLLLLLRATGFTCAQTDGRNGYTAVIEVTSGGPWGDWAWPEMCPDGFFASGFSLKVEPPQGIPGDDTALNGIRLHCARGNVLGNTHVVESQSGRWGAGVEDPLG

SEQ ID NO: 96744 - protein, 656 aa, Homo sapiens
  Payload ID: 19297
  Gene Name: vitrin
  Uniprot ID: Q6UXI7
  ENSP ID: ENSP00000368543
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMDLWSTATYTSSQNRPRADPGLVPKEELSTQSLEPVSLGDPNCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 96745 - protein, 693 aa, Homo sapiens
  Payload ID: 19297
  Gene Name: vitrin
  Uniprot ID: Q6UXI7
  ENSP ID: ENSP00000368544
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMDLWSTATYTSSQNRPRADPGIQRQDPSGAAFQKPVGADVSLGEMDSWKPGSVLLDEGLVPKEELSTQSLEPVSLGDPNCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 96746 - protein, 678 aa, Homo sapiens
  Payload ID: 19297
  Gene Name: vitrin
  Uniprot ID: Q6UXI7
  ENSP ID: ENSP00000374625
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMDLWSTATYTSSQNRPRADPGIQRQDPSGAAFQKPVGADVSLGLVPKEELSTQSLEPVSLGDPNCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 96747 - protein, 630 aa, Homo sapiens
  Payload ID: 19297
  Gene Name: vitrin
  ENSP ID: ENSP00000384154
MRTVVLTMKASVIEMFLAVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMGEMDSWKPGSVLLDEGLVPKEELSTQSLEPVSLGDPNCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 96748 - protein, 657 aa, Homo sapiens
  Payload ID: 19297
  Gene Name: vitrin
  Uniprot ID: Q6UXI7
  ENSP ID: ENSP00000385658
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMDLWSTATYTSSQNRPRADPGIQRQDPSGAAFQKPVGADVSLDCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 96749 - protein, 203 aa, Homo sapiens
  Payload ID: 19297
  Gene Name: vitrin
  Uniprot ID: Q6UXI7
  ENSP ID: ENSP00000393561
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGKCSRVIESKPSESMNTRRVLGDSGEINILTGQAPLALAIF

SEQ ID NO: 96750 - protein, 347 aa, Homo sapiens
  Payload ID: 19297
  Gene Name: vitrin
  ENSP ID: ENSP00000417874
MGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 96751 - protein, 134 aa, Homo sapiens
  Payload ID: 19297
  Gene Name: vitrin
  ENSP ID: ENSP00000419251
  MOD_RES (1)..(1): Any amino acid
XTSSQNRPRADPGIQRQDPSGAAFQKPVGADVSLGLVPKEELSTQSLEPVSLGDPNCKIDLSFLIDGSTSIGKRRFRIQKQLLADVAQALDIGPAGPLMGVVQYGPLHWYWKNSPGNGEEWVGRETAPISQLST

SEQ ID NO: 96752 - protein, 478 aa, Homo sapiens
  Payload ID: 19298
  Gene Name: vitronectin
  Uniprot ID: P04004
  ENSP ID: ENSP00000226218
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRATWLSLFSSEESNLGANNYDDYRMDWLVPATCEPIQSVFFFSGDKYYRVNLRTRRVDTVDPPYPRSIAQYWLGCPAPGHL

SEQ ID NO: 96753 - protein, 118 aa, Homo sapiens
  Payload ID: 19298
  Gene Name: vitronectin
  ENSP ID: ENSP00000440439
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKP

SEQ ID NO: 96754 - protein, 976 aa, Homo sapiens [sequence omitted]

SEQ ID NO: 96755 - protein, 972 aa, Homo sapiens
  Payload ID: 19299
  Gene Name: v-kit Hardy-Zuckerman 4 feline sarcoma viral oncogene homolog
  Uniprot ID: P10721
  ENSP ID: ENSP00000390987
MRGARGAWDFLCVLLLLLRVQTGSSQPSVSPGEPSPPSIHPGKSDLIVRVGDEIRLLCTDPGFVKWTFEILDETNENKQNEWITEKAEATNTGKYTCTNKHGLSNSIYVFVRDPAKLFLVDRSLYGKEDNDTLVRCPLTDPEVTNYSLKGCQGKPLPKDLRFIPDPKAGIMIKSVKRAYHRLCLHCSVDQEGKSVLSEKFILKVRPAFKAVPVVSVSKASYLLREGEEFTVTCTIKDVSSSVYSTWKRENSQTKLQEKYNSWHHGDFNYERQATLTISSARVNDSGVFMCYANNTFGSANVTTTLEVVDKGFINIFPMINTTVFVNDGENVDLIVEYEAFPKPEHQQWIYMNRTFTDKWEDYPKSENESNIRYVSELHLTRLKGTEGGTYTFLVSNSDVNAAIAFNVYVNTKPEILTYDRLVNGMLQCVAAGFPEPTIDWYFCPGTEQRCSASVLPVDVQTLNSSGPPFGKLVVQSSIDSSAFKHNGTVECKAYNDVGKTSAYFNFAFKEQIHPHTLFTPLLIGFVIVAGMMCIIVMILTYKYLQKPMYEVQWKVVEEINGNNYVYIDPTQLPYDHKWEFPRNRLSFGKTLGAGAFGKVVEATAYGLIKSDAAMTVAVKMLKPSAHLTEREALMSELKVLSYLGNHMNIVNLLGACTIGGPTLVITEYCCYGDLLNFLRRKRDSFICSKQEDHAEAALYKNLLHSKESSCSDSTNEYMDMKPGVSYVVPTKADKRRSVRIGSYIERDVTPAIMEDDELALDLEDLLSFSYQVAKGMAFLASKNCIHRDLAARNILLTHGRITKICDFGLARDIKNDSNYVVKGNARLPVKWMAPESIFNCVYTFESDVWSYGIFLWELFSLGSSPYPGMPVDSKFYKMIKEGFRMLSPEHAPAEMYDIMKTCWDADPLKRPTFKQIVQLIEKQISESTNHIYSNLANCSPNRQKPVVDHSVRINSVGSTASSSQPLLVHDDV

SEQ ID NO: 96756 - protein, 101 aa, Homo sapiens
  Payload ID: 19300
  Gene Name: VMA21 vacuolar H+-ATPase homolog (S. cerevisiae)
  Uniprot ID: Q3ZAQ7
  ENSP ID: ENSP00000333255
MERPDKAALNALQPPEFRNESSLASTLKTLLFFTALMITVPIGLYFTTKSYIFEGALGMSNRDSYFYAAIVAVVAVHVVLALFVYVAWNEGSRQWREGKQD

SEQ ID NO: 96757 - protein, 156 aa, Homo sapiens
  Payload ID: 19300
  Gene Name: VMA21 vacuolar H+-ATPase homolog (S. cerevisiae)
  Uniprot ID: Q3ZAQ7
  ENSP ID: ENSP00000359386
MLGSPCGPQLSDRDADEDQCSREFRGRRSRRPPRRTMLRGKSRLNVEWLGYSPGLLLEHRPLLAGRTPRSHRRNESSLASTLKTLLFFTALMITVPIGLYFTTKSYIFEGALGMSNRDSYFYAAIVAVVAVHVVLALFVYVAWNEGSRQWREGKQD

SEQ ID NO: 96758 - protein, 403 aa, Homo sapiens
  Payload ID: 19301
  Gene Name: v-maf avian musculoaponeurotic fibrosarcoma oncogene homolog
  Uniprot ID: O75444
  ENSP ID: ENSP00000327048
MASELAMSNSDLPTSPLAMEYVNDFDLMKFEVKKEPVETDRIISQCGRLIAGGSLSSTPMSTPCSSVPPSPSFSAPSPGSGSEQKAHLEDYYWMTGYPQQLNPEALGFSPEDAVEALISNSHQLQGGFDGYARGAQQLAAAAGAGAGASLGGSGEEMGPAAAVVSAVIAAAAAQSGAGPHYHHHHHHAAGHHHHPTAGAPGAAGSAAASAGGAGGAGGGGPASAGGGGGGGGGGGGGGAAGAGGALHPHHAAGGLHFDDRFSDEQLVTMSVRELNRQLRGVSKEEVIRLKQKRRTLKNRGYAQSCRFKRVQQRHVLESEKNQLLQQVDHLKQEISRLVRERDAYKEKYEKLVSSGFRENGSSSDNPSSPEFFITEPTRKLEPSVGYATFWKPQHRVLTSVFTK

SEQ ID NO: 96759 - protein, 373 aa, Homo sapiens
  Payload ID: 19301
  Gene Name: v-maf avian musculoaponeurotic fibrosarcoma oncogene homolog
  Uniprot ID: O75444
  ENSP ID: ENSP00000377019
MASELAMSNSDLPTSPLAMEYVNDFDLMKFEVKKEPVETDRIISQCGRLIAGGSLSSTPMSTPCSSVPPSPSFSAPSPGSGSEQKAHLEDYYWMTGYPQQLNPEALGFSPEDAVEALISNSHQLQGGFDGYARGAQQLAAAAGAGAGASLGGSGEEMGPAAAVVSAVIAAAAAQSGAGPHYHHHHHHAAGHHHHPTAGAPGAAGSAAASAGGAGGAGGGGPASAGGGGGGGGGGGGGGAAGAGGALHPHHAAGGLHFDDRFSDEQLVTMSVRELNRQLRGVSKEEVIRLKQKRRTLKNRGYAQSCRFKRVQQRHVLESEKNQLLQQVDHLKQEISRLVRERDAYKEKYEKLVSSGFRENGSSSDNPSSPEFFM

SEQ ID NO: 96760 - protein, 383 aa, Homo sapiens
  Payload ID: 19301
  Gene Name: v-maf avian musculoaponeurotic fibrosarcoma oncogene homolog
  ENSP ID: ENSP00000455097
MASELAMSNSDLPTSPLAMEYVNDFDLMKFEVKKEPVETDRIISQCGRLIAGGSLSSTPMSTPCSSVPPSPSFSAPSPGSGSEQKAHLEDYYWMTGYPQQLNPEALGFSPEDAVEALISNSHQLQGGFDGYARGAQQLAAAAGAGAGASLGGSGEEMGPAAAVVSAVIAAAAAQSGAGPHYHHHHHHAAGHHHHPTAGAPGAAGSAAASAGGAGGAGGGGPASAGGGGGGGGGGGGGGAAGAGGALHPHHAAGGLHFDDRFSDEQLVTMSVRELNRQLRGVSKEEVIRLKQKRRTLKNRGYAQSCRFKRVQQRHVLESEKNQLLQQVDHLKQEISRLVRERDAYKEKYEKLVSSGFRENGSSSDNPSSPEFFMYPRESSTSVM

SEQ ID NO: 96761 - protein, 353 aa, Homo sapiens
  Payload ID: 19302
  Gene Name: v-maf avian musculoaponeurotic fibrosarcoma oncogene homolog A
  Uniprot ID: Q8NHW3
  ENSP ID: ENSP00000328364
MAAELAMGAELPSSPLAIEYVNDFDLMKFEVKKEPPEAERFCHRLPPGSLSSTPLSTPCSSVPSSPSFCAPSPGTGGGGGAGGGGGSSQAGGAPGPPSGGPGAVGGTSGKPALEDLYWMSGYQHHLNPEALNLTPEDAVEALIGSGHHGAHHGAHHPAAAAAYEAFRGPGFAGGGGADDMGAGHHHGAHHAAHHHHAAHHHHHHHHHHGGAGHGGGAGHHVRLEERFSDDQLVSMSVRELNRQLRGFSKEEVIRLKQKRRTLKNRGYAQSCRFKRVQQRHILESEKCQLQSQVEQLKLEVGRLAKERDLYKEKYEKLAGRGGPGSAGGAGFPREPSPPQAGPGGAKGTADFFL

SEQ ID NO: 96762 - protein, 323 aa, Homo sapiens
  Payload ID: 19303
  Gene Name: v-maf avian musculoaponeurotic fibrosarcoma oncogene homolog B
  Uniprot ID: Q9Y5Q3
  ENSP ID: ENSP00000362410
MAAELSMGPELPTSPLAMEYVNDFDLLKFDVKKEPLGRAERPGRPCTRLQPAGSVSSTPLSTPCSSVPSSPSFSPTEQKTHLEDLYWMASNYQQMNPEALNLTPEDAVEALIGSHPVPQPLQSFDSFRGAHHHHHHHHPHPHHAYPGAGVAHDELGPHAHPHHHHHHQASPPPSSAASPAQQLPTSHPGPGPHATASATAAGGNGSVEDRFSDDQLVSMSVRELNRHLRGFTKDEVIRLKQKRRTLKNRGYAQSCRYKRVQQKHHLENEKTQLIQQVEQLKQEVSRLARERDAYKVKCEKLANSGFREAGSTSDSPSSPEFFL

SEQ ID NO: 96763 - protein, 164 aa, Homo sapiens
  Payload ID: 19304
  Gene Name: v-maf avian musculoaponeurotic fibrosarcoma oncogene homolog F
  Uniprot ID: Q9ULX9
  ENSP ID: ENSP00000345393
MSVDPLSSKALKIKRELSENTPHLSDEALMGLSVRELNRHLRGLSAEEVTRLKQRRRTLKNRGYAASCRVKRVCQKEELQKQKSELEREVDKLARENAAMRLELDALRGKCEALQGFARSVAAARGPATLVAPASVITIVKSTPGSGSGPAHGPDPAHGPASCS

SEQ ID NO: 96764 - protein, 164 aa, Homo sapiens; identical to SEQ ID NO: 96763
  Payload ID: 19304
  Gene Name: v-maf avian musculoaponeurotic fibrosarcoma oncogene homolog F
  Uniprot ID: Q9ULX9
  ENSP ID: ENSP00000384094

SEQ ID NO: 96765 - protein, 164 aa, Homo sapiens; identical to SEQ ID NO: 96763
  Payload ID: 19304
  Gene Name: v-maf avian musculoaponeurotic fibrosarcoma oncogene homolog F
  Uniprot ID: Q9ULX9
  ENSP ID: ENSP00000388882

SEQ ID NO: 96766 - protein, 93 aa, Homo sapiens
  Payload ID: 19304
  Gene Name: v-maf avian musculoaponeurotic fibrosarcoma oncogene homolog F
  ENSP ID: ENSP00000391589
MGLSVRELNRHLRGLSAEEVTRLKQRRRTLKNRGYAASCRVKRVCQKEELQKQKSELEREVDKLARENAAMRLELDALRGKCEALQGFARSVA

SEQ ID NO: 96767 - protein, 125 aa, Homo sapiens
  Payload ID: 19304
  Gene Name: v-maf avian musculoaponeurotic fibrosarcoma oncogene homolog F
  ENSP ID: ENSP00000416493
MSVDPLSSKALKIKRELSENTPHLSDEALMGLSVRELNRHLRGLSAEEVTRLKQRRRTLKNRGYAASCRVKRVCQKEELQKQKSELEREVDKLARENAAMRLELDALRGKCEALQGFARSVAAAR

SEQ ID NO: 96768 - protein, 135 aa, Homo sapiens
  Payload ID: 19304
  Gene Name: v-maf avian musculoaponeurotic fibrosarcoma oncogene homolog F
  Uniprot ID: Q9ULX9
  ENSP ID: ENSP00000441482
MGLSVRELNRHLRGLSAEEVTRLKQRRRTLKNRGYAASCRVKRVCQKEELQKQKSELEREVDKLARENAAMRLELDALRGKCEALQGFARSVAAARGPATLVAPASVITIVKSTPGSGSGPAHGPDPAHGPASCS

SEQ ID NO: 96769 - protein, 164 aa, Homo sapiens; identical to SEQ ID NO: 96763
  Payload ID: 19304
  Gene Name: v-maf avian musculoaponeurotic fibrosarcoma oncogene homolog F
  Uniprot ID: Q9ULX9
  ENSP ID: ENSP00000442060

SEQ ID NO: 96770 - protein, 162 aa, Homo sapiens
  Payload ID: 19305
  Gene Name: v-maf avian musculoaponeurotic fibrosarcoma oncogene homolog G
  Uniprot ID: O15525
  ENSP ID: ENSP00000350369
MTTPNKGNKALKVKREPGENGTSLTDEELVTMSVRELNQHLRGLSKEEIVQLKQRRRTLKNRGYAASCRVKRVTQKEELEKQKAELQQEVEKLASENASMKLELDALRSKYEALQTFARTVARSPVAPARGPLAAGLGPLVPGKVAATSVITIVKSKTDARS

SEQ ID NO: 96771 - protein, 162 aa, Homo sapiens; identical to SEQ ID NO: 96770
  Payload ID: 19305
  Gene Name: v-maf avian musculoaponeurotic fibrosarcoma oncogene homolog G
  Uniprot ID: O15525
  ENSP ID: ENSP00000376173

SEQ ID NO: 96772 - protein, 98 aa, Homo sapiens
  Payload ID: 19305
  Gene Name: v-maf avian musculoaponeurotic fibrosarcoma oncogene homolog G
  ENSP ID: ENSP00000459634
MTTPNKGNKALKVKREPGENGTSLTDEELVTMSVRELNQHLRGLSKEEIVQLKQRRRTLKNRGYAASCRVKRVTQKEELEKQKAELQQEVEKLASENA

SEQ ID NO: 96773 - protein, 156 aa, Homo sapiens
  Payload ID: 19306
  Gene Name: v-maf avian musculoaponeurotic fibrosarcoma oncogene homolog K
  Uniprot ID: O60675
  ENSP ID: ENSP00000344903
MTTNPKPNKALKVKKEAGENAPVLSDDELVSMSVRELNQHLRGLTKEEVTRLKQRRRTLKNRGYAASCRIKRVTQKEELERQRVELQQEVEKLARENSSMRLELDALRSKYEALQTFARTVARGPVAPSKVATTSVITIVKSTELSSTSVPFSAAS

SEQ ID NO: 96774 - protein, 156 aa, Homo sapiens; identical to SEQ ID NO: 96773
  Payload ID: 19306
  Gene Name: v-maf avian musculoaponeurotic fibrosarcoma oncogene homolog K
  Uniprot ID: O60675
  ENSP ID: ENSP00000385437

SEQ ID NO: 96775 - protein, 156 aa, Homo sapiens; identical to SEQ ID NO: 96773
  Payload ID: 19306
  Gene Name: v-maf avian musculoaponeurotic fibrosarcoma oncogene homolog K
  Uniprot ID: O60675
  ENSP ID: ENSP00000386009

SEQ ID NO: 96776 - protein, 346 aa, Homo sapiens
  Payload ID: 19307
  Gene Name: v-mos Moloney murine sarcoma viral oncogene homolog
  Uniprot ID: P00540
  ENSP ID: ENSP00000310722
MPSPLALRPYLRSEFSPSVDARPCSSPSELPAKLLLGATLPRAPRLPRRLAWCSIDWEQVCLLQRLGAGGFGSVYKATYRGVPVAIKQVNKCTKNRLASRRSFWAELNVARLRHDNIVRVVAASTRTPAGSNSLGTIIMEFGGNVTLHQVIYGAAGHPEGDAGEPHCRTGGQLSLGKCLKYSLDVVNGLLFLHSQSIVHLDLKPANILISEQDVCKISDFGCSEKLEDLLCFQTPSYPLGGTYTHRAPELLKGEGVTPKADIYSFAITLWQMTTKQAPYSGERQHILYAVVAYDLRPSLSAAVFEDSLPGQRLGDVIQRCWRPSAAQRPSARLLLVDLTSLKAELG

SEQ ID NO: 96777 - protein, 726 aa, Homo sapiens [sequence omitted]

SEQ ID NO: 96778 - protein, 761 aa, Homo sapiens
  Payload ID: 19308
  Gene Name: v-myb avian myeloblastosis viral oncogene homolog
  Uniprot ID: P10242
  ENSP ID: ENSP00000339992
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQPCSSTWEPASCGKMEEQMTSSSQARKYVNAFSARTLVM

SEQ ID NO: 96779 - protein, 449 aa, Homo sapiens
  Payload ID: 19308
  Gene Name: v-myb avian myeloblastosis viral oncogene homolog
  ENSP ID: ENSP00000341050
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTV

SEQ ID NO: 96780 - protein, 666 aa, Homo sapiens
  Payload ID: 19308
  Gene Name: v-myb avian myeloblastosis viral oncogene homolog
  Uniprot ID: P10242
  ENSP ID: ENSP00000356786
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPTGVQWHDFGSLQPLPPGFKRFSCLSLPRSWDYRHPPPRPANFEFLVETGFLHVGQAGLELLTSGDLPASASQSARITGVSHRARPEYSYKLRFNGTSIRR

SEQ ID NO: 96781 - protein, 640 aa, Homo sapiens
  Payload ID: 19308
  Gene Name: v-myb avian myeloblastosis viral oncogene homolog
  Uniprot ID: P10242
  ENSP ID: ENSP00000356788
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQPCSSTWEPASCGKMEEQMTSSSQARKYVNAFSARTLVM

SEQ ID NO: 96782 - protein, 277 aa, Homo sapiens
  Payload ID: 19308
  Gene Name: v-myb avian myeloblastosis viral oncogene homolog
  ENSP ID: ENSP00000390460
EDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPVRLSSCA

SEQ ID NO: 96783 - protein, 299 aa, Homo sapiens
  Payload ID: 19308
  Gene Name: v-myb avian myeloblastosis viral oncogene homolog
  ENSP ID: ENSP00000403387
MARRPRHSIYSSDEDDEDFEMCDHDYDGLLPKSGKRHLGKTRWTREENRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPVRLSSCA

SEQ ID NO: 96784 - protein, 637 aa, Homo sapiens
  Payload ID: 19308
  Gene Name: v-myb avian myeloblastosis viral oncogene homolog
  Uniprot ID: P10242
  ENSP ID: ENSP00000410825
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQPCSSTWEPASCGKMEEQMTSSSQARKYVNAFSARTLVM

SEQ ID NO: 96785 - protein, 554 aa, Homo sapiens
  Payload ID: 19308
  Gene Name: v-myb avian myeloblastosis viral oncogene homolog
  ENSP ID: ENSP00000413011
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTV

SEQ ID NO: 96786 - protein, 86 aa, Homo sapiens
  Payload ID: 19308
  Gene Name: v-myb avian myeloblastosis viral oncogene homolog
  ENSP ID: ENSP00000432042
TQNHTCSYPGWHSTTIADHTRPHGDSAPVSCLGEHHSTPSLPADPGSLPEESASPARCMIVHQGTILDNVKNLLEFAETLQFIDSM

SEQ ID NO: 96787 - protein, 388 aa, Homo sapiens
  Payload ID: 19308
  Gene Name: v-myb avian myeloblastosis viral oncogene homolog
  ENSP ID: ENSP00000432168
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCRVSGGPCSTSEGQP

SEQ ID NO: 96788 - protein, 402 aa, Homo sapiens
  Payload ID: 19308
  Gene Name: v-myb avian myeloblastosis viral oncogene homolog
  Uniprot ID: P10242
  ENSP ID: ENSP00000432811
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSM

SEQ ID NO: 96789 - protein, 745 aa, Homo sapiens
  Payload ID: 19308
  Gene Name: v-myb avian myeloblastosis viral oncogene homolog
  Uniprot ID: P10242
  ENSP ID: ENSP00000432851
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQPCSSTWEPASCGKMEEQMTSSSQARKYVNAFSARTLVM

SEQ ID NO: 96790 - protein, 388 aa, Homo sapiens; identical to SEQ ID NO: 96787
  Payload ID: 19308
  Gene Name: v-myb avian myeloblastosis viral oncogene homolog
  ENSP ID: ENSP00000432877

SEQ ID NO: 96791 - protein, 374 aa, Homo sapiens
  Payload ID: 19308
  Gene Name: v-myb avian myeloblastosis viral oncogene homolog
  ENSP ID: ENSP00000432948
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPASS

SEQ ID NO: 96792 - protein, 611 aa, Homo sapiens
  Payload ID: 19308
  Gene Name: v-myb avian myeloblastosis viral oncogene homolog
  ENSP ID: ENSP00000433227
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQVITIPTLVF

SEQ ID NO: 96793 - protein, 446 aa, Homo sapiens
  Payload ID: 19308
  Gene Name: v-myb avian myeloblastosis viral oncogene homolog
  ENSP ID: ENSP00000433458
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTV

SEQ ID NO: 96794 - protein, 581 aa, Homo sapiens
  Payload ID: 19308
  Gene Name: v-myb avian myeloblastosis viral oncogene homolog
  ENSP ID: ENSP00000433745
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVNTQPFGSNKLRILPPLFLVCSLMCLPLALCNTTTFRARFSYKVQRKGTARL

SEQ ID NO: 96795 - protein, 385 aa, Homo sapiens
  Payload ID: 19308
  Gene Name: v-myb avian myeloblastosis viral oncogene homolog
  ENSP ID: ENSP00000433844
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQTQNHTCSYPGWHSTTIADHTRPHGDSAPVSCLGEHHSTPSLPADPGSLPEESASPARCRVSGGPCSTSEGQP

SEQ ID NO: 96796 - protein, 581 aa, Homo sapiens
  Payload ID: 19308
  Gene Name: v-myb avian myeloblastosis viral oncogene homolog
  ENSP ID: ENSP00000434420
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVNTQPFGSNKLRILPPLFLVCSLMCLPLALCNTTTFRARFSYKVQRKGGISN

SEQ ID NO: 96797 - protein, 402 aa, Homo sapiens; identical to SEQ ID NO: 96788
  Payload ID: 19308
  Gene Name: v-myb avian myeloblastosis viral oncogene homolog
  Uniprot ID: P10242
  ENSP ID: ENSP00000434639

SEQ ID NO: 96798 - protein, 79 aa, Homo sapiens
  Payload ID: 19308
  Gene Name: v-myb avian myeloblastosis viral oncogene homolog
  ENSP ID: ENSP00000434675
MARRPRHSIYSSDEDDEDFEMCDHDYDGLLPKSGKRHLGKTRWTREENRTDVQCQHRWQKVLNPELIKGPWTKEEDQRN

SEQ ID NO: 96799 - protein, 758 aa, Homo sapiens
  Payload ID: 19308
  Gene Name: v-myb avian myeloblastosis viral oncogene homolog
  Uniprot ID: P10242
  ENSP ID: ENSP00000434723
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQPCSSTWEPASCGKMEEQMTSSSQARKYVNAFSARTLVM

SEQ ID NO: 96800 - protein, 419 aa, Homo sapiens
  Payload ID: 19308
  Gene Name: v-myb avian myeloblastosis viral oncogene homolog
  ENSP ID: ENSP00000434795
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQTQNHTCSYPGWHSTTIADHTRPHGDSAPVSCLGEHHSTPSLPADPGSLPEESASPARILHHGVISAVLNSLKKQIFHLANITQAKPYSFSKERAMGLNLQENLAQG

SEQ ID NO: 96801 - protein, 422 aa, Homo sapiens
  Payload ID: 19308
  Gene Name: v-myb avian myeloblastosis viral oncogene homolog
  ENSP ID: ENSP00000434816
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARILHHGVISAVLNSLKKQIFHLANITQAKPYSFSKERAMGLNLQENLAQG

SEQ ID NO: 96802 - protein, 374 aa, Homo sapiens; identical to SEQ ID NO: 96791
  Payload ID: 19308
  Gene Name: v-myb avian myeloblastosis viral oncogene homolog
  ENSP ID: ENSP00000434917

SEQ ID NO: 96803 - protein, 603 aa, Homo sapiens
  Payload ID: 19308
  Gene Name: v-myb avian myeloblastosis viral oncogene homolog
  Uniprot ID: P10242
  ENSP ID: ENSP00000435055
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQENILTSSVLMAPASEDEDNVLKAFTVPKNRSLASPLQPCSSTWEPASCGKMEEQMTSSSQARKYVNAFSARTLVM

SEQ ID NO: 96804 - protein, 402 aa, Homo sapiens; identical to SEQ ID NO: 96788
  Payload ID: 19308
  Gene Name: v-myb avian myeloblastosis viral oncogene homolog
  Uniprot ID: P10242
  ENSP ID: ENSP00000435293

SEQ ID NO: 96805 - protein, 326 aa, Homo sapiens
  Payload ID: 19308
  Gene Name: v-myb avian myeloblastosis viral oncogene homolog
  ENSP ID: ENSP00000435497
MARRPRHSIYSSDEDDEDFEMCDHDYDGLLPKSGKRHLGKTRWTREENRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPLCGPLLNSDIFSDWAANWDGSLCFATYIVNQQRQ

SEQ ID NO: 96806 - protein, 350 aa, Homo sapiens
  Payload ID: 19308
  Gene Name: v-myb avian myeloblastosis viral oncogene homolog
  Uniprot ID: P10242
  ENSP ID: ENSP00000435578
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPLCGPLLNSDIFSDWAANWDGSLCFATYIVNQQRQ

SEQ ID NO: 96807 - protein, 364 aa, Homo sapiens
  Payload ID: 19308
  Gene Name: v-myb avian myeloblastosis viral oncogene homolog
  ENSP ID: ENSP00000435595
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPFLNTSSNHENSDLEMPSLTSTPLIGHKLTVTTPFHRDQTVKTQKENTV

SEQ ID NO: 96808 - protein, 555 aa, Homo sapiens
  Payload ID: 19308
  Gene Name: v-myb avian myeloblastosis viral oncogene homolog
  Uniprot ID: P10242
  ENSP ID: ENSP00000435938
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQPCSSTWEPASCGKMEEQMTSSSQARKYVNAFSARTLVM

SEQ ID NO: 96809 - protein, 347 aa, Homo sapiens
  Payload ID: 19308
  Gene Name: v-myb avian myeloblastosis viral oncogene homolog
  ENSP ID: ENSP00000436385
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQLCGPLLNSDIFSDWAANWDGSLCFATYIVNQQRQ

SEQ ID NO: 96810 - protein, 347 aa, Homo sapiens; identical to SEQ ID NO: 96809
  Payload ID: 19308
  Gene Name: v-myb avian myeloblastosis viral oncogene homolog
  ENSP ID: ENSP00000436602

SEQ ID NO: 96811 - protein, 605 aa, Homo sapiens
  Payload ID: 19308
  Gene Name: v-myb avian myeloblastosis viral oncogene homolog
  Uniprot ID: P10242
  ENSP ID: ENSP00000436605
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQPCSSTWEPASCGKMEEQMTSSSQARKYVNAFSARTLVM

SEQ ID NO: 96812 - protein, 103 aa, Homo sapiens
  Payload ID: 19308
  Gene Name: v-myb avian myeloblastosis viral oncogene homolog
  ENSP ID: ENSP00000436925
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRN

SEQ ID NO: 96813 - protein, 350 aa, Homo sapiens; identical to SEQ ID NO: 96806
  Payload ID: 19308
  Gene Name: v-myb avian myeloblastosis viral oncogene homolog
  Uniprot ID: P10242
  ENSP ID: ENSP00000437081

SEQ ID NO: 96814 - protein, 350 aa, Homo sapiens; identical to SEQ ID NO: 96806
  Payload ID: 19308
  Gene Name: v-myb avian myeloblastosis viral oncogene homolog
  Uniprot ID: P10242
  ENSP ID: ENSP00000437264

SEQ ID NO: 96815 - protein, 660 aa, Homo sapiens
  Payload ID: 19308
  Gene Name: v-myb avian myeloblastosis viral oncogene homolog
  ENSP ID: ENSP00000477898
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPTGVQWHDFGSLQPLPPGFKRFSCLSLPRSWDYRHPPPRPANFEFLVETGFLHVGQAGLELLTSGDLPASASQSARITGVSHRARPGGIFLQAPF

SEQ ID NO: 96816 - protein, 612 aa, Homo sapiens
  Payload ID: 19308
  Gene Name: v-myb avian myeloblastosis viral oncogene homolog
  ENSP ID: ENSP00000479896
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQATKAQRLFQF

SEQ ID NO: 96817 - protein, 692 aa, Homo sapiens
  Payload ID: 19309
  Gene Name: v-myb avian myeloblastosis viral oncogene homolog-like 1
  Uniprot ID: P10243
  ENSP ID: ENSP00000428011
MAKRSRSEDEDDDLQYADHDYEVPQQKGLKKLWNRVKWTRDEDDKLKKLVEQHGTDDWTLIASHLQNRSDFQCQHRWQKVLNPELIKGPWTKEEDQRVIELVQKYGPKRWSLIAKHLKGRIGKQCRERWHNHLNPEVKKSSWTEEEDRIIYEAHKRLGNRWAEIAKLLPGRTDNSIKNHWNSTMRRKVEQEGYLQDGIKSERSSSKLQHKPCAAMDHMQTQNQFYIPVQIPGYQYVSPEGNCIEHVQPTSAFIQQPFIDEDPDKEKKIKELEMLLMSAENEVRRKRIPSQPGSFSSWSGSFLMDDNMSNTLNSLDEHTSEFYSMDENQPVSAQQNSPTKFLAVEANAVLSSLQTIPEFAETLELIESDPVAWSDVTSFDISDAAASPIKSTPVKLMRIQHNEGAMECQFNVSLVLEGKKNTCNGGNSEAVPLTSPNIAKFSTPPAILRKKRKMRVGHSPGSELRDGSLNDGGNMALKHTPLKTLPFSPSQFFNTCPGNEQLNIENPSFTSTPICGQKALITTPLHKETTPKDQKENVGFRTPTIRRSILGTTPRTPTPFKNALAAQEKKYGPLKIVSQPLAFLEEDIREVLKEETGTDLFLKEEDEPAYKSCKQENTASGKKVRKSLVLDNWEKEESGTQLLTEDISDMQSNCEWETVVYGKTEDQLIMTEQARRYLSTYTATSSTSRALIL

SEQ ID NO: 96818 - protein, 410 aa, Homo sapiens
  Payload ID: 19309
  Gene Name: v-myb avian myeloblastosis viral oncogene homolog-like 1
  ENSP ID: ENSP00000428265
MAKRSRSEDEDDDLQYADHDYEVPQQKGLKKLWNRVKWTRDEDDKLKKLVEQHGTDDWTLIASHLQNRSDFQCQHRWQKVLNPELIKGPWTKEEDQRVIELVQKYGKKRKMRVGHSPGSELRDGSLNDGGNMALKHTPLKTLPFSPSQFFNTCPGNEQLNIENPSFTSTPICGQKALITTPLHKETTPKDQKENVGFRTPTIRRSILGTTPRTPTPFKNALAAQEKKYGPLKIVSQPLAFLEEDIREVLKEETGTDLFLKEEDEPAYKSCKQENTASGKKVRKSLVLDNWEKEESGTQLLTEDISDMQSENRFTTSLLMIPLLEIHDNRCNLIPEKQDINSTNKTYTLTKKKPNPNTSKVVKLEKNLQSNCEWETVVYGKTEDQLIMTEQARRYLSTYTATSSTSRALIL

SEQ ID NO: 96819 - protein, 752 aa, Homo sapiens
  Payload ID: 19309
  Gene Name: v-myb avian myeloblastosis viral oncogene homolog-like 1
  Uniprot ID: P10243
  ENSP ID: ENSP00000429633
MAKRSRSEDEDDDLQYADHDYEVPQQKGLKKLWNRVKWTRDEDDKLKKLVEQHGTDDWTLIASHLQNRSDFQCQHRWQKVLNPELIKGPWTKEEDQRVIELVQKYGPKRWSLIAKHLKGRIGKQCRERWHNHLNPEVKKSSWTEEEDRIIYEAHKRLGNRWAEIAKLLPGRTDNSIKNHWNSTMRRKVEQEGYLQDGIKSERSSSKLQHKPCAAMDHMQTQNQFYIPVQIPGYQYVSPEGNCIEHVQPTSAFIQQPFIDEDPDKEKKIKELEMLLMSAENEVRRKRIPSQPGSFSSWSGSFLMDDNMSNTLNSLDEHTSEFYSMDENQPVSAQQNSPTKFLAVEANAVLSSLQTIPEFAETLELIESDPVAWSDVTSFDISDAAASPIKSTPVKLMRIQHNEGAMECQFNVSLVLEGKKNTCNGGNSEAVPLTSPNIAKFSTPPAILRKKRKMRVGHSPGSELRDGSLNDGGNMALKHTPLKTLPFSPSQFFNTCPGNEQLNIENPSFTSTPICGQKALITTPLHKETTPKDQKENVGFRTPTIRRSILGTTPRTPTPFKNALAAQEKKYGPLKIVSQPLAFLEEDIREVLKEETGTDLFLKEEDEPAYKSCKQENTASGKKVRKSLVLDNWEKEESGTQLLTEDISDMQSENRFTTSLLMIPLLEIHDNRCNLIPEKQDINSTNKTYTLTKKKPNPNTSKVVKLEKNLQSNCEWETVVYGKTEDQLIMTEQARRYLSTYTATSSTSRALIL

SEQ ID NO: 96820 - protein, 700 aa, Homo sapiens
  Payload ID: 19310
  Gene Name: v-myb avian myeloblastosis viral oncogene homolog-like 2
  Uniprot ID: P10244
  ENSP ID: ENSP00000217026
MSRRTRCEDLDELHYQDTDSDVPEQRDSKCKVKWTHEEDEQLRALVRQFGQQDWKFLASHFPNRTDQQCQYRWLRVLNPDLVKGPWTKEEDQKVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 96821 - protein, 676 aa, Homo sapiens
  Payload ID: 19310
  Gene Name: v-myb avian myeloblastosis viral oncogene homolog-like 2
  Uniprot ID: P10244
  ENSP ID: ENSP00000380072
MSRRTRCEDLDELHYQDTDSDVPEQRDSKCKVKWTHEENRTDQQCQYRWLRVLNPDLVKGPWTKEEDQKVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 96822 - protein, 257 aa, Homo sapiens
  Payload ID: 19311
  Gene Name: v-myc avian myelocytomatosis viral oncogene homolog
  ENSP ID: ENSP00000259523
MPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSGGTRR

SEQ ID NO: 96823 - protein, 439 aa, Homo sapiens
  Payload ID: 19311
  Gene Name: v-myc avian myelocytomatosis viral oncogene homolog
  Uniprot ID: P01106
  ENSP ID: ENSP00000367207
MPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 96824 - protein, 184 aa, Homo sapiens
  Payload ID: 19311
  Gene Name: v-myc avian myelocytomatosis viral oncogene homolog
  ENSP ID: ENSP00000429441
LDFFRVVENQPPATMPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSV

SEQ ID NO: 96825 - protein, 59 aa, Homo sapiens
  Payload ID: 19311
  Gene Name: v-myc avian myelocytomatosis viral oncogene homolog
  ENSP ID: ENSP00000430226
MTSTTTRCSRISTATRRRTSTSSSSRASCSPRRPARISGRNSSCCPPRPCPLAAAPGSA

SEQ ID NO: 96826 - protein, 453 aa, Homo sapiens
  Payload ID: 19311
  Gene Name: v-myc avian myelocytomatosis viral oncogene homolog
  ENSP ID: ENSP00000430235
LDFFRVVENQPPATMPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 96827 - protein, 454 aa, Homo sapiens
  Payload ID: 19311
  Gene Name: v-myc avian myelocytomatosis viral oncogene homolog
  ENSP ID: ENSP00000478887
LDFFRVVENQQPPATMPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 96828 - protein, 454 aa, Homo sapiens; identical to SEQ ID NO: 96827
  Payload ID: 19311
  Gene Name: v-myc avian myelocytomatosis viral oncogene homolog
  ENSP ID: ENSP00000479618

SEQ ID NO: 96829 - protein, 236 aa, Homo sapiens
  Payload ID: 19312
  Gene Name: v-myc avian myelocytomatosis viral oncogene lung carcinoma derived homolog
  Uniprot ID: P12524
  ENSP ID: ENSP00000361902
MCVCAGCRAAPSRRGAGPLQVAGGWSEGADMDYDSYQHYFYDYDCGEDFYRSTAPSEDIWKKFELVPSPPTSPPWGLGPGAGDPAPGIGPPEPWPGGCTGDEAESRGHSKGWGRNYASIIRRDCMWSGFSARERLERAVSDRLAPGAPRGNPPKASAAPDCTPSLEAGNPAPAAPCPLGEPKTQACSGSESPSDSGKDLPEPSKRGPPHGWPKLCPCLRSGIGSSQALGPSPPLFG

SEQ ID NO: 96830 - protein, 364 aa, Homo sapiens
  Payload ID: 19312
  Gene Name: v-myc avian myelocytomatosis viral oncogene lung carcinoma derived homolog
  Uniprot ID: P12524
  ENSP ID: ENSP00000361903
MDYDSYQHYFYDYDCGEDFYRSTAPSEDIWKKFELVPSPPTSPPWGLGPGAGDPAPGIGPPEPWPGGCTGDEAESRGHSKGWGRNYASIIRRDCMWSGFSARERLERAVSDRLAPGAPRGNPPKASAAPDCTPSLEAGNPAPAAPCPLGEPKTQACSGSESPSDSENEEIDVVTVEKRQSLGIRKPVTITVRADPLDPCMKHFHISIHQQQHNYAARFPPESCSQEEASERGPQEEVLERDAAGEKEDEEDEEIVSPPPVESEAAQSCHPKPVSSDTEDVTKRKNHNFLERKRRNDLRSRFLALRDQVPTLASCSKAPKVVILSKALEYLQALVGAEKRMATEKRQLRCRQQQLQKRIAYLTGY

SEQ ID NO: 96831 - protein, 394 aa, Homo sapiens
  Payload ID: 19312
  Gene Name: v-myc avian myelocytomatosis viral oncogene lung carcinoma derived homolog
  Uniprot ID: P12524
  ENSP ID: ENSP00000380494
MCVCAGCRAAPSRRGAGPLQVAGGWSEGADMDYDSYQHYFYDYDCGEDFYRSTAPSEDIWKKFELVPSPPTSPPWGLGPGAGDPAPGIGPPEPWPGGCTGDEAESRGHSKGWGRNYASIIRRDCMWSGFSARERLERAVSDRLAPGAPRGNPPKASAAPDCTPSLEAGNPAPAAPCPLGEPKTQACSGSESPSDSENEEIDVVTVEKRQSLGIRKPVTITVRADPLDPCMKHFHISIHQQQHNYAARFPPESCSQEEASERGPQEEVLERDAAGEKEDEEDEEIVSPPPVESEAAQSCHPKPVSSDTEDVTKRKNHNFLERKRRNDLRSRFLALRDQVPTLASCSKAPKVVILSKALEYLQALVGAEKRMATEKRQLRCRQQQLQKRIAYLTGY

SEQ ID NO: 96832 - protein, 100 aa, Homo sapiens
  Payload ID: 19312
  Gene Name: v-myc avian myelocytomatosis viral oncogene lung carcinoma derived homolog
  ENSP ID: ENSP00000434375
MDYDSYQHYFYDYDCGEDFYRSTAPSEDIWKKFELVPSPPTSPPWGLGPGAGDPAPGIGPPEPWPGGCTGDEAESRGHSKGWGRNYASIIRRDCMWSGFS

SEQ ID NO: 96833 - protein, 464 aa, Homo sapiens
  Payload ID: 19313
  Gene Name: v-myc avian myelocytomatosis viral oncogene neuroblastoma derived homolog
  Uniprot ID: P04198
  ENSP ID: ENSP00000281043
MPSCSTSTMPGMICKNPDLEFDSLQPCFYPDEDDFYFGGPDSTPPGEDIWKKFELLPTPPLSPSRGFAEHSSEPPSWVTEMLLENELWGSPAEEDAFGLGGLGGLTPNPVILQDCMWSGFSAREKLERAVSEKLQHGRGPPTAGSTAQSPGAGAASPAGRGHGGAAGAGRAGAALPAELAHPAAECVDPAVVFPFPVNKREPAPVPAAPASAPAAGPAVASGAGIAAPAGAPGVAPPRPGGRQTSGGDHKALSTSGEDTLSDSDDEDDEEEDEEEEIDVVTVEKRRSSSNTKAVTTFTITVRPKNAALGPGRAQSSELILKRCLPIHQQHNYAAPSPYVESEDAPPQKKIKSEASPRPLKSVIPPKAKSLSPRNSDSEDSERRRNHNILERQRRNDLRSSFLTLRDHVPELVKNEKAAKVVILKKATEYVHSLQAEEHQLLLEKEKLQARQQQLLKKIEHARTC

SEQ ID NO: 96834 - protein, 283 aa, Homo sapiens
  Payload ID: 19314
  Gene Name: voltage-dependent anion channel 1
  Uniprot ID: P21796
  ENSP ID: ENSP00000265333
MAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 96835 - protein, 283 aa, Homo sapiens; identical to SEQ ID NO: 96834
  Payload ID: 19314
  Gene Name: voltage-dependent anion channel 1
  Uniprot ID: P21796
  ENSP ID: ENSP00000378484

SEQ ID NO: 96836 - protein, 283 aa, Homo sapiens; identical to SEQ ID NO: 96834
  Payload ID: 19314
  Gene Name: voltage-dependent anion channel 1
  Uniprot ID: P21796
  ENSP ID: ENSP00000378487

SEQ ID NO: 96837 - protein, 183 aa, Homo sapiens
  Payload ID: 19314
  Gene Name: voltage-dependent anion channel 1
  ENSP ID: ENSP00000390129
MAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTN

SEQ ID NO: 96838 - protein, 282 aa, Homo sapiens
  Payload ID: 19315
  Gene Name: voltage-dependent anion channel 2
  ENSP ID: ENSP00000298468
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAG

SEQ ID NO: 96839 - protein, 194 aa, Homo sapiens
  Payload ID: 19315
  Gene Name: voltage-dependent anion channel 2
  ENSP ID: ENSP00000344876
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTN

SEQ ID NO: 96840 - protein, 309 aa, Homo sapiens
  Payload ID: 19315
  Gene Name: voltage-dependent anion channel 2
  Uniprot ID: P45880
  ENSP ID: ENSP00000361635
MSWCNELRLPALKQHSIGRGLESHITMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 96841 - protein, 294 aa, Homo sapiens
  Payload ID: 19315
  Gene Name: voltage-dependent anion channel 2
  Uniprot ID: P45880
  ENSP ID: ENSP00000361686
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 96842 - protein, 109 aa, Homo sapiens
  Payload ID: 19315
  Gene Name: voltage-dependent anion channel 2
  ENSP ID: ENSP00000389551
MSWCNELRLPALKQHSIGRGLESHITMCIPPSYADLGKAARDIFNKGFGFGLVKLDVKTKSCSGVEFSTSGSSNTDTGKVTGTLETKYKWCEYGLTFTEKWNTDNTLGT

SEQ ID NO: 96843 - protein, 204 aa, Homo sapiens
  Payload ID: 19315
  Gene Name: voltage-dependent anion channel 2
  ENSP ID: ENSP00000401492
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGS

SEQ ID NO: 96844 - protein, 294 aa, Homo sapiens; identical to SEQ ID NO: 96841
  Payload ID: 19315
  Gene Name: voltage-dependent anion channel 2
  Uniprot ID: P45880
  ENSP ID: ENSP00000443092

SEQ ID NO: 96845 - protein, 283 aa, Homo sapiens
  Payload ID: 19316
  Gene Name: voltage-dependent anion channel 3
  Uniprot ID: Q9Y277
  ENSP ID: ENSP00000022615
MCNTPTYCDLGKAAKDVFNKGYGFGMVKIDLKTKSCSGVEFSTSGHAYTDTGKASGNLETKYKVCNYGLTFTQKWNTDNTLGTEISWENKLAEGLKLTLDTIFVPNTGKKSGKLKASYKRDCFSVGSNVDIDFSGPTIYGWAVLAFEGWLAGYQMSFDTAKSKLSQNNFALGYKAADFQLHTHVNDGTEFGGSIYQKVNEKIETSINLAWTAGSNNTRFGIAAKYMLDCRTSLSAKVNNASLIGLGYTQTLRPGVKLTLSALIDGKNFSAGGHKVGLGFELEA

SEQ ID NO: 96846 - protein, 134 aa, Homo sapiens
  Payload ID: 19316
  Gene Name: voltage-dependent anion channel 3
  ENSP ID: ENSP00000428029
MCNTPTYCDLGKAAKDVFNKGYGFGMVKIDLKTKSCSGVMEFSTSGHAYTDTGKASGNLETKYKVCNYGLTFTQKWNTDNTLGTEISWENKLAEGLKLTLDTIFVPNTGKKSGKLKASYKRDCFSVGLGFELEA

SEQ ID NO: 96847 - protein, 165 aa, Homo sapiens
  Payload ID: 19316
  Gene Name: voltage-dependent anion channel 3
  ENSP ID: ENSP00000428519
MCNTPTYCDLGKAAKDVFNKGYGFGMVKIDLKTKSCSGVEFSTSGHAYTDTGKASGNLETKYKVCNYGLTFTQKWNTDNTLGTEISWENKLAEGLKLTLDTIFVPNTGKKSGKLKASYKRDCFSVGSNVDIDFSGPTIYGWAVLAFEGWLAGYQMSFDTAKSKLS

SEQ ID NO: 96848 - protein, 284 aa, Homo sapiens
  Payload ID: 19316
  Gene Name: voltage-dependent anion channel 3
  Uniprot ID: Q9Y277
  ENSP ID: ENSP00000428845
MCNTPTYCDLGKAAKDVFNKGYGFGMVKIDLKTKSCSGVMEFSTSGHAYTDTGKASGNLETKYKVCNYGLTFTQKWNTDNTLGTEISWENKLAEGLKLTLDTIFVPNTGKKSGKLKASYKRDCFSVGSNVDIDFSGPTIYGWAVLAFEGWLAGYQMSFDTAKSKLSQNNFALGYKAADFQLHTHVNDGTEFGGSIYQKVNEKIETSINLAWTAGSNNTRFGIAAKYMLDCRTSLSAKVNNASLIGLGYTQTLRPGVKLTLSALIDGKNFSAGGHKVGLGFELEA

SEQ ID NO: 96849 - protein, 108 aa, Homo sapiens
  Payload ID: 19316
  Gene Name: voltage-dependent anion channel 3
  ENSP ID: ENSP00000428977
MSSTKDMEFSTSGHAYTDTGKASGNLETKYKVCNYGLTFTQKWNTDNTLGTEISWENKLAEGLKLTLDTIFVPNTGKKSGKLKASYKRDCFSVGSNVDIDFSGPTIYG

SEQ ID NO: 96850 - protein, 158 aa, Homo sapiens
  Payload ID: 19316
  Gene Name: voltage-dependent anion channel 3
  ENSP ID: ENSP00000429006
MCNTPTYCDLGKAAKDVFNKGYGFGMVKIDLKTKSCSGVEFSTSGHAYTDTGKASGNLETKYKVCNYGLTFTQKWNTDNTLGTEISWENKLAEGLKLTLDTIFVPNTGKKSGKLKASYKRDCFSVGSNVDIDFSGPTIYGWAVLAFEGWLAGYQMSFD

SEQ ID NO: 96851 - protein, 57 aa, Homo sapiens
  Payload ID: 19316
  Gene Name: voltage-dependent anion channel 3
  ENSP ID: ENSP00000430373
MCNTPTYCDLGKAAKDVFNKGYGFGMVKIDLKTKSCSGVLCGNIHSDGIFYFWSCLH

SEQ ID NO: 96852 - protein, 100 aa, Homo sapiens
  Payload ID: 19316
  Gene Name: voltage-dependent anion channel 3
  ENSP ID: ENSP00000430908
MCNTPTYCDLGKAAKDVFNKGYGFGMVKIDLKTKSCSGVEFSTSGHAYTDTGKASGNLETKYKVCNYGLTFTQKWNTDNTLGTEISWENKKEEWEIEGLL

SEQ ID NO: 96853 - protein, 353 aa, Homo sapiens
  Payload ID: 19317
  Gene Name: vomeronasal 1 receptor 1
  Uniprot ID: Q9GZP7
  ENSP ID: ENSP00000322339
MVGDTLKLLSPLMTRYFFLLFYSTDSSDLNENQHPLDFDEMAFGKVKSGISFLIQTGVGILGNSFLLCFYNLILFTGHKLRPTDLILSQLALANSMVLFFKGIPQTMAAFGLKYLLNDTGCKFVFYYHRVGTRVSLSTICLLNGFQAIKLNPSICRWMEIKIRSPRFIDFCCLLCWAPHVLMNASVLLLVNGPLNSKNSSAKNNYGYCSYKASKRFSSLHAVLYFSPDFMSLGFMVWASGSMVFFLYRHKQQVQHNHSNRLSCRPSQEARATHTIMVLVSSFFVFYSVHSFLTIWTTVVANPGQWIVTNSVLVASCFPARSPFVLIMSDTHISQFCFACRTRKTLFPNLVVMP

SEQ ID NO: 96854 - protein, 395 aa, Homo sapiens
  Payload ID: 19318
  Gene Name: vomeronasal 1 receptor 2
  Uniprot ID: Q8NFZ6
  ENSP ID: ENSP00000351244
MTHTLYPTPFALYPINISAAWHLGPLPVSCFVSNKYQCSLAFGATTGLRVLVVVVPQTQLSFLSSLCLVSLFLHSLVSAHGEKPTKPVGLDPTLFQVVVGILGNFSLLYYYMFLYFRGYKPRSTDLILRHLTVADSLVILSKRIPETMATFGLKHFDNYFGCKFLLYAHRVGRGVSIGSTCLLSVFQVITINPRNSRWAEMKVKAPTYIGLSNILCWAFHMLVNAIFPIYTTGKWSNNNITKKGDLGYCSAPLSDEVTKSVYAALTSFHDVLCLGLMLWASSSIVLVLYRHKQQVQHICRNNLYPNSSPGNRAIQSILALVSTFALCYALSFITYVYLALFDNSSWWLVNTAALIIACFPTISPFVLMCRDPSRSRLCSICCRRNRRFFHDFRKM

SEQ ID NO: 96855 - protein, 301 aa, Homo sapiens
  Payload ID: 19319
  Gene Name: vomeronasal 1 receptor 4
  Uniprot ID: Q7Z5H5
  ENSP ID: ENSP00000310856
MASRYVAVGMILSQTVVGVLGSFSVLLHYLSFYCTGCRLRSTDLIVKHLIVANFLALRCKGVPQTMAAFGVRYFLNALGCKLVFYLHRVGRGVSIGTTCLLSVFQVITVSSRKSRWAKLKEKAPKHVGFSVLLCWIVCMLVNIIFPMYVTGKWNYTNITVNEDLGYCSGGGNNKIAQTLRAMLLSFPDVLCLGLMLWVSSSMVCILHRHKQRVQHIDRSNLSPRASPENRATQSILILVSTFVSSYTLSCLFQVCMALLDNPNSLLVNTSALMSVCFPTLSPFVLMSCDPSVYRFCFAWKR

SEQ ID NO: 96856 - protein, 197 aa, Homo sapiens
  Payload ID: 19320
  Gene Name: von Hippel-Lindau binding protein 1
  Uniprot ID: P61758
  ENSP ID: ENSP00000286428
MAAVKDSCGKGEMATGNGRRLHLGIPEAVFVEDVDSFMKQPGNETADTVLKKLDEQYQKYKFMELNLAQKKRRLKGQIPEIKQTLEILKYMQKKKESTNSMETRFLLADNLYCKASVPPTDKVCLWLGANVMLEYDIDEAQALLEKNLSTATKNLDSLEEDLDFLRDQFTTTEVNMARVYNWDVKRRNKDDSTKNKA

SEQ ID NO: 96857 - protein, 192 aa, Homo sapiens
  Payload ID: 19320
  Gene Name: von Hippel-Lindau binding protein 1
  ENSP ID: ENSP00000438694
MAPQPMIHTQQGLRTSSPSTPSPEHQEDVDSFMKQPGNETADTVLKKLDEQYQKYKFMELNLAQKKRRLKGQIPEIKQTLEILKYMQKKKESTNSMETRFLLADNLYCKASVPPTDKVCLWLGANVMLEYDIDEAQALLEKNLSTATKNLDSLEEDLDFLRDQFTTTEVNMARVYNWDVKRRNKDDSTKNKA

SEQ ID NO: 96858 - protein, 192 aa, Homo sapiens; identical to SEQ ID NO: 96857
  Payload ID: 19320
  Gene Name: von Hippel-Lindau binding protein 1
  ENSP ID: ENSP00000486053

SEQ ID NO: 96859 - protein, 213 aa, Homo sapiens
  Payload ID: 19321
  Gene Name: von Hippel-Lindau tumor suppressor, E3 ubiquitin protein ligase
  Uniprot ID: P40337
  ENSP ID: ENSP00000256474
MPRRAENWDEAEVGAEEAGVEEYGPEEDGGEESGAEESGPEESGPEELGAEEEMEAGRPRPVLRSVNSREPSQVIFCNRSPRVVLPVWLNFDGEPQPYPTLPPGTGRRIHSYRGHLWLFRDAGTHDGLLVNQTELFVPSLNVDGQPIFANITLPVYTLKERCLQVVRSLVKPENYRRLDIVRSLYEDLEDHPNVQKDLERLTQERIAHQRMGD

SEQ ID NO: 96860 - protein, 172 aa, Homo sapiens
  Payload ID: 19321
  Gene Name: von Hippel-Lindau tumor suppressor, E3 ubiquitin protein ligase
  Uniprot ID: P40337
  ENSP ID: ENSP00000344757
MPRRAENWDEAEVGAEEAGVEEYGPEEDGGEESGAEESGPEESGPEELGAEEEMEAGRPRPVLRSVNSREPSQVIFCNRSPRVVLPVWLNFDGEPQPYPTLPPGTGRRIHSYRVYTLKERCLQVVRSLVKPENYRRLDIVRSLYEDLEDHPNVQKDLERLTQERIAHQRMGD

SEQ ID NO: 96861 - protein, 139 aa, Homo sapiens
  Payload ID: 19322
  Gene Name: von Hippel-Lindau tumor suppressor-like
  Uniprot ID: Q6RSH7
  ENSP ID: ENSP00000464258
MPWRAGNGVGLEAQAGTQEAGPEEYCQEELGAEEEMAARAAWPVLRSVNSRELSRIIICNHSPRIVLPVWLNYYGKLLPYLTLLPGRDFRIHNFRSHPWLFRDARTHDKLLVNQTELFVPSSNVNGQPVFANITLQCIP

SEQ ID NO: 96862 - protein, 2813 aa, Homo sapiens
  Payload ID: 19323
  Gene Name: von Willebrand factor
  Uniprot ID: P04275
  ENSP ID: ENSP00000261405
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCQDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRITLLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 96863 - protein, 60 aa, Homo sapiens
  Payload ID: 19323
  Gene Name: von Willebrand factor
  ENSP ID: ENSP00000459134
MIPARFAGVLLALALILPETRCLQMPSPVGELRSIKVAQNCPILWGHRMRRKESKTWMDY

SEQ ID NO: 96864 - protein, 60 aa, Homo sapiens; identical to SEQ ID NO: 96863
  Payload ID: 19323
  Gene Name: von Willebrand factor
  ENSP ID: ENSP00000461331

SEQ ID NO: 96865 - protein, 445 aa, Homo sapiens
  Payload ID: 19324
  Gene Name: von Willebrand factor A domain containing 1
  Uniprot ID: Q6PCB0
  ENSP ID: ENSP00000417185
MLPWTALGLALSLRLALARSGAERGPPASAPRGDLMFLLDSSASVSHYEFSRVREFVGQLVAPLPLGTGALRASLVHVGSRPYTEFPFGQHSSGEAAQDAVRASAQRMGDTHTGLALVYAKEQLFAEASGARPGVPKVLVWVTDGGSSDPVGPPMQELKDLGVTVFIVSTGRGNFLELSAAASAPAEKHLHFVDVDDLHIIVQELRGSILDAMRPQQLHATEITSSGFRLAWPPLLTADSGYYVLELVPSAQPGAARRQQLPGNATDWIWAGLDPDTDYDVALVPESNVRLLRPQILRVRTRPGEAGPGASGPESGAGPAPTQLAALPAPEEAGPERIVISHARPRSLRVSWAPALGSAAALGYHVQFGPLRGGEAQRVEVPAGRNCTTLQGLAPGTAYLVTVTAAFRSGRESALSAKACTPDGPRPRPRPVPRAPTPGTASREP

SEQ ID NO: 96866 - protein, 64 aa, Homo sapiens
  Payload ID: 19324
  Gene Name: von Willebrand factor A domain containing 1
  Uniprot ID: Q6PCB0
  ENSP ID: ENSP00000423404
MLPWTALGLALSLRLALARSGAERGAQGPGRHRVHCQHRPRQLPGAVSRCLSPCREAPALCGRG

SEQ ID NO: 96867 - protein, 167 aa, Homo sapiens
  Payload ID: 19324
  Gene Name: von Willebrand factor A domain containing 1
  ENSP ID: ENSP00000463643
MFLLDSSASVSHYEFSRVREFVGQLVAPLPLGTGALRASLVHVGSRPYTEFPFGQHSSGEAAQDAVRASAQRMGDTHTGLALVYAKEQLFAEASGARPGVPKVLVWVTDGGSSDPVGPPMQELKDLGVTVFIVSTGRGNFLELSAAASAPAEKHLHFVDVDDLHIIV

SEQ ID NO: 96868 - protein, 148 aa, Homo sapiens
  Payload ID: 19324
  Gene Name: von Willebrand factor A domain containing 1
  ENSP ID: ENSP00000464343
MLPWTALGLALSLRLALARSGAERGPLGEGKHPLKESWGPGGPCLAVGLSGGPTPEAEHSSFPPGPPASAPRGDLMFLLDSSASVSHYEFSRVREFVGQLVAPLPLGTGALRASLVHVGSRPYTEFPFGQHSSGEAAQDAVRASAQRM

SEQ ID NO: 96869 - protein, 755 aa, Homo sapiens
  Payload ID: 19325
  Gene Name: von Willebrand factor A domain containing 2
  Uniprot ID: Q5GFL6
  ENSP ID: ENSP00000376708
MPPFLLLEAVCVFLFSRVPPSLPLQEVHVSKETIGKISAASKMMWCSAAVDIMFLLDGSNSVGKGSFERSKHFAITVCDGLDISPERVRVGAFQFSSTPHLEFPLDSFSTQQEVKARIKRMVFKGGRTETELALKYLLHRGLPGGRNASVPQILIIVTDGKSQGDVALPSKQLKERGVTVFAVGVRFPRWEELHALASEPRGQHVLLAEQVEDATNGLFSTLSSSAICSSATPDCRVEAHPCEHRTLEMVREFAGNAPCWRGSRRTLAVLAAHCPFYSWKRVFLTHPATCYRTTCPGPCDSQPCQNGGTCVPEGLDGYQCLCPLAFGGEANCALKLSLECRVDLLFLLDSSAGTTLDGFLRAKVFVKRFVRAVLSEDSRARVGVATYSRELLVAVPVGEYQDVPDLVWSLDGIPFRGGPTLTGSALRQAAERGFGSATRTGQDRPRRVVVLLTESHSEDEVAGPARHARARELLLLGVGSEAVRAELEEITGSPKHVMVYSDPQDLFNQIPELQGKLCSRQRPGCRTQALDLVFMLDTSASVGPENFAQMQSFVRSCALQFEVNPDVTQVGLVVYGSQVQTAFGLDTKPTRAAMLRAISQAPYLGGVGSAGTALLHIYDKVMTVQRGARPGVPKAVVVLTGGRGAEDAAVPAQKLRNNGISVLVVGVGPVLSEGLRRLAGPRDSLIHVAAYADLRYHQDVLIEWLCGEAKQPVNLCKPSPCMNEGSCVLQNGSYRCKCRDGWEGPHCENRFLRRP

SEQ ID NO: 96870 - protein, 421 aa, Homo sapiens
  Payload ID: 19325
  Gene Name: von Willebrand factor A domain containing 2
  Uniprot ID: Q5GFL6
  ENSP ID: ENSP00000473752
MEAHVFQKDWTATSASARWPLEGRLTVVALKLSLECRVDLLFLLDSSAGTTLDGFLRAKVFVKRFVRAVLSEDSRARVGVATYSRELLVAVPVGEYQDVPDLVWSLDGIPFRGGPTLTGSALRQAAERGFGSATRTGQDRPRRVVVLLTESHSEDEVAGPARHARARELLLLGVGSEAVRAELEEITGSPKHVMVYSDPQDLFNQIPELQGKLCSRQRPGCRTQALDLVFMLDTSASVGPENFAQMQSFVRSCALQFEVNPDVTQVGLVVYGSQVQTAFGLDTKPTRAAMLRAISQAPYLGGVGSAGTALLHIYDKVMTVQRGARPGVPKAVVVLTGGRGAEDAAVPAQKLRNNGISVLVVGVGPVLSEGLRRLAGPRDSLIHVAAYADLRYHQDVLIEWLCGGEWGNPHPQGCPHGRPSA

SEQ ID NO: 96871 - protein, 429 aa, Homo sapiens
  Payload ID: 19326
  Gene Name: von Willebrand factor A domain containing 3A
  ENSP ID: ENSP00000299840
  MOD_RES (1)..(1): Any amino acid
XHDAPLTIEFPNLDKTSAEWLKVNGLKAKKLSLYQVLAPNAFSPVEEFVPILQKTVSSTIHEKAMIQFEWHDGTVKNIHVDPPFLYKYQQQLSRAMRMYERRIEWLSLASRRIWGTVCEKRVVVLLDISATNSMYIIHIQHSLRLLLEEQLSNKDCFNLIAFGSTIESWRPEMVPVSHNNLQSAWRWALNLRCRGSRNVLSALRKAVEVDFKDKDKHQSQGIYLFTGGIPDQDMPTLSAYMAEACGGCDLQLNVCLFYVGEPKMDTTPPARYASHTDTAAAYKEVTRAAGGRFHWFGDTGIYESDDINSIMSEMEKALNYSQKCAFLMASLKNHSGKVLGSSALPKEKPKTLQLRSQPKKLCPPRPTVPLGARMSIKDDPDREKSPPLKSLKWRPLSSRVGISPGMAEWLRAEFWSQQDQLRPSQRKKG

SEQ ID NO: 96872 - protein, 1184 aa, Homo sapiens
  Payload ID: 19326
  Gene Name: von Willebrand factor A domain containing 3A
  Uniprot ID: A6NCI4
  ENSP ID: ENSP00000374049
MKKYRKISIGCFAMATQTSHVFHGQENMFLENHCIRRNTGRDSKKPLKQKNMNGLGQNSDNGLLVTHVNQTQDLLRLQGSETQSSDWEDSEDWLSAHSLKCQKLTLADLISQGTEVLEEGTNVVQKICFSTQIIRHFESKLSDTIEVYQERIQWLTENSKKAFGLIKGARVSILIDVSAISSGPQKEEFQKDLMSLIDEQLSHKEKLFVLSFGTNAGSLWPDPMEVSASTLQELKLWVKTLQPDGGSNLLQALKKIFTLKGLDSLVAIMRSCPDQPSEILSDYIQQSTMGRDLIIHFITYRCDDQMPPAVLKNLAEAVRGYYHCYSPKMEHYTSRDMDELLAEIQKAQSLLSHVQALQHSSPCEALTCTMEEISTEITNGPLISLLPKPPKHDAPLTIEFPNLDKTSAEWLKVNGLKAKKLSLYQVLAPNAFSPVEEFVPILQKTVSSTIHEKAMIQFEWHDGTVKNIHVDPPFLYKYQQQLSRAMRMYERRIEWLSLASRRIWGTVCEKRVVVLLDISATNSMYIIHIQHSLRLLLEEQLSNKDCFNLIAFGSTIESWRPEMVPVSHNNLQSAWRWALNLRCRGSRNVLSALRKAVEVDFKDKDKHQSQGIYLFTGGIPDQDMPTLSAYMAEACGGCDLQLNVCLFYVGEPKMDTTPPARYASHTDTAAAYKEVTRAAGGRFHWFGDTGIYESDDINSIMSEMEKALNYSQKCAFLMASLKNHSGKVLGSSALPKEKPKTLQLRSQPKKLCPPRPTVPLGARMSIKDDPDREKSPPLKSLKWRPLSSRVGISPAAAQPTKEGMMELRRKTKSREAETSLLLFYTEKGNDVGSVYKKYPQGRGLRRTSSSIDLPRKDTVCSSQEWVAKYGLKKLKLEISRCMGPNCTHQKSGQRSASAKHCSIFPSVEIHGVVRHIQWTPREMEVYIRHLEKVLRRYVQRLQWLLSGSRRLFGTVLESKVCILLDTSGSMGPYLQQVKTELVLLIWEQLRKCCDSFNLLSFAESFQSWQDTLVETTDAACHEAMQWVTHLQAQGSTSILQALLKAFSFHDLEGLYLLTDGKPDTSCSLVLNEVQKLREKRDVKVHTISLNCSDRAAVEFLRKLASFTGGRYHCPVGEDTLSKIHSLLTKGFINEKDPTLPPFEGDDLRILAQEITKARSFLWQAQSFRSQLQKKNDAEPKVTLS

SEQ ID NO: 96873 - protein, 286 aa, Homo sapiens
  Payload ID: 19326
  Gene Name: von Willebrand factor A domain containing 3A
  Uniprot ID: A6NCI4
  ENSP ID: ENSP00000456513
MEVYIRHLEKVLRRYVQRLQWLLSGPVLCSRTWYRQSMDRGVMMTAASGSRRLFGTVLESKVCILLDTSGSMGPYLQQVKTELVLLIWEQLRKCCDSFNLLSFAESFQSWQDTLVETTDAACHEAMQWVTHLQAQGSTSILQALLKAFSFHDLEGLYLLTDGKPDTSCSLVLNEVQKLREKRDVKVHTISLNCSDRAAVEFLRKLASFTGGRYHCPVGEDTLSKIHSLLTKGFINEKDPTLPPFEGDDLRILAQEITKARSFLWQAQSFRSQLQKKNDAEPKVTLS

SEQ ID NO: 96874 - protein, 147 aa, Homo sapiens
  Payload ID: 19326
  Gene Name: von Willebrand factor A domain containing 3A
  ENSP ID: ENSP00000457167
IPDQDMPTLSAYMAEACGGCDLQLNVCLFYVGEPKMDTTPPARYASHTDTAAAYKEVTRAAGGRFHWFGDTGIYESDDINSIMSEMEKALNYSQKCAFLMASLKNHSGKVLGSSALPKEKPKTLQLRSQPKKLCPPRPTVPLGARMV

SEQ ID NO: 96875 - protein, 31 aa, Homo sapiens
  Payload ID: 19326
  Gene Name: von Willebrand factor A domain containing 3A
  ENSP ID: ENSP00000457368
MSLIDEQLSHKEKLFVLSFGTNAGSLWPDPM

SEQ ID NO: 96876 - protein, 746 aa, Homo sapiens
  Payload ID: 19326
  Gene Name: von Willebrand factor A domain containing 3A
  ENSP ID: ENSP00000457770
MKKYRKISIGCFAMATQTSHVFHGQENMFLENHCIRRNTGRDSKKPLKQKNMNGLGQNSDNGLLVTHVNQTQDLLRLQGSETQSSDWEDSEDWLSAHSLKCQKLTLADLISQGTEVLEEGTNVVQKICFSTQIIRHFESKLSDTIEVYQERIQWLTENSKKAFGLIKGARVSILIDVSAISSGPQKEEFQKDLMSLIDEQLSHKEKLFVLSFGTNAGSLWPDPMEVSASTLQELKLWVKTLQPDGGSNLLQALKKIFTLKGLDSLVAIMRSCPDQPSEILSDYIQQSTMGRDLIIHFITYRCDDQMPPAVLKNLAEAVRGYYHCYSPKMEHYTSRDMDELLAEIQKAQSLLSHVQALQHSSPCEALTCTMEEISTEITNGPLISLLPKPPKHDAPLTIEFPNLDKTSAEWLKVNGLKAKKLSLYQVLAPNAFSPVEEFVPILQKTVSSTIHEKAMIQFEWHDGTVKNIHVDPPFLYKYQWNDYTAWIPRDLTHHSLKPTQQQLSRAMRMYERRIEWLSLASRRIWGTVCEKRVVVLLDISATNSMYIIHIQHSLRLLLEEQLSNKDCFNLIAFGSTIESWRPEMVPVSHNNLQSAWRWALNLRCRGSRNVLSALRKAVEVDFKDKDKHQSQGIYLFTGGIPDQDMPTLSAYMAEACGGCDLQLNVCLFYVGEPKMDTTPPARYASHTDTAAAYKEVTRAAGGRFHWFGDTGIYESDDINSIMSEMEKALNYSQKCAFLMASLKNHS

SEQ ID NO: 96877 - protein, 624 aa, Homo sapiens
  Payload ID: 19327
  Gene Name: von Willebrand factor A domain containing 3B
  Uniprot ID: Q502W6
  ENSP ID: ENSP00000388158
MEKSGPSSTISEQQLQRQEGWINTKTDLAEQSLISSEKWLQLHGLKSNKLTLKQILSQIGFPHCEDYVASLGRPVASRYADGLFPQLYRAEDGRVYNLTAKSELIYQFVEHLTQAVESYKQRMDWLTSKSRQIFGVILEQCVTIVLDFGGILEGELDLCREALTMVLQEQVAHITEFNIIRVSQEPVKWQENATPVTEQSIATAISWVEKLTVELTVSEAGRLDALLEAGRDKTIESIYYFVVGDVPEESKELLLQRALEIPCPVYTVSFNARGEGTIAFLKDLSAKTHSRFHAFAERTECVEFPAFSTKDGDNVMTWNSRKLKGKLPPGAGVREDVFLVWQEMEEACSTLAQIQRLVAEPPKPDVATVDCESETTSVEIASNPEDTWDSKTWLQKYGLKAQKLSLYDVLADCSFRHADGVVDIKAKPENESVQTSAETNKKTVHAKYCSRFVHAPWKDGSLVHVNITKEKCKWYSERIHTALARIRRRIKWLQDGSQSLFGRLHNDCIYILIDTSHSMKSKLDLVKDKIIQFIQEQLKYKSKFNFVKFDGQAVAWREQLAEVNEDNLEQAQSWIRDIKIGSSTNTLSALKTAFADKETQAIYLLTDGRPDQGTSSHLLLTAAV

SEQ ID NO: 96878 - protein, 124 aa, Homo sapiens
  Payload ID: 19327
  Gene Name: von Willebrand factor A domain containing 3B
  ENSP ID: ENSP00000391241
MEKSGPSSTISEQQLQRQEGWINTKTDLAEQSLISSEKWLQLHGLKSNKLTLKQILSQIGFPHCEDYVASLGRPVASRYADGLFPQLYRAEDGRVYNGFSRACEVAGKCYSCDRTVHSYCHQLG

SEQ ID NO: 96879 - protein, 101 aa, Homo sapiens
  Payload ID: 19327
  Gene Name: von Willebrand factor A domain containing 3B
  ENSP ID: ENSP00000396734
MEKSGPSSTISEQQLQRQEGWINTKTDLAEQSLISSEKWLQLHGLKSNKLTLKQILSQIGFPHCEDYVASLGRPVASRYADGLFPQLYRAEDGRVYNLNQN

SEQ ID NO: 96880 - protein, 303 aa, Homo sapiens
  Payload ID: 19327
  Gene Name: von Willebrand factor A domain containing 3B
  ENSP ID: ENSP00000396866
MEKSGPSSTISEQQLQRQEGWINTKTDLAEQSLISSEKWLQLHGLKSNKLTLKQILSQIGFPHCEDYVASLGRPVASRYADGLFPQLYRAEDGRVYNLTAKSELIYQFVEHLTQAVESYKQRMDWLTSKSRQIFGVILEQCVTIVLDFGGILEGELDLCREALTMVLQEQVAHITEFNIIRVSQEPVKWQENATPVTEQSIATAISWVEKLTVELTVSEAGRLDALLEAGRDKTELESERTCFSFGKRWRKPAARWPRSRGWWPSLPSPTWPLWTASQKQPLLRLHRIQKTPGTLRHGCRNMA

SEQ ID NO: 96881 - protein, 423 aa, Homo sapiens
  Payload ID: 19327
  Gene Name: von Willebrand factor A domain containing 3B
  ENSP ID: ENSP00000411168
MEKSGPSSTISEQQLQRQEGWINTKTDLAEQSLISSEKWLQLHGLKSNKLTLKQILSQIGFPHCEDYVASLGRPVASRYADGLFPQLYRAEDGRVYNLTAKSELIYQFVEHLTQAVESYKQRMDWLTSKSRQIFGVILEQCVTIVLDFGGILEGELDLCREALTMVLQEQVAHITEFNIIRVSQEPVKWQENATPVTEQSIATAISWVEKLTVELTVSEAGRLDALLEAGRDKTIESIYYFVVGDVPEESKELLLQRALEIPCPVYTVSFNARGEGTIAFLKDLSAKTHSRFHAFAERTECVEFPAFSTKDGDNVMTWNSRKLKGKLPPGAGVREDVFLVWQEMEEACSTLAQIQRLVAEPPKPDVATVDCGAVPSFESSGKIVFCLCDMLACPAQSQKQPLLRLHRIQKTPGTLRHGCRNMA

SEQ ID NO: 96882 - protein, 1294 aa, Homo sapiens
  Payload ID: 19327
  Gene Name: von Willebrand factor A domain containing 3B
  Uniprot ID: Q502W6
  ENSP ID: ENSP00000417955
MEKSGPSSTISEQQLQRQEGWINTKTDLAEQSLISSEKWLQLHGLKSNKLTLKQILSQIGFPHCEDYVASLGRPVASRYADGLFPQLYRAEDGRVYNLTAKSELIYQFVEHLTQAVESYKQRMDWLTSKSRQIFGVILEQCVTIVLDFGGILEGELDLCREALTMVLQEQVAHITEFNIIRVSQEPVKWQENATPVTEQSIATAISWVEKLTVELTVSEAGRLDALLEAGRDKTIESIYYFVVGDVPEESKELLLQRALEIPCPVYTVSFNARGEGTIAFLKDLSAKTHSRFHAFAERTECVEFPAFSTKDGDNVMTWNSRKLKGKLPPGAGVREDVFLVWQEMEEACSTLAQIQRLVAEPPKPDVATVDCESETTSVEIASNPEDTWDSKTWLQKYGLKAQKLSLYDVLADCSFRHADGVVDIKAKPENESVQTSAETNKKTVHAKYCSRFVHAPWKDGSLVHVNITKEKCKWYSERIHTALARIRRRIKWLQDGSQSLFGRLHNDCIYILIDTSHSMKSKLDLVKDKIIQFIQEQLKYKSKFNFVKFDGQAVAWREQLAEVNEDNLEQAQSWIRDIKIGSSTNTLSALKTAFADKETQAIYLLTDGRPDQPPETVIDQVKRFQEIPIYTISFNYNDEIANRFLKEVAALTGGEFHFYNFGCKDPTPPEAVQNEDLTLLVKEMEQGHSDLEKMQDLYSESLIMDWWYNAEKDGDSKHQKEICSMISTPEKCAKPQSDVDSTQTSSLNMLKGPWGLSDQKVQKKKVLHAESTKTSLLRSQMSSLRSSACSERKDGLSNASSRRTALSDKEMSILLAEEWLDDKSSEKVTREGSQVYDHDSSDVSSENWLKTYGLVAKKLTLMDALSVAAVPHSSTYVPVLDKHVVSKVFDEVFPLAHVCNDTNKMTLINPQGAKLNIYKRKVEQAIQSYEKRLNKIVWRALSQEEKEKLDANKPIQYLENKTVLNQALERLNWPISLKELSMLESEILAGKMYIQQAMELQEAAKKNYANKAPGEQQKLQGNPTKKTKSKRPDPLKGQKVIARCDENGFYFPGVVKKCVSRTQALVGFSYGDTKVVSTSFITPVGGAMPCPLLQVGDYVFAKIVIPKGFDFYVPAIVIALPNKHVATEKFYTVLKCNNRREFCPRSALIKISQNKYALSCSHIKSPPIPEDPEVEDVEARNSAFLFWPLKEADTQDSREPRREKPRRKKRPAKQPLQQAAPSDSDGSSHGISSHGSCQGTHPEPRTAHLHFPAAGRLGLSSHAIIATPPPRAALPCTLQATHSSKGLRSVPETL

SEQ ID NO: 96883 - protein, 104 aa, Homo sapiens
  Payload ID: 19327
  Gene Name: von Willebrand factor A domain containing 3B
  ENSP ID: ENSP00000432446
  MOD_RES (1)..(1): Any amino acid
XKTAFADKETQAIYLLTDGRPDQPPETVIDQVKRFQEIPIYTISFNYNDEIANRFLKEVAALTGGEFHFYNFGCKDPTPPEAVQASKGNLFYDFNPRKVCKASI

SEQ ID NO: 96884 - protein, 82 aa, Homo sapiens
  Payload ID: 19327
  Gene Name: von Willebrand factor A domain containing 3B
  ENSP ID: ENSP00000434226
  MOD_RES (1)..(1): Any amino acid
XTLMDALSVAAVPHSSTYVPVLDKHVVSKVFDECFPDQPQIGHLGNEVFPLAHVCNDTNKMTLINPQGAKLNIYKRKVEQAI

SEQ ID NO: 96885 - protein, 723 aa, Homo sapiens
  Payload ID: 19327
  Gene Name: von Willebrand factor A domain containing 3B
  ENSP ID: ENSP00000436153
  MOD_RES (1)..(1): Any amino acid
XKTAFADKETQAIYLLTDGRPDQPPETVIDQVKRFQEIPIYTISFNYNDEIANRFLKEVAALTGGEFHFYNFGCKDPTPPEAVQNEDLTLLVKEMEQGHSDLEKMQDLYSESLIMDWWYNAEKDGDSKHQKEICSMISTPEKCAKPQSDVDSTQTSSLNMLKGPWGLSDQKVQKKKVLHAESTKTSLLRSQMSSLRSSACSERKDGLSNASSRRTALSDKEMSILLAEEWLDDKSSEKVTREGSQVYDHDSSDVSSENWLKTYGLVAKKLTLMDALSVAAVPHSSTYVPVLDKHVVSKVFDEVFPLAHVCNDTNKMTLINPQGAKLNIYKRKVEQAIQSYEKRLNKIVWRALSQEEKEKLDANKPIQYLENKTVLNQALERLNWPISLKELSMLESEILAGKMYIQQAMELQEAAKKNYANKAPGEQQKLQGNPTKKTKSKRPDPLKGQKVIARCDENGFYFPGVVKKCVSRTQALVGFSYGDTKVVSTSFITPVGGAMPCPLLQVGDYVFAKIVIPKGFDFYVPAIVIALPNKHVATEKFYTVLKCNNRREFCPRSALIKISQNKYALSCSHIKSPPIPEDPEVEDVEARNSAFLFWPLKEADTQDSREPRREKPRRKKRPAKQPLQQAAPSDSDGSSHGISSHGSCQGTHPEPRVWVMGGEHNIAYLRNTLKSLSRIVHLTSSFRFWACLGSSAAKTLTSLSNAELCFPRQPTSTSPRPGV

SEQ ID NO: 96886 - protein, 105 aa, Homo sapiens
  Payload ID: 19327
  Gene Name: von Willebrand factor A domain containing 3B
  ENSP ID: ENSP00000437247
  MOD_RES (1)..(1): Any amino acid
XSKLDLVKDKIIQFIQEQLKYKSKFNFVKFDGQAVAWREQLAEVNEDNLEQAQSWIRDIKIGSSTNTLSALKTAFADKETQAIYLLTDGRPDQGTSSHLLLTAAV

SEQ ID NO: 96887 - protein, 416 aa, Homo sapiens
  Payload ID: 19327
  Gene Name: von Willebrand factor A domain containing 3B
  Uniprot ID: Q502W6
  ENSP ID: ENSP00000484764
MATKGMRLKSTKEVFPLAHVCNDTNKMTLINPQGAKLNIYKRKVEQAIQSYEKRLNKIVWRALSQEEKEKLDANKPIQYLENKTVLNQALERLNWPISLKELSMLESEILAGKMYIQQAMELQEAAKKNYANKAPGEQQKLQGNPTKKTKSKRPDPLKGQKVIARCDENGFYFPGVVKKCVSRTQALVGFSYGDTKVVSTSFITPVGGAMPCPLLQVGDYVFAKIVIPKGFDFYVPAIVIALPNKHVATEKFYTVLKCNNRREFCPRSALIKISQNKYALSCSHIKSPPIPEDPEVEDVEARNSAFLFWPLKEADTQDSREPRREKPRRKKRPAKQPLQQAAPSDSDGSSHGISSHGSCQGTHPEPRTAHLHFPAAGRLGLSSHAIIATPPPRAALPCTLQATHSSKGLRSVPETL

SEQ ID NO: 96888 - protein, 415 aa, Homo sapiens
  Payload ID: 19328
  Gene Name: von Willebrand factor A domain containing 5A
  Uniprot ID: O00534
  ENSP ID: ENSP00000355070
MVHFCGLLTLHREPVPLKSISVSVNIYEFVAGVSATLNYENEEKVPLEAFFVFPMDEDSAVYSFEALVDGKKIVAELQDKMKARTNYEKAISQGHQAFLLEGDSSSRDVFSCNVGNLQPGSKAAVTLKYVQELPLEADGALRFVLPAVLNPRYQFSGSSKDSCLNVKTPIVPVEDLPYTLSMVATIDSQHGIEKVQSNCPLSPTEYLGEDKTSAQVSLAAGHKFDRDVELLIYYNEVHTPSVVLEMGMPNMKPGHLMGDPSAMVSFYPNIPEDQPSNTCGEFIFLMDRSGSMQSPMSSQDTSQLRIQAAKETLILLLKSLPIGCYFNIYGFGSSYEACFPESVKYTQQTMEEALGRVKLMQADLGGTEILAPLQNIYRGPSIPGHPLQLFVFTDGEVTDTFSVIKEVRINRQKHR

SEQ ID NO: 96889 - protein, 431 aa, Homo sapiens
  Payload ID: 19328
  Gene Name: von Willebrand factor A domain containing 5A
  ENSP ID: ENSP00000376501
MSSVCDMSFLQKSCITMVHFCGLLTLHREPVPLKSISVSVNIYEFVAGVSATLNYENEEKVPLEAFFVFPMDEDSAVYSFEALVDGKKIVAELQDKMKARTNYEKAISQGHQAFLLEGDSSSRDVFSCNVGNLQPGSKAAVTLKYVQELPLEADGALRFVLPAVLNPRYQFSGSSKDSCLNVKTPIVPVEDLPYTLSMVATIDSQHGIEKVQSNCPLSPTEYLGEDKTSAQVSLAAGHKFDRDVELLIYYNEVHTPSVVLEMGMPNMKPGHLMGDPSAMVSFYPNIPEDQPSNTCGEFIFLMDRSGSMQSPMSSQDTSQLRIQAAKETLILLLKSLPIGCYFNIYGFGSSYEACFPESVKYTQQTMEEALGRVKLMQADLGGTEILAPLQNIYRGPSIPGHPLQLFVFTDGEVTDTFSVIKEVRINRQKHR

SEQ ID NO: 96890 - protein, 786 aa, Homo sapiens
  Payload ID: 19328
  Gene Name: von Willebrand factor A domain containing 5A
  Uniprot ID: O00534
  ENSP ID: ENSP00000376504
MVHFCGLLTLHREPVPLKSISVSVNIYEFVAGVSATLNYENEEKVPLEAFFVFPMDEDSAVYSFEALVDGKKIVAELQDKMKARTNYEKAISQGHQAFLLEGDSSSRDVFSCNVGNLQPGSKAAVTLKYVQELPLEADGALRFVLPAVLNPRYQFSGSSKDSCLNVKTPIVPVEDLPYTLSMVATIDSQHGIEKVQSNCPLSPTEYLGEDKTSAQVSLAAGHKFDRDVELLIYYNEVHTPSVVLEMGMPNMKPGHLMGDPSAMVSFYPNIPEDQPSNTCGEFIFLMDRSGSMQSPMSSQDTSQLRIQAAKETLILLLKSLPIGCYFNIYGFGSSYEACFPESVKYTQQTMEEALGRVKLMQADLGGTEILAPLQNIYRGPSIPGHPLQLFVFTDGEVTDTFSVIKEVRINRQKHRCFSFGIGEGTSTSLIKGIARASGGTSEFITGKDRMQSKALRTLKRSLQPVVEDVSLSWHLPPGLSAKMLSPEQTVIFRGQRLISYAQLTGRMPAAETTGEVCLKYTLQGKTFEDKVTFPLQPKPDVNLTIHRLAAKSLLQTKDMGLRETPASDKKDALNLSLESGVISSFTAFIAINKELNKPVQGPLAHRDVPRPILLGASAPLKIKCQSGFRKALHSDRPPSASQPRGELMCYKAKTFQMDDYSLCGLISHKDQHSPGFGENHLVQLIYHQNANGSWDLNEDLAKILGMSLEEIMAAQPAELVDSSGWATILAVIWLHSNGKDLKCEWELLERKAVAWMRAHAGSTMPSVVKAAITFLKSSVDPAIFAF

SEQ ID NO: 96891 - protein, 415 aa, Homo sapiens; identical to SEQ ID NO: 96888
  Payload ID: 19328
  Gene Name: von Willebrand factor A domain containing 5A
  Uniprot ID: O00534
  ENSP ID: ENSP00000404683

SEQ ID NO: 96892 - protein, 786 aa, Homo sapiens; identical to SEQ ID NO: 96890
  Payload ID: 19328
  Gene Name: von Willebrand factor A domain containing 5A
  Uniprot ID: O00534
  ENSP ID: ENSP00000407726

SEQ ID NO: 96893 - protein, 1215 aa, Homo sapiens
  Payload ID: 19329
  Gene Name: von Willebrand factor A domain containing 5B1
  Uniprot ID: Q5TIE3
  ENSP ID: ENSP00000289815
MPGLLNWITGAALPLTASDVTSCVSGYALGLTASLTYGNLEAQPFQGLFVYPLDECTTVIGFEAVIADRVVTVQIKDKAKLESGHFDASHVRSPTVTGNILQDGVSIAPHSCTPGKVTLDEDLERILFVANLGTIAPMENVTIFISTSSELPTLPSGAVRVLLPAVCAPTVPQFCTKSTGTSNQQAQGKDRHCFGAWAPGSWNKLCLATLLNTEVSNPMEYEFNFQLEIRGPCLLAGVESPTHEIRADAAPSARSAKSIIITLANKHTFDRPVEILIHPSEPHMPHVLIEKGDMTLGEFDQHLKGRTDFIKGMKKKSRAERKTEIIRKRLHKDIPHHSVIMLNFCPDLQSVQPCLRKAHGEFIFLIDRSSSMSGISMHRVKDAMLVALKSLMPACLFNIIGFGSTFKSLFPSSQTYSEDSLAMACDDIQRMKADMGGTNILSPLKWVIRQPVHRGHPRLLFVITDGAVNNTGKVLELVRNHAFSTRCYSFGIGPNVCHRLVKGLASVSEGSAELLMEGERLQPKMVKSLKKAMAPVLSDVTVEWIFPETTEVLVSPVSASSLFPGERLVGYGIVCDASLHISNPRSDKRRRYSMLHSQESGSSVFYHSQDDGPGLEGGDCAKNSGAPFILGQAKNARLASGDSTTKHDLNLSQRRRAYSTNQITNHKPLPRATMASDPMPAAKRYPLRKARLQDLTNQTSLDVQRWQIDLQPLLNSGQDLNQGPKLRGPGARRPSLLPQGCQPFLPWGQETQAWSPVRERTSDSRSPGDLEPSHHPSAFETETSSDWDPPAESQERASPSRPATPAPVLGKALVKGLHDSQRLQWEVSFELGTPGPERGGAQDADLWSETFHHLAARAIIRDFEQLAEREGEIEQGSNRRYQVSALHTSKACNIISKYTAFVPVDVSKSRYLPTVVEYPNSGAALRMLGSRALAQQWRGTSSGFGRPQTMLGEDSAPGNDMEASPTALFSEARSPGREKHGASEGPQRSLATNTLSSMKASENLFGSWLNLNKSRLLTRAAKGFLSKPLIKAVESTSGNQSFDYIPLVSLQLASGAFLLNEAFCEATHIPMEKLKWTSPFTCHRVSLTTRPSESKTPSPQLCTSSPPRHPSCDSFSLEPLAKGKLGLEPRAVVEHTGKLWATVVGLAWLEHSSASYFTEWELVAAKANSWLEQQEVPEGRTQGTLKAAARQLFVLLRHWDENLEFNMLCYNPNYV

SEQ ID NO: 96894 - protein, 1220 aa, Homo sapiens
  Payload ID: 19329
  Gene Name: von Willebrand factor A domain containing 5B1
  Uniprot ID: Q5TIE3
  ENSP ID: ENSP00000364220
MPGLLNWITGAALPLTASDVTSCVSGYALGLTASLTYGNLEAQPFQGLFVYPLDECTTVIGFEAVIADRVVTVQIKDKAKLESGHFDASHVRSPTVTGNILQDGVSIAPHSCTPGKVTLDEDLERILFVANLGTIAPMENVTIFISTSSELPTLPSGAVRVLLPAVCAPTVPQFCTKSTGTSNQQAQGKDRHCFGAWAPGSWNKLCLATLLNTEVSNPMEYEFNFQLEIRGPCLLAGVESPTHEIRADAAPSARSAKSIIITLANKHTFDRPVEILIHPSEPHMPHVLIEKGDMTLGEFDQHLKGRTDFIKGMKKKSRAERKTEIIRKRLHKDIPHHSVIMLNFCPDLQSVQPCLRKAHGEFIFLIDRSSSMSGISMHRVKDAMLVALKSLMPACLFNIIGFGSTFKSLFPSSQTYSEDSLAMACDDIQRMKADMGGTNILSPLKWVIRQPVHRGHPRLLFVITDGAVNNTGKVLELVRNHAFSTRCYSFGIGPNVCHRLVKGLASVSEGSAELLMEGERLQPKMVKSLKKAMAPVLSDVTVEWIFPETTEVLVSPVSASSLFPGERLVGYGIVCDASLHISNPRSDKRRRYSMLHSQESGSSVFYHSQDDGPGLEGGDCAKNSGAPFILGQAKNARLASGDSTTKHDLNLSQRRRAYSTNQITNHKPLPRATMASDPMPAAKRYPLRKARLQDLTNQTSLDVQRWQIDLQPLLNSGQDLNQGPKLRGPGARRPSLLPQGCQPFLPWGQETQAWSPVRERTSDSRSPGDLEPSHHPSAFETETSSDWDPPAESQERASPSRPATPAPVLGKALVKGLHDSQRLQWEVSFELGTPGPERGGAQDADLWSETFHHLAARAIIRDFEQLAEREGEIEQGSNRRYQVSALHTSKACNIISKYTAFVPVDVSKSRYLPTVVEYPNSAALRMLGSRALAQQWRGTSSGFGRPQTMLGEDSAPGNGKFQALNMEASPTALFSEARSPGREKHGASEGPQRSLATNTLSSMKASENLFGSWLNLNKSRLLTRAAKGFLSKPLIKAVESTSGNQSFDYIPLVSLQLASGAFLLNEAFCEATHIPMEKLKWTSPFTCHRVSLTTRPSESKTPSPQLCTSSPPRHPSCDSFSLEPLAKGKLGLEPRAVVEHTGKLWATVVGLAWLEHSSASYFTEWELVAAKANSWLEQQEVPEGRTQGTLKAAARQLFVLLRHWDENLEFNMLCYNPNYV

SEQ ID NO: 96895 - protein, 184 aa, Homo sapiens
  Payload ID: 19329
  Gene Name: von Willebrand factor A domain containing 5B1
  ENSP ID: ENSP00000431194
MPGLLNWITGAALPLTASDVTSCVSGYALGLTASLTYGNLEAQPFQGLFVYPLDECTTVIGFEAVIADRVVTVQIKDKAKLESGHFDASHVRSPTVTGDLGRGFGADPVRGQPGDHCPHGECHHLHQHLLGAPNAAQRGCEGPSACCLCPNRAPVLHQEHWHLQPTGPGQRQALLRCLGPGLLE

SEQ ID NO: 96896 - protein, 127 aa, Homo sapiens
  Payload ID: 19329
  Gene Name: von Willebrand factor A domain containing 5B1
  ENSP ID: ENSP00000432600
MPGLLNWITGAALPLTASDVTSCVSGYALGLTASLTYGNLEAQPFQGLFVYPLDECTTVIGFEAVIADRVVTVQIKDKAKLESGHFDASHVRSPTVTGNILQDGVSIAPHSCTPGKVTLDEDLERIL

SEQ ID NO: 96897 - protein, 444 aa, Homo sapiens
  Payload ID: 19329
  Gene Name: von Willebrand factor A domain containing 5B1
  ENSP ID: ENSP00000435623
  MOD_RES (1)..(1): Any amino acid
XCDASLHISNPRSDKRRRYSMLHSQESGSSVFYHSQDDGPGLEGGDCAKNSGAPFILGQAKNARLASGDSTTKHDLNLSQRRRAYSTNQITNHKPLPRATMASDPMPAAKRYPLRKARLQDLTNQTSLDVQRWQIDLQPLLNSGQDLNQGPKLRGPGARRPSLLPQGCQPFLPWGQETQAWSPVRERTSDSRSPGDLEPSHHPSAFETETSSDWDPPAESQERASPSRPATPAPVLGKALVKGLHDSQRLQWEVSFELGTPGPERGGAQDADLWSETFHHLAARAIIRDFEQLAEREGEIEQGSNRRYQVSALHTSKACNIISKYTAFVPVDVSKSRYLPTVVEYPNSGAALRMLGSRALAQQWRGTSSGFGRPQTMLGEDSAPGNGPRKCSQTLMGFKTKTETEHSVRGWKPRGALQNQSVLSTSWSHWPPKPRRTSSTPEPS

SEQ ID NO: 96898 - protein, 82 aa, Homo sapiens
  Payload ID: 19329
  Gene Name: von Willebrand factor A domain containing 5B1
  ENSP ID: ENSP00000437028
MPGLLNWITGAALPLTASDVTSCVSGYALGLTASLTYGNLEAQPFQGLFVYPLDECTTVIGFEAVIADRVVTVQIKDKAKLE

SEQ ID NO: 96899 - protein, 298 aa, Homo sapiens
  Payload ID: 19329
  Gene Name: von Willebrand factor A domain containing 5B1
  ENSP ID: ENSP00000437095
MPGLLNWITGAALPLTASDVTSCVSGYALGLTASLTYGNLEAQPFQGLFVYPLDECTTVIGFEAVIADRVVTVQIKDKAKLESGHFDASHVRSPTVTGNILQDGVSIAPHSCTPGKVTLDEDLERILFVANLGTIAPMENVTIFISTSSELPTLPSGAVRVLLPAVCAPTVPQFCTKSTGTSNQQAQGKDRHCFGAWAPGSWNKLCLATLLNTEVSNPMEYEFNFQLEIRGPCLLAGGEIEAAWPWSHCRSGAPNGAGMSLISGLDLGVPQRTPLSPDLMSLYPPCLSMPLRGGESHS

SEQ ID NO: 96900 - protein, 1024 aa, Homo sapiens
  Payload ID: 19330
  Gene Name: von Willebrand factor A domain containing 5B2
  ENSP ID: ENSP00000273794
MLVTGPCLLAGLESPSHALRADAPPHASSAATICVTLAEGHHCDRALEILLHPSEPHQPHLMLEGGSLSSAEYEARVRARRDFQRLQRRDSDGDRQVWFLQRRFHKDILLNPVLALSFCPDLSSKPGHLGTATRELLFLLDSSSVAHKDAIVLAVKSLPPQTLINLAVFGTLVQPLFPESRPCSDDAVQLICESIETLQVPSGPPDVLAALDWAVGQPQHRAYPRQLFLLTAASPMAATTHRTLELMRWHRGTARCFSFGLGPTCHQLLQGLSALSRGQAYFLRPGQRLQPMLVQALRKALEPALSDISVDWFVPDTVEALLTPREIPALYPGDQLLGYCSLFRVDGFRSRPPGGQEPGWQSSGGSVFPSPEEAPSAASPGTEPTGTSEPLGTGTVSAELSSPWAARDSEQTGTDALTDPVTDPGPNPSDTAIWRRIFQSSYIREQYVLTHCSASPEPGPGSTGSSESPGSQGPGSPEGSAPLEPPSQQGCRSLAWGEPAGSRSCPLPAPTPAPFKVGALSTEVLGRQHRAALAGRSLSSPPGRANQVPGRPRKPSLGAILDGPSPEPGQQLGQGLDDSGNLLSPAPMDWDMLMEPPFLFTAVPPSGELAPPAVPPQAPRCHVVIRGLCGEQPMCWEVGVGLETLWGPGDGSQPPSPPVREAAWDQALHRLTAASVVRDNEQLALRGGAETTADRGHARRCWLRALQTSKVSSAPSCFTCPVAVDATTREVLPGALQVCSSEPAEPPGTPPASHSHLDAAPLPTVVYSKGLQRGSPAGAWDSDQNGNSKRALGDPATPTEGPRRPPPRPPCRLSMGRRHKLCSPDPGQANNSEGSDHDYLPLVRLQEAPGSFRLDAPFCAAVRISQERLCRASPFAVHRASLSPTSASLPWALLGPGVGQGDSATASCSPSPSSGSEGPGQVDSGRGSDTEASEGAEGLGGTDLRGRTWATAVALAWLEHRCAAAFDEWELTAAKADCWLRAQHLPDGLDLAALKAAARGLFLLLRHWDQNLQLHLLCYSPANV

SEQ ID NO: 96901 - protein, 1242 aa, Homo sapiens
  Payload ID: 19330
  Gene Name: von Willebrand factor A domain containing 5B2
  Uniprot ID: Q8N398
  ENSP ID: ENSP00000398688
MPGLYCPSSWTPLPLTDSWVRACANGPCLSVRARLTYRNPQPQPVDGVFVYPLAEAEVVSGFEAEAAGRRVSFQLQSRRRSQAACCRALGPGLGTPTPRRCAQGHLVLDLAQARSTLVLPTGIIAAAGTMTVTLHSSRELPSRPDGVLHVALPTVLTPLAPPGPPGPPRPPGLCDDSPTSCFGVGSLQEEGLAWEELAAPRDVFSGPARCPAPYTFSFEMLVTGPCLLAGLESPSHALRADAPPHASSAATICVTLAEGHHCDRALEILLHPSEPHQPHLMLEGGSLSSAEYEARVRARRDFQRLQRRDSDGDRQVWFLQRRFHKDILLNPVLALSFCPDLSSKPGHLGTATRELLFLLDSSSVAHKDAIVLAVKSLPPQTLINLAVFGTLVQPLFPESRPCSDDAVQLICESIETLQVPSGPPDVLAALDWAVGQPQHRAYPRQLFLLTAASPMAATTHRTLELMRWHRGTARCFSFGLGPTCHQLLQGLSALSRGQAYFLRPGQRLQPMLVQALRKALEPALSDISVDWFVPDTVEALLTPREIPALYPGDQLLGYCSLFRVDGFRSRPPGGQEPGWQSSGGSVFPSPEEAPSAASPGTEPTGTSEPLGTGTVSAELSSPWAARDSEQSTDALTDPVTDPGPNPSDTAIWRRIFQSSYIREQYVLTHCSASPEPGPGSTGSSESPGSQGPGSPEGSAPLEPPSQQGCRSLAWGEPAGSRSCPLPAPTPAPFKVGALSTEVLGRQHRAALAGRSLSSPPGRANQVPGRPRKPSLGAILDGPSPEPGQQLGQGLDDSGNLLSPAPMDWDMLMEPPFLFTAVPPSGELAPPAVPPQAPRCHVVIRGLCGEQPMCWEVGVGLETLWGPGDGSQPPSPPVREAAWDQALHRLTAASVVRDNEQLALRGGAETTADRGHARRCWLRALQTSKVSSAPSCFTCPVAVDATTREVLPGALQVCSSEPAEPPGTPPASHSHLDAAPLPTVVYSKGLQRGSPAGAWDSDQNGNSKRALGDPATPTEGPRRPPPRPPCRLSMGRRHKLCSPDPGQANNSEGSDHDYLPLVRLQEAPGSFRLDAPFCAAVRISQERLCRASPFAVHRASLSPTSASLPWALLGPGVGQGDSATASCSPSPSSGSEGPGQVDSGRGSDTEASEGAEGLGGTDLRGRTWATAVALAWLEHRCAAAFDEWELTAAKADCWLRAQHLPDGLDLAALKAAARGLFLLLRHWDQNLQLHLLCYSPANV

SEQ ID NO: 96902 - protein, 891 aa, Homo sapiens
  Payload ID: 19331
  Gene Name: von Willebrand factor A domain containing 7
  Uniprot ID: Q9Y334
  ENSP ID: ENSP00000364840
MLPTEVPQSHPGPSALLLLQLLLPPTSAFFPNIWSLLAAPGSITHQDLTEEAALNVTLQLFLEQPPPGRPPLRLEDFLGRTLLADDLFAAYFGPGSSRRFRAALGEVSRANAAQDFLPTSRNDPDLHFDAERLGQGRARLVGALRETVVAARALDHTLARQRLGAALHALQDFYSHSNWVELGEQQPHPHLLWPRQELQNLAQVADPTCSDCEELSCPRNWLGFTLLTSGYFGTHPPKPPGKCSHGGHFDRSSSQPPRGGINKDSTSPGFSPHHMLHLQAAKLALLASIQAFSLLRSRLGDRDFSRLLDITPASSLSFVLDTTGSMGEEINAAKIQARHLVEQRRGSPMEPVHYVLVPFHDPGFGPVFTTSDPDSFWQQLNEIHALGGGDEPEMCLSALQLALLHTPPLSDIFVFTDASPKDAFLTNQVESLTQERRCRVTFLVTEDTSRVQGRARREILSPLRFEPYKAVALASGGEVIFTKDQHIRDVAAIVGESMAALVTLPLDPPVVVPGQPLVFSVDGLLQKITVRIHGDISSFWIKNPAGVSQGQEEGGGPLGHTRRFGQFWMVTMDDPPQTGTWEIQVTAEDTPGVRVQAQTSLDFLFHFGIPMEDGPHPGLYPLTQPVAGLQTQLLVEVTGLGSRANPGDPQPHFSHVILRGVPEGAELGQVPLEPVGPPERGLLAASLSPTLLSTPRPFSLELIGQDAAGRRLHRAAPQPSTVVPVLLELSGPSGFLAPGSKVPLSLRIASFSGPQDLDLRTFVNPSFSLTSNLSRAHLELNESAWGRLWLEVPDSAAPDSVVMVTVTAGGREANPVPPTHAFLRLLVSAPAPQDRHTTPTGSSDPILTTATPAFSPFTLVTQGRAGAGLAAGSPWWGTVGGVLLLLGLASW

SEQ ID NO: 96903 - protein, 891 aa, Homo sapiens; identical to SEQ ID NO: 96902
  Payload ID: 19331
  Gene Name: von Willebrand factor A domain containing 7
  Uniprot ID: Q9Y334
  ENSP ID: ENSP00000390732

SEQ ID NO: 96904 - protein, 891 aa, Homo sapiens; identical to SEQ ID NO: 96902
  Payload ID: 19331
  Gene Name: von Willebrand factor A domain containing 7
  Uniprot ID: Q9Y334
  ENSP ID: ENSP00000406943

SEQ ID NO: 96905 - protein, 891 aa, Homo sapiens
  Payload ID: 19331
  Gene Name: von Willebrand factor A domain containing 7
  ENSP ID: ENSP00000411804
MLPTEVPQSHPGPSALLLLQLLLPPTSAFFPNIWSLLAAPGSITHQDLTEEAALNVTLQLFLEQPPPGRPPLRLEDFLGRTLLADDLFAAYFGPGSSRRFRAALGEVSRANAAQDFLPTSRNDPDLHFDAERLGQGRARLVGALRETVVAARALDHTLARQRLGAALHALQDFYSHSNWVELGEQQPHPHLLWPRQELQNLAQVADPTCSDCEELSCPRNWLGFTLLTSGYFGTHPPKPPGKCSHGGHFDRSSSQPPRGGINKDSTSPGFSPHHMLHLQAAKLALLASIQAFSLLRSRLGDRDFSRLLDITPASSLSFVLDTTGSMGEEINAAKIQARHLVEQRRGSPMEPVHYVLVPFHDPGFGPVFTTSDPDSFWQQLNEIHALGGGDEPEMCLSALQLALLHTPPLSDIFVFTDASPKDAFLTNQVESLTQERRCRVTFLVTEDTSRVQGRARREILSPLRFEPYKAVALASGGEVIFTKDQHIRDVAAIVGESMAALVTLPLDPPVVVPGQPLVFSVDGLLQKITVRIHGDISSFWIKNPAGVSQGQEEGGGPLGHTRRFGQFWMVTMDDPPQTGTWEIQVTAEDTPGVRVQAQTSLDFLFHFGIPMEDGPHPGLYPLTQPVAGLQTQLLVEVTGLGSRANPGDPQPHFSHVILRGVPEGAELGQVPLEPVGPPERGLLAASLSPTLLSTPRPFSLELIGQDAAGRRLHRAAPQPSTVVPVLLELSGPSGFLAPGSKVPLSLRIASFSGPQDLDLRTFVNPSFSLTSNLSRAHLELNESAWGRLWLEVPDSAAPDSVVMVTVTAGGREANPVPPTHAFLRLLVSAPAPQDRHTTPTGSSDPILTTATPAFSPFTLVAQGRAGAGLAAGSPWWGTVGGVLLLLGLASW

SEQ ID NO: 96906 - protein, 891 aa, Homo sapiens; identical to SEQ ID NO: 96902
  Payload ID: 19331
  Gene Name: von Willebrand factor A domain containing 7
  Uniprot ID: Q9Y334
  ENSP ID: ENSP00000411910

SEQ ID NO: 96907 - protein, 891 aa, Homo sapiens; identical to SEQ ID NO: 96902
  Payload ID: 19331
  Gene Name: von Willebrand factor A domain containing 7
  Uniprot ID: Q9Y334
  ENSP ID: ENSP00000413704

SEQ ID NO: 96908 - protein, 1039 aa, Homo sapiens
  Payload ID: 19332
  Gene Name: von Willebrand factor A domain containing 8
  Uniprot ID: A3KMH1
  ENSP ID: ENSP00000281496
MQSRLLLLGAPGGHGGPASRRMRLLLRQVVQRRPGGDRQRPEVRLLHAGSGADTGDTVNIGDVSYKLKIPKNPELVPQNYISDSLAQSVVQHLRWIMQKDLLGQDVFLIGPPGPLRRSIAMQYLELTKREVEYIALSRDTTETDLKQRREIRAGTAFYIDQCAVRAATEGRTLILEGLEKAERNVLPVLNNLLENREMQLEDGRFLMSAERYDKLLRDHTKKELDSWKIVRVSENFRVIALGLPVPRYSGNPLDPPLRSRFQARDIYYLPFKDQLKLLYSIGANVSAEKVSQLLSFATTLCSQESSTLGLPDFPLDSLAAAVQILDSFPMMPIKHAIQWLYPYSILLGHEGKMAVEGVLKRFELQDSGSSLLPKEIVKVEKMMENHVSQASVTIRIADKEVTIKVPAGTRLLSQPCASDRFIQTLSHKQLQAEMMQSHMVKDICLIGGKGCGKTVIAKNFADTLGYNIEPIMLYQDMTARDLLQQRYTLPNGDTAWRSSPLVNAALEGKLVLLDGIHRVNAGTLAVLQRLIHDRELSLYDGSRLLREDRYMRLKEELQLSDEQLQKRSIFPIHPSFRIIALAEPPVIGSTAHQWLGPEFLTMFFFHYMKPLVKSEEIQVIKEKVPNVPQEALDKLLSFTHKLRETQDPTAQSLAASLSTRQLLRISRRLSQYPNENLHSAVTKACLSRFLPSLARSALEKNLADATIEINTDDNLEPELKDYKCEVTSGTLRIGAVSAPIYNAHEKMKVPDVLFYDNIQHVIVMEDMLKDFLLGEHLLLVGNQGVGKNKIVDRFLHLLNRPREYIQLHRDTTVQTLTLQPSVKDGLIVYEDSPLVKAVKLGHILVVDEADKAPTNVTCILKTLVENGEMILADGRRIVANSANVNGRENVVVIHPDFRMIVLANRPGFPFLGNDFFGTLGDIFSCHAVDNPKPHSELEMLRQYGPNVPEPILQKLVAAFGELRSLADQGIINYPYSTREVVNIVKHLQKFPTEGLSSVVRNVFDFDSYNNDMREILINTLHKYGIPIGAKPTSVQLAKE

SEQ ID NO: 96909 - protein, 1905 aa, Homo sapiens
  Payload ID: 19332
  Gene Name: von Willebrand factor A domain containing 8
  Uniprot ID: A3KMH1
  ENSP ID: ENSP00000368612
MQSRLLLLGAPGGHGGPASRRMRLLLRQVVQRRPGGDRQRPEVRLLHAGSGADTGDTVNIGDVSYKLKIPKNPELVPQNYISDSLAQSVVQHLRWIMQKDLLGQDVFLIGPPGPLRRSIAMQYLELTKREVEYIALSRDTTETDLKQRREIRAGTAFYIDQCAVRAATEGRTLILEGLEKAERNVLPVLNNLLENREMQLEDGRFLMSAERYDKLLRDHTKKELDSWKIVRVSENFRVIALGLPVPRYSGNPLDPPLRSRFQARDIYYLPFKDQLKLLYSIGANVSAEKVSQLLSFATTLCSQESSTLGLPDFPLDSLAAAVQILDSFPMMPIKHAIQWLYPYSILLGHEGKMAVEGVLKRFELQDSGSSLLPKEIVKVEKMMENHVSQASVTIRIADKEVTIKVPAGTRLLSQPCASDRFIQTLSHKQLQAEMMQSHMVKDICLIGGKGCGKTVIAKNFADTLGYNIEPIMLYQDMTARDLLQQRYTLPNGDTAWRSSPLVNAALEGKLVLLDGIHRVNAGTLAVLQRLIHDRELSLYDGSRLLREDRYMRLKEELQLSDEQLQKRSIFPIHPSFRIIALAEPPVIGSTAHQWLGPEFLTMFFFHYMKPLVKSEEIQVIKEKVPNVPQEALDKLLSFTHKLRETQDPTAQSLAASLSTRQLLRISRRLSQYPNENLHSAVTKACLSRFLPSLARSALEKNLADATIEINTDDNLEPELKDYKCEVTSGTLRIGAVSAPIYNAHEKMKVPDVLFYDNIQHVIVMEDMLKDFLLGEHLLLVGNQGVGKNKIVDRFLHLLNRPREYIQLHRDTTVQTLTLQPSVKDGLIVYEDSPLVKAVKLGHILVVDEADKAPTNVTCILKTLVENGEMILADGRRIVANSANVNGRENVVVIHPDFRMIVLANRPGFPFLGNDFFGTLGDIFSCHAVDNPKPHSELEMLRQYGPNVPEPILQKLVAAFGELRSLADQGIINYPYSTREVVNIVKHLQKFPTEGLSSVVRNVFDFDSYNNDMREILINTLHKYGIPIGAKPTSVQLAKELTLPEQTFMGYWTIGQARSGMQKLLCPVETHHIDIKGPALINIQEYPIERHEERSLNFTEECASWRIPLDEINIICDIATSHENEQNTLYVVTCNPASLYFMNMTGKSGFFVDFFDIFPRTANGVWHPFVTVAPLGSPLKGQVVLHEQQSNVILLLDTTGRALHRLILPSEKFTSKKPFWWNKEEAETYKMCKEFSHKNWLVFYKEKGNSLTVLDVLEGRTHTISLPINLKTVFLVAEDKWLLVESKTNQKYLLTKPAHIESEGSGVCQLYVLKEEPPSTGFGVTQETEFSIPHKISSDQLSSEHLSSAVEQKIASPNRILSDEKNYATIVVGFPDLMSPSEVYSWKRPSSLHKRSGTDTSFYRGKKKRGTPKQSNCVTLLDTNQVVRILPPGEVPLKDIYPKDVTPPQTSGYIEVTDLQSKKLRYIPIPRSESLSPYTTWLSTISDTDALLAEWDKSGVVTVDMGGHIRLWETGLERLQRSLMEWRNMIGQDDRNMQITINRDSGEDVSSPKHGKEDPDNMPHVGGNTWAGGTGGRDTAGLGGKGGPYRLDAGHTVYQVSQAEKDAVPEEVKRAAREMGQRAFQQRLKEIQMSEYDAATYERFSGAVRRQVHSLRIILDNLQAKGKERQWLRHQATGELDDAKIIDGLTGEKAIYKRRGELEPQLGSPQQKPKRLRLVVDVSGSMYRFNRMDGRLERTMEAVCMVMEAFENYEEKFQYDIVGHSGDGYNIGLVPMNKIPKDNKQRLEILKTMHAHSQFCMSGDHTLEGTEHAIKEIVKEEADEYFVIVLSDANLSRYGIHPAKFAQILTRDPQVNAFAIFIGSLGDQATRLQRTLPAGRSFVAMDTKDIPQILQQIFTSTMLSSV

SEQ ID NO: 96910 - protein, 518 aa, Homo sapiens
  Payload ID: 19333
  Gene Name: von Willebrand factor A domain containing 9
  Uniprot ID: Q96SY0
  ENSP ID: ENSP00000326379
MPTVVVMDVSLSMTRPVSIEGSEEYQRKHLAAHGLTMLFEHMATNYKLEFTALVVFSSLWELMVPFTRDYNTLQEALSNMDDYDKTCLESALVGVCNIVQQEWGGAIPCQVVLVTDGCLGIGRGSLRHSLATQNQRSESNRFPLPFPFPSKLYIMCMANLEELQSTDSLECLERLIDLNNGEGQIFTIDGPLCLKNVQSMFGKLIDLAYTPFHAVLKCGHLTADVQVFPRPEPFVVDEEIDPIPKVINTDLEIVGFIDIADISSPPVLSRHLVLPIALNKEGDEVGTGITDDNEDENSANQIAGKIPNFCVLLHGSLKVEGMVAIVQLGPEWHGMLYSQADSKKKSNLMMSLFEPGPEPLPWLGKMAQLGPISDAKENPYGEDDNKSPFPLQPKNKRSYAQNVTVWIKPSGLQTDVQKILRNARKLPEKTQTFYKELNRLRKAALAFGFLDLLKGVADMLERECTLLPETAHPDAAFQLTHAAQQLKLASTGTSEYAAYDQNITPLHTDFSGSSTERI

SEQ ID NO: 96911 - protein, 482 aa, Homo sapiens
  Payload ID: 19333
  Gene Name: von Willebrand factor A domain containing 9
  ENSP ID: ENSP00000396314
MPTVVVMDVSLSMTRPVSIEGSEEYQRKHLAAHGLTMLFEHMATNYKLEFTALVVFSSLWELMVPFTRDYNTLQVVLVTDGCLGIGRGSLRHSLATQNQRSESNRFPLPFPFPSKLYIMCMANLEELQSTDSLECLERLIDLNNGEGQIFTIDGPLCLKNVQSMFGKLIDLAYTPFHAVLKCGHLTADVQVFPRPEPFVVDEEIDPIPKVINTDLEIVGFIDIADISSPPVLSRHLVLPIALNKEGDEVGTGITDDNEDENSANQIAGKIPNFCVLLHGSLKVEGMVAIVQLGPEWHGMLYSQADSKKKSNLMMSLFEPGPEPLPWLGKMAQLGPISDAKENPYGEDDNKSPFPLQPKNKRSYAQNVTVWIKPSGLQTDVQKILRNARKLPEKTQTFYKELNRLRKAALAFGFLDLLKGVADMLERECTLLPETAHPDAAFQLTHAAQQLKLASTGTSEYAAYDQNITPLHTDFSGSSTERI

SEQ ID NO: 96912 - protein, 439 aa, Homo sapiens
  Payload ID: 19333
  Gene Name: von Willebrand factor A domain containing 9
  Uniprot ID: Q96SY0
  ENSP ID: ENSP00000402898
MDDYDKTCLESALVGVCNIVQQEWGGAIPCQVVLVTDGCLGIGRGSLRHSLATQNQRSESNRFPLPFPFPSKLYIMCMANLEELQSTDSLECLERLIDLNNGEGQIFTIDGPLCLKNVQSMFGKLIDLAYTPFHAVLKCGHLTADVQVFPRPEPFVVDEEIDPIPKVINTDLEIVGFIDIADISSPPVLSRHLVLPIALNKEGDEVGTGITDDNEDENSANQIAGKIPNFCVLLHGSLKVEGMVAIVQLGPEWHGMLYSQADSKKKSNLMMSLFEPGPEPLPWLGKMAQLGPISDAKENPYGEDDNKSPFPLQPKNKRSYAQNVTVWIKPSGLQTDVQKILRNARKLPEKTQTFYKELNRLRKAALAFGFLDLLKGVADMLERECTLLPETAHPDAAFQLTHAAQQLKLASTGTSEYAAYDQNITPLHTDFSGSSTERI

SEQ ID NO: 96913 - protein, 461 aa, Homo sapiens
  Payload ID: 19333
  Gene Name: von Willebrand factor A domain containing 9
  Uniprot ID: Q96SY0
  ENSP ID: ENSP00000408429
MPTESLCRRTVSGDGHGEALSNMDDYDKTCLESALVGVCNIVQQEWGGAIPCQVVLVTDGCLGIGRGSLRHSLATQNQRSESNRFPLPFPFPSKLYIMCMANLEELQSTDSLECLERLIDLNNGEGQIFTIDGPLCLKNVQSMFGKLIDLAYTPFHAVLKCGHLTADVQVFPRPEPFVVDEEIDPIPKVINTDLEIVGFIDIADISSPPVLSRHLVLPIALNKEGDEVGTGITDDNEDENSANQIAGKIPNFCVLLHGSLKVEGMVAIVQLGPEWHGMLYSQADSKKKSNLMMSLFEPGPEPLPWLGKMAQLGPISDAKENPYGEDDNKSPFPLQPKNKRSYAQNVTVWIKPSGLQTDVQKILRNARKLPEKTQTFYKELNRLRKAALAFGFLDLLKGVADMLERECTLLPETAHPDAAFQLTHAAQQLKLASTGTSEYAAYDQNITPLHTDFSGSSTERI

SEQ ID NO: 96914 - protein, 169 aa, Homo sapiens
  Payload ID: 19333
  Gene Name: von Willebrand factor A domain containing 9
  ENSP ID: ENSP00000454425
MPTESLCRRTVSGDGHGLSVCILIGNTGIIFIMPTVVVMDVSLSMTRPVSIEGSEEYQRKHLAAHGLTMLFEHMATNYKLEFTALVVFSSLWELMVPFTRDYNTLQEALSNMDDYDKTCLESALVGVCNIVQQEWGGAIPCQVVLVTDGCLGIGRGSLRHSLATQNQRS

SEQ ID NO: 96915 - protein, 71 aa, Homo sapiens
  Payload ID: 19333
  Gene Name: von Willebrand factor A domain containing 9
  ENSP ID: ENSP00000454743
MDDYDKTCLESALVGVCNIVQQEWGGAIPCQVVLVTDGCLGIGRGSLRHSLATQNQRSESNRFPLPFPFPS

SEQ ID NO: 96916 - protein, 57 aa, Homo sapiens
  Payload ID: 19333
  Gene Name: von Willebrand factor A domain containing 9
  ENSP ID: ENSP00000454972
MPTDCVRRWARGEWGGRGPGTAFRCLLGLQVKGLWVKNNPGPALGLPATVAAAPRCL

SEQ ID NO: 96917 - protein, 154 aa, Homo sapiens
  Payload ID: 19333
  Gene Name: von Willebrand factor A domain containing 9
  ENSP ID: ENSP00000455105
MPTVVVMDVSLSMTRPVSIEGSEEYQRKHLAAHGLTMLFEHMATNYKLEFTALVVFSSLWELMVPFTRDYNTLQEALSNMDDYDKTCLESALVGVCNIVQQEWGGAIPCQVVLVTDGCLGIGRGSLRHSLATQNQRSESNSSRAPIPWNALNVS

SEQ ID NO: 96918 - protein, 468 aa, Homo sapiens
  Payload ID: 19333
  Gene Name: von Willebrand factor A domain containing 9
  ENSP ID: ENSP00000456460
MPTVVVMDVSLSMTRPVSIEGSEEYQPLSNMDDYDKTCLESALVGVCNIVQQEWGGAIPCQVVLVTDGCLGIGRGSLRHSLATQNQRSESNRFPLPFPFPSKLYIMCMANLEELQSTDSLECLERLIDLNNGEGQIFTIDGPLCLKNVQSMFGKLIDLAYTPFHAVLKCGHLTADVQVFPRPEPFVVDEEIDPIPKVINTDLEIVGFIDIADISSPPVLSRHLVLPIALNKGDEVGTGITDDNEDENSANQIAGKIPNFCVLLHGSLKVEGMVAIVQLGPEWHGMLYSQADSKKKSNLMMSLFEPGPEPLPWLGKMAQLGPISDAKENPYGEDDNKSPFPLQPKNKRSYAQNVTVWIKPSGLQTDVQKILRNARKLPEKTQTFYKELNRLRKAALAFGFLDLLKGVADMLERECTLLPETAHPDAAFQLTHAAQQLKLASTGTSEYAAYDQNITPLHTDFSGSSTERI

SEQ ID NO: 96919 - protein, 39 aa, Homo sapiens
  Payload ID: 19333
  Gene Name: von Willebrand factor A domain containing 9
  ENSP ID: ENSP00000456956
MKLYLRTGEGLPEADGKAKEQEALSNMDDYDKTCLESAL

SEQ ID NO: 96920 - protein, 554 aa, Homo sapiens
  Payload ID: 19333
  Gene Name: von Willebrand factor A domain containing 9
  ENSP ID: ENSP00000457624
MKLYLRTGEGLPEADGKAKEQLSVCILIGNTGIIFIMPTVVVMDVSLSMTRPVSIEGSEEYQRKHLAAHGLTMLFEHMATNYKLEFTALVVFSSLWELMVPFTRDYNTLQEALSNMDDYDKTCLESALVGVCNIVQQEWGGAIPCQVVLVTDGCLGIGRGSLRHSLATQNQRSESNRFPLPFPFPSKLYIMCMANLEELQSTDSLECLERLIDLNNGEGQIFTIDGPLCLKNVQSMFGKLIDLAYTPFHAVLKCGHLTADVQVFPRPEPFVVDEEIDPIPKVINTDLEIVGFIDIADISSPPVLSRHLVLPIALNKEGDEVGTGITDDNEDENSANQIAGKIPNFCVLLHGSLKVEGMVAIVQLGPEWHGMLYSQADSKKKSNLMMSLFEPGPEPLPWLGKMAQLGPISDAKENPYGEDDNKSPFPLQPKNKRSYAQNVTVWIKPSGLQTDVQKILRNARKLPEKTQTFYKELNRLRKAALAFGFLDLLKGVADMLERECTLLPETAHPDAAFQLTHAAQQLKLASTGTSEYAAYDQNITPLHTDFSGSSTERI

SEQ ID NO: 96921 - protein, 76 aa, Homo sapiens
  Payload ID: 19333
  Gene Name: von Willebrand factor A domain containing 9
  ENSP ID: ENSP00000457922
MPTVVVMDVSLSMTRPVSIEGSEEYQPLSNMDDYDKTCLESALVGVCNIVQQEWGGAIPCQVVLVTDGCLGIGRGS

SEQ ID NO: 96922 - protein, 57 aa, Homo sapiens; identical to SEQ ID NO: 96916
  Payload ID: 19333
  Gene Name: von Willebrand factor A domain containing 9
  ENSP ID: ENSP00000457977

SEQ ID NO: 96923 - protein, 57 aa, Homo sapiens; identical to SEQ ID NO: 96916
  Payload ID: 19333
  Gene Name: von Willebrand factor A domain containing 9
  ENSP ID: ENSP00000458470

SEQ ID NO: 96924 - protein, 219 aa, Homo sapiens
  Payload ID: 19334
  Gene Name: von Willebrand factor C and EGF domains
  Uniprot ID: Q96DN2
  ENSP ID: ENSP00000301770
MWAGLLLRAACVALLLPGAPARGYTGRKPPGHFAAERRRLGPHVCLSGFGSGCCPGWAPSMGGGHCTLPLCSFGCGSGICIAPNVCSCQDGEQGATCPETHGPCGEYGCDLTCNHGGCQEVARVCPVGFSMTETAVGIRCTDIDECVTSSCEGHCVNTEGGFVCECGPGMQLSADRHSCQDTDECLGTPCQQRCKNSIGSYKCSCRTGFHLHGNRHSCM

SEQ ID NO: 96925 - protein, 955 aa, Homo sapiens
  Payload ID: 19334
  Gene Name: von Willebrand factor C and EGF domains
  Uniprot ID: Q96DN2
  ENSP ID: ENSP00000334186
MWAGLLLRAACVALLLPGAPARGYTGRKPPGHFAAERRRLGPHVCLSGFGSGCCPGWAPSMGGGHCTLPLCSFGCGSGICIAPNVCSCQDGEQGATCPETHGPCGEYGCDLTCNHGGCQEVARVCPVGFSMTETAVGIRCTDIDECVTSSCEGHCVNTEGGFVCECGPGMQLSADRHSCQDTDECLGTPCQQRCKNSIGSYKCSCRTGFHLHGNRHSCVDVNECRRPLERRVCHHSCHNTVGSFLCTCRPGFRLRADRVSCEAFPKAVLAPSAILQPRQHPSKMLLLLPEAGRPALSPGHSPPSGAPGPPAGVRTTRLPSPTPRLPTSSPSAPVWLLSTLLATPVPTASLLGNLRPPSLLQGEVMGTPSSPRGPESPRLAAGPSPCWHLGAMHESRSRWTEPGCSQCWCEDGKVTCEKVRCEAACSHPIPSRDGGCCPSCTGCFHSGVVRAEGDVFSPPNENCTVCVCLAGNVSCISPECPSGPCQTPPQTDCCTCVPVRCYFHGRWYADGAVFSGGGDECTTCVCQNGEVECSFMPCPELACPREEWRLGPGQCCFTCQEPTPSTGCSLDDNGVEFPIGQIWSPGDPCELCICQADGSVSCKRTDCVDSCPHPIRIPGQCCPDCSAGCTYTGRIFYNNETFPSVLDPCLSCICLLGSVACSPVDCPITCTYPFHPDGECCPVCRDCNYEGRKVANGQVFTLDDEPCTRCTCQLGEVSCEKVPCQRACADPALLPGDCCSSCPDSLSPLEEKQGLSPHGNVAFSKAGRSLHGDTEAPVNCSSCPGPPTASPSRPVLHLLQLLLRTNLMKTQTLPTSPAGAHGPHSLALGLTATFPGEPGASPRLSPGPSTPPGAPTLPLASPGAPQPPPVTPERSFSASGAQIVSRWPPLPGTLLTEASALSMMDPSPSKTPITLLGPRVLSPTTSRLSTALAATTHPGPQQPPVGASRGEESTM

SEQ ID NO: 96926 - protein, 173 aa, Homo sapiens
  Payload ID: 19334
  Gene Name: von Willebrand factor C and EGF domains
  ENSP ID: ENSP00000441565
MWAGLLLRAACVALLLPGAPARGYTGRKPPGHFAAERRRLGPHVCLSGFGSGCCPGWAPSMGGGHCTLRKCLSLCPKSSPPAVCVASPQSLVRGADGRPQFLVSHLHFSSQPSAPSAVGVASASLPMSAPARMESKGPPAQKPMDHVGSTAVTLPATMEAVRRWPECAPWASR

SEQ ID NO: 96927 - protein, 420 aa, Homo sapiens
  Payload ID: 19334
  Gene Name: von Willebrand factor C and EGF domains
  ENSP ID: ENSP00000442570
MPCPELACPREEWRLGPGQCCFTCQEPTPSTGCSLDDNGVEFPIGQIWSPGDPCELCICQADGSVSCKRTDCVDSCPHPIRIPGQCCPDCSAGCTYTGRIFYNNETFPSVLDPCLSCICLLGSVACSPVDCPITCTYPFHPDGECCPVCRDCNYEGRKVANGQVFTLDDEPCTRCTCQLGEVSCEKVPCQRACADPALLPGDCCSSCPDSLSPLEEKQGLSPHGNVAFSKAGRSLHGDTEAPVNCSSCPGPPTASPSRPVLHLLQLLLRTNLMKTQTLPTSPAGAHGPHSLALGLTATFPGEPGASPRLSPGPSTPPGAPTLPLASPGAPQPPPVTPERSFSASGAQIVSRWPPLPGTLLTEASALSMMDPSPSKTPITLLGPRVLSPTTSRLSTALAATTHPGPQQPPVGASRGEESTM

SEQ ID NO: 96928 - protein, 670 aa, Homo sapiens [sequence omitted]

SEQ ID NO: 96929 - protein, 325 aa, Homo sapiens
  Payload ID: 19335
  Gene Name: von Willebrand factor C domain containing 2
  Uniprot ID: Q2TAL6
  ENSP ID: ENSP00000341819
MPSSTAMAVGALSSSLLVTCCLMVALCSPSIPLEKLAQAPEQPGQEKREHASRDGPGRVNELGRPARDEGGSGRDWKSKSGRGLAGREPWSKLKQAWVSQGGGAKAGDLQVRPRGDTPQAEALAAAAQDAIGPELAPTPEPPEEYVYPDYRGKGCVDESGFVYAIGEKFAPGPSACPCLCTEEGPLCAQPECPRLHPRCIHVDTSQCCPQCKERKNYCEFRGKTYQTLEEFVVSPCERCRCEANGEVLCTVSACPQTECVDPVYEPDQCCPICKNGPNCFAETAVIPAGREVKTDECTICHCTYEEGTWRIERQAMCTRHECRQM

SEQ ID NO: 96930 - protein, 222 aa, Homo sapiens
  Payload ID: 19336
  Gene Name: von Willebrand factor C domain containing protein 2-like
  Uniprot ID: B2RUY7
  ENSP ID: ENSP00000308976
MALHIHEACILLLVIPGLVTSAAISHEDYPADEGDQISSNDNLIFDDYRGKGCVDDSGFVYKLGERFFPGHSNCPCVCALDGPVCDQPECPKIHPKCTKVEHNGCCPECKEVKNFCEYHGKNYKILEEFKPSPCEWCRCEPSNEVHCVVADCAVPECVNPVYEPEQCCPVCKNGPNCFAGTTIIPAGIEVKVDECNICHCHNGDWWKPAQCSKRECQGKQTV

SEQ ID NO: 96931 - protein, 139 aa, Homo sapiens
  Payload ID: 19336
  Gene Name: von Willebrand factor C domain containing protein 2-like
  ENSP ID: ENSP00000403779
MALHIHEACILLLVIPGLVTSAAISHEDYPADEGDQISSNDNLIFDDYRGKGCVDDSGFVYKLGERFFPGHSNCPCVCALDGPVCDQPECPKIHPKCTKVEHNGCCPECKEVKNFCEYHGKNYKILEEFKVQTALQERR

SEQ ID NO: 96932 - protein, 1590 aa, Homo sapiens
  Payload ID: 19337
  Gene Name: von Willebrand factor D and EGF domains
  Uniprot ID: Q8N2E2
  ENSP ID: ENSP00000275358
MPGGACVLVIALMFLAWGEAQECSPGGHQFLRSPYRSVRFDSWHLQQSAVQDLICDHSLSPGWYRFLILDRPAEMPTKCVEMNHCGTQAPIWLSLRDSETLPSPGEIKQLTACATWQFLFSTTKDCCLFQIPVSVRNCGNFSVYLLQPTQGCMGYCAEAISDARLHPCGSDETETGGDCVRQLAASLPPPPAGRPEVLVELIESRLFCRCSFDVPATKNSVGFHIAWSRLSSQEVKEELTQETTVQAFSLLELDGINLRLGDRIFCSASVFFLENPHVQSVAIESQEFFAGFKLQPELSTISEDGKEYYLRIESTVPIICSEFSELDQECKISLKLKTIGQGREHLGLNLALSSCHVDLLQTSSCANGTCSHTFVYYTAVTDFSRDGDRVSNIVVQPIVNEDFLWNNYIPDSIQIKVKDVPTAYCYTFTDPHIITFDGRVYDNFKTGTFVLYKSMSRDFEVHVRQWDCRSLHYPVSCNCGFVAQEGGDIVTFDMCNGQLRESQPYLFIKSQDVTRNIKISESYLGRKVTIWFSSGAFIRADLGEWGMSLTIRAPSVDYRNTLGLCGTFDENPENDFHDKNGMQIDQNFNNYVAFINEWRILPGKSMSDTLPVSMTSPGKPSYCSCSLDTAAYPSSEDLDSVSRSEIALGCKDLNHVSLSSLIPELDVTSEYINSDTLVREINKHTSPEEYNLNLFLQEKKHINLTKLGLNVQKHPGNEKEDSLQYLANKKYTQGRGSHSQEMRYNRQNRWKRQNFHEFPPLFAFPSLSQTDLEELTYFFPEDHAEDVQQEFFPSWPTPSGLTEYSTLTLCQETLANSSIGRLCLAFLGKRLDSVIEMCVKDVLLKDDLSWAEAGVALLENECEKRIVEEGKYNTEEYGTSIEDILSVLKCPNLCSGNGQCMEWGCACSPSFSSYDCSDSYDKAPEITELGNAGFCDVQKYNCMMVRVFGKGFKELPSIKCEVTKLQYNSSEWMPGEPIYTQTVFHNSRAVDCQLPTDVQQFDTMDLVGGKPTGKWQLKVSNDGYKFSNPKITVIYDGACQVCGLYKNDSCTIKENVCIIDGLCYVEGDKNPTSPCLICRPKISRFTWSFLENNQPPVIQALQDKLQTFYGENFEYQFVAFDPEGSDIHFTLDSGPEGASVSSAGLFMWKTDLLTTQQITVRLNDDCDAETRVTIEVTVKSCDCLNGGSCVSDRNFSPGSGVYLCVCLPGFHGSLCEVDISGCQSNPCGLGSYISGFHSYSCDCPPELKVETQFVNQFTTQTVVLTRSDKSVNKEEDDKNAQGRKRHVKPTSGNAFTICKYPCGKSRECVAPNICKCKPGYIGSNCQTALCDPDCKNHGKCIKPNICQCLPGHGGATCDEEHCNPPCQHGGTCLAGNLCTCPYGFVGPRCETMVCNRHCENGGQCLTPDICQCKPGWYGPTCSTALCDPVCLNGGSCNKPNTCLCPNGFFGEHCQNAFCHPPCKNGGHCMRNNVCVCREGYTGRRFQKSICDPTCMNGGKCVGPSTCSCPSGWSGKRCNTPICLQKCKNGGECIAPSICHCPSSWEGVRCQIPICNPKCLYGGRCIFPNVCSCRTEYSGVKCEKKIQIRRH

SEQ ID NO: 96933 - protein, 170 aa, Homo sapiens
  Payload ID: 19337
  Gene Name: von Willebrand factor D and EGF domains
  ENSP ID: ENSP00000317143
MPGGACVLVIALMFLAWGEAQECSPGGHQFLRSPYRSVRFDSWHLQQSAVQDLICDHSLSPGWYRFLILDRPAEMPTKCVEMNHCGTQAPIWLSLRDSETLPSPGEIKQLTACATWQFLFSTTKDCCLFQIPVSVRNCGNFSVYLLQPTQGCMGYCAEGFFAKIVKSPHT

SEQ ID NO: 96934 - protein, 1302 aa, Homo sapiens
  Payload ID: 19337
  Gene Name: von Willebrand factor D and EGF domains
  ENSP ID: ENSP00000401687
MPGGACVLVIALMFLAWGEAQECSPGGHQFLRSPYRSVRFDSWHLQQSAVQDLICDHSLSPGWYRFLILDRPAEMPTKCVEMNHCGTQAPIWLSLRDSETLPSPGEIKQLTACATWQFLFSTTKDCCLFQIPVSVRNCGNFSVYLLQPTQGCMGYCAEAISDARLHPCGSDETETGGDCVRQLAASLPPPPAGRPEVLVELIESRLFCRCSFDVPATKNSVGFHIAWSRLSSQEVKEELTQETTVQAFSLLELDGINLRLGDRIFCSASVFFLENPHVQSVAIESQEFFAGFKLQPELSTISEDGKEYYLRIESTVPIICSEFSELDQECKISLKLKTIGQGREHLGLNLALSSCHVDLLQTSSCANGTCSHTFVYYTAVTDFSRDGDRVSNIVVQPIVNEDFLWNNYIPDSIQIKVKDVPTAYCYTFTDPHIITFDGRVYDNFKTGTFVLYKSMSRDFEVHVRQWDCRSLHYPVSCNCGFVAQEGGDIVTFDMCNGQLRESQPYLFIKSQDVTRNIKISESYLGRKVTIWFSSGAFIRADLGEWGMSLTIRAPSVDYRNTLGLCGTFDENPENDFHDKNGMQIDQNFNNYVAFINEWRILPGKSMSDTLPVSMTSPGKPSYCSCSLDTAAYPSSEDLDSVSRSEIALGCKDLNHVSLSSLIPELDVTSEYINSDTLVREINKHTSPEEYNLNLFLQEKKHINLTKLGLNVQKHPGNEKEDSLQYLANKKYTQGRGSHSQEMRYNRQNRWKRQNFHEFPPLFAFPSLSQTDLEELTYFFPEDHAEDVQQEFFPSWPTPSGLTEYSTLTLCQETLANSSIGRLCLAFLGKRLDSVIEMCVKDVLLKDDLSWAEAGVALLENECEKRIVEEGKYNTEEYGTSIEDILSVLKCPNLCSGNGQCMEWGCACSPSFSSYDCSDSYDKAPEITELGNAGFCDVQKYNCMMVRVFGKGFKELPSIKCEVTKLQYNSSEWMPGEPIYTQTVFHNSRAVDCQLPTDVQQFDTMDLVGGKPTGKWQLKVSNDGYKFSNPKITVIYDGACQVCGLYKNDSCTIKENVCIIDGLCYVEGDKNPTSPCLICRPKISRFTWSFLENNQPPVIQALQDKLQTFYGENFEYQFVAFDPEGSDIHFTLDSGPEGASVSSAGLFMWKTDLLTTQQITVRLNDDCDAETRVTIEVTVKSCDCLNGGSCVSDRNFSPGSGVYLCVCLPGFHGSLCEVDISGCQSNPCGLGSYISGFHSYSCDCPPELKGKNCQEDVDECDSKPCFEGVACLNTFGSYHCGSCPEGFYGDGKICHGKSFYFLL

SEQ ID NO: 96935 - protein, 352 aa, Homo sapiens
  Payload ID: 19337
  Gene Name: von Willebrand factor D and EGF domains
  ENSP ID: ENSP00000428810
MPGGACVLVIALMFLAWGEAQECSPGGHQFLRSPYRSVRFDSWHLQQSAVQDLICDHSLSPGWYRFLILDRPAEMPTKCVEMNHCGTQAPIWLSLRDSETLPSPGEIKQLTACATWQFLFSTTKDCCLFQIPVSVRNCGNFSVYLLQPTQGCMGYCAEAISDARLHPCGSDETETGGDCVRQLAASLPPPPAGRPEVLVELIESRLFCRCSFDVPATKNSVGFHIAWSRLSSQEVKEELTQETTVQAFSLLELDGINLRLGDRIFCSASVFFLENPHVQSVAIESQEFFAGFKLQPELSTISEDGKEYYLRIESTVPIICSEFSELDQECKISLKLKTIGQDLVFFWGIYPC

SEQ ID NO: 96936 - protein, 944 aa, Homo sapiens
  Payload ID: 19337
  Gene Name: von Willebrand factor D and EGF domains
  ENSP ID: ENSP00000481403
MSLTIRAPSVDYRNTLGLCGTFDENPENDFHDKNGMQIDQNFNNYVAFINEWRILPGKSMSDTLPVSMTSPGKPSYCSCSLDTAAYPSSEDLDSVSRSEIALGCKDLNHVSLSSLIPELDVTSEYINSDTLVREINKHTSPEEYNLNLFLQEKKHINLTKLGLNVQKHPGNEKEDSLQYLANKKYTQGRGSHSQEMRYNRQNRWKRQNFHEFPPLFAFPSLSQTDLEELTYFFPEDHAEDVQQEFFPSWPTPSGLTEYSTLTLCQETLANSSIGRLCLAFLGKRLDSVIEMCVKDVLLKDDLSWAEAGVALLENECEKRIVEEGKYNTEEYGTSIEDILSVLKCPNLCSGNGQCMEWGCACSPSFSSYDCSDSYDKAPEITELGNAGFCDVQKYNCMMVRVFGKGFKELPSIKCEVTKLQYNSSEWMPGEPIYTQTVFHNSRAVDCQLPTDVQQFDTMDLVGGKPTGKWQLKVSNDGYKFSNPKITVIYDGACQVCGLYKNDSCTIKENVCIIDGLCYVEGDKNPTSPCLICRPKISRFTWSFLENNQPPVIQALQDKLQTFYGENFEYQFVAFDPEGSDIHFTLDSGPEGASVSSAGLFMWKTDLLTTQQITVRLNDDCDAETRVTIEVTVKSCDCLNGGSCVSDRNFSPGSGVYLCVCLPGFHGSLCEVDISGCQSNPCGLGSYISGFHSYSCDCPPELKVETQFVNQFTTQTVVLTRSDKSVNKEEDDKNAQGRKRHVKPTSGNAFTICKYPCGKSRECVAPNICKCKPGYIGSNCQTALCDPDCKNHGKCIKPNICQCLPGHGGATCDEEHCNPPCQHGGTCLAGNLCTCPYGFVGPRCETMVCNRHCENGGQCLTPDICQCKPGWYGPTCSTALCDPVCLNGGSCNKPNTCLCPNGFFGEHCQNAFCHPPCKNGGHCMRNNVCVCREGYTGRRFQKRHL

SEQ ID NO: 96937 - protein, 1058 aa, Homo sapiens
  Payload ID: 19338
  Gene Name: Vpr (HIV-1) binding protein
  Uniprot ID: Q9Y4B6
  ENSP ID: ENSP00000338857
MTTVVVHVDSKAELTTLLEQWEKEHGSGQDMVPILTRMSQLIEKETEEYRKGDPDPFDDRHPGRADPECMLGHLLRILFKNDDFMNALVNAYVMTSREPPLNTAACRLLLDIMPGLETAVVFQEKEGIVENLFKWAREADQPLRTYSTGLLGGAMENQDIAANYRDENSQLVAIVLRRLRELQLQEVALRQENKRPSPRKLSSEPLLPLDEEAVDMDYGDMAVDDAEIQKSALQIIINCVCGPDNRISSIGKFISGTPRRKLPQNPKSSEHTLAKMWNVVQSNNGIKVLLSLLSIKMPITDADQIRALACKALVGLSRSSTVRQIISKLPLFSSCQIQQLMKEPVLQDKRSDHVKFCKYAAELIERVSGKPLLIGTDVSLARLQKADVVAQSRISFPEKELLLLIRNHLISKGLGETATVLTKEADLPMTAASHSSAFTPVTAAASPVSLPRTPRIANGIATRLGSHAAVGASAPSAPTAHPQPRPPQGPLALPGPSYAGNSPLIGRISFIRERPSPCNGRKIRVLRQKSDHGAYSQSPAIKKQLDRHLPSPPTLDSIITEYLREQHARCKNPVATCPPFSLFTPHQCPEPKQRRQAPINFTSRLNRRASFPKYGGVDGGCFDRHLIFSRFRPISVFREANEDESGFTCCAFSARERFLMLGTCTGQLKLYNVFSGQEEASYNCHNSAITHLEPSRDGSLLLTSATWSQPLSALWGMKSVFDMKHSFTEDHYVEFSKHSQDRVIGTKGDIAHIYDIQTGNKLLTLFNPDLANNYKRNCATFNPTDDLVLNDGVLWDVRSAQAIHKFDKFNMNISGVFHPNGLEVIINTEIWDLRTFHLLHTVPALDQCRVVFNHTGTVMYGAMLQADDEDDLMEERMKSPFGSSFRTFNATDYKPIATIDVKRNIFDLCTDTKDCYLAVIENQGSMDALNMDTVCRLYEVGRQRLAEDEDEEEDQEEEEQEEEDDDEDDDDTDDLDELDTDQLLEAELEEDDNNENAGEDGDNDFSPSDEELANLLEEGEDGEDEDSDADEEVELILGDTDSSDNSDLEDDIILSLNE

SEQ ID NO: 96938 - protein, 1507 aa, Homo sapiens
  Payload ID: 19338
  Gene Name: Vpr (HIV-1) binding protein
  Uniprot ID: Q9Y4B6
  ENSP ID: ENSP00000393183
MTTVVVHVDSKAELTTLLEQWEKEHGSGQDMVPILTRMSQLIEKETEEYRKGDPDPFDDRHPGRADPECMLGHLLRILFKNDDFMNALVNAYVMTSREPPLNTAACRLLLDIMPGLETAVVFQEKEGIVENLFKWAREADQPLRTYSTGLLGGAMENQDIAANYRDENSQLVAIVLRRLRELQLQEVALRQENKRPSPRKLSSEPLLPLDEEAVDMDYGDMAVDVVDGDQEEASGDMEISFHLDSGHKTSSRVNSTTKPEDGGLKKNKSAKQGDRENFRKAKQKLGFSSSDPDRMFVELSNSSWSEMSPWVIGTNYTLYPMTPAIEQRLILQYLTPLGEYQELLPIFMQLGSRELMMFYIDLKQTNDVLLTFEALKHLASLLLHNKFATEFVAHGGVQKLLEIPRPSMAATGVSMCLYYLSYNQDAMERVCMHPHNVLSDVVNYTLWLMECSHASGCCHATMFFSICFSFRAVLELFDRYDGLRRLVNLISTLEILNLEDQGALLSDDEIFASRQTGKHTCMALRKYFEAHLAIKLEQVKQSLQRTEGGILVHPQPPYKACSYTHEQIVEMMEFLIEYGPAQLYWEPAEVFLKLSCVQLLLQLISIACNWKTYYARNDTVRFALDVLAILTVVPKIQLQLAESVDVLDEAGSTVSTVGISIILGVAEGEFFIHDAEIQKSALQIIINCVCGPDNRISSIGKFISGTPRRKLPQNPKSSEHTLAKMWNVVQSNNGIKVLLSLLSIKMPITDADQIRALACKALVGLSRSSTVRQIISKLPLFSSCQIQQLMKEPVLQDKRSDHVKFCKYAAELIERVSGKPLLIGTDVSLARLQKADVVAQSRISFPEKELLLLIRNHLISKGLGETATVLTKEADLPMTAASHSSAFTPVTAAASPVSLPRTPRIANGIATRLGSHAAVGASAPSAPTAHPQPRPPQGPLALPGPSYAGNSPLIGRISFIRERPSPCNGRKIRVLRQKSDHGAYSQSPAIKKQLDRHLPSPPTLDSIITEYLREQHARCKNPVATCPPFSLFTPHQCPEPKQRRQAPINFTSRLNRRASFPKYGGVDGGCFDRHLIFSRFRPISVFREANEDESGFTCCAFSARERFLMLGTCTGQLKLYNVFSGQEEASYNCHNSAITHLEPSRDGSLLLTSATWSQPLSALWGMKSVFDMKHSFTEDHYVEFSKHSQDRVIGTKGDIAHIYDIQTGNKLLTLFNPDLANNYKRNCATFNPTDDLVLNDGVLWDVRSAQAIHKFDKFNMNISGVFHPNGLEVIINTEIWDLRTFHLLHTVPALDQCRVVFNHTGTVMYGAMLQADDEDDLMEERMKSPFGSSFRTFNATDYKPIATIDVKRNIFDLCTDTKDCYLAVIENQGSMDALNMDTVCRLYEVGRQRLAEDEDEEEDQEEEEQEEEDDDEDDDDTDDLDELDTDQLLEAELEEDDNNENAGEDGDNDFSPSDEELANLLEEGEDGEDEDSDADEEVELILGDTDSSDNSDLEDDIILSLNE

SEQ ID NO: 96939 - protein, 1506 aa, Homo sapiens
  Payload ID: 19338
  Gene Name: Vpr (HIV-1) binding protein
  Uniprot ID: Q9Y4B6
  ENSP ID: ENSP00000421724
MTTVVVHVDSKAELTTLLEQWEKEHGSGQDMVPILTRMSQLIEKETEEYRKGDPDPFDDRHPGRADPECMLGHLLRILFKNDDFMNLVNAYVMTSREPPLNTAACRLLLDIMPGLETAVVFQEKEGIVENLFKWAREADQPLRTYSTGLLGGAMENQDIAANYRDENSQLVAIVLRRLRELQLQEVALRQENKRPSPRKLSSEPLLPLDEEAVDMDYGDMAVDVVDGDQEEASGDMEISFHLDSGHKTSSRVNSTTKPEDGGLKKNKSAKQGDRENFRKAKQKLGFSSSDPDRMFVELSNSSWSEMSPWVIGTNYTLYPMTPAIEQRLILQYLTPLGEYQELLPIFMQLGSRELMMFYIDLKQTNDVLLTFEALKHLASLLLHNKFATEFVAHGGVQKLLEIPRPSMAATGVSMCLYYLSYNQDAMERVCMHPHNVLSDVVNYTLWLMECSHASGCCHATMFFSICFSFRAVLELFDRYDGLRRLVNLISTLEILNLEDQGALLSDDEIFASRQTGKHTCMALRKYFEAHLAIKLEQVKQSLQRTEGGILVHPQPPYKACSYTHEQIVEMMEFLIEYGPAQLYWEPAEVFLKLSCVQLLLQLISIACNWKTYYARNDTVRFALDVLAILTVVPKIQLQLAESVDVLDEAGSTVSTVGISIILGVAEGEFFIHDAEIQKSALQIIINCVCGPDNRISSIGKFISGTPRRKLPQNPKSSEHTLAKMWNVVQSNNGIKVLLSLLSIKMPITDADQIRALACKALVGLSRSSTVRQIISKLPLFSSCQIQQLMKEPVLQDKRSDHVKFCKYAAELIERVSGKPLLIGTDVSLARLQKADVVAQSRISFPEKELLLLIRNHLISKGLGETATVLTKEADLPMTAASHSSAFTPVTAAASPVSLPRTPRIANGIATRLGSHAAVGASAPSAPTAHPQPRPPQGPLALPGPSYAGNSPLIGRISFIRERPSPCNGRKIRVLRQKSDHGAYSQSPAIKKQLDRHLPSPPTLDSIITEYLREQHARCKNPVATCPPFSLFTPHQCPEPKQRRQAPINFTSRLNRRASFPKYGGVDGGCFDRHLIFSRFRPISVFREANEDESGFTCCAFSARERFLMLGTCTGQLKLYNVFSGQEEASYNCHNSAITHLEPSRDGSLLLTSATWSQPLSALWGMKSVFDMKHSFTEDHYVEFSKHSQDRVIGTKGDIAHIYDIQTGNKLLTLFNPDLANNYKRNCATFNPTDDLVLNDGVLWDVRSAQAIHKFDKFNMNISGVFHPNGLEVIINTEIWDLRTFHLLHTVPALDQCRVVFNHTGTVMYGAMLQADDEDDLMEERMKSPFGSSFRTFNATDYKPIATIDVKRNIFDLCTDTKDCYLAVIENQGSMDALNMDTVCRLYEVGRQRLAEDEDEEEDQEEEEQEEEDDDEDDDDTDDLDELDTDQLLEAELEEDDNNENAGEDGDNDFSPSDEELANLLEEGEDGEDEDSDADEEVELILGDTDSSDNSDLEDDIILSLNE

SEQ ID NO: 96940 - protein, 941 aa, Homo sapiens; identical to SEQ ID NO: 96128
  Payload ID: 19339
  Gene Name: VPS11, CORVET/HOPS core subunit
  ENSP ID: ENSP00000485929

SEQ ID NO: 96941 - protein, 931 aa, Homo sapiens; identical to SEQ ID NO: 96129
  Payload ID: 19339
  Gene Name: VPS11, CORVET/HOPS core subunit
  ENSP ID: ENSP00000486795

SEQ ID NO: 96942 - protein, 181 aa, Homo sapiens; identical to SEQ ID NO: 96130
  Payload ID: 19339
  Gene Name: VPS11, CORVET/HOPS core subunit
  ENSP ID: ENSP00000487072
  MOD_RES (1)..(1): Any amino acid

SEQ ID NO: 96943 - protein, 484 aa, Homo sapiens; identical to SEQ ID NO: 96127
  Payload ID: 19339
  Gene Name: VPS11, CORVET/HOPS core subunit
  ENSP ID: ENSP00000487452

SEQ ID NO: 96944 - protein, 327 aa, Homo sapiens
  Payload ID: 19340
  Gene Name: VPS26 retromer complex component A
  Uniprot ID: O75436
  ENSP ID: ENSP00000263559
MSFLGGFFGPICEIDIVLNDGETRKMAEMKTEDGKVEKHYLFYDGESVSGKVNLAFKQPGKRLEHQGIRIEFVGQIELFNDKSNTHEFVNLVKELALPGELTQSRSYDFEFMQVEKPYESYIGANVRLRYFLKVTIVRRLTDLVKEYDLIVHQLATYPDVNNSIKMEVGIEDCLHIEFEYNKSKYHLKDVIVGKIYFLLVRIKIQHMELQLIKKEITGIGPSTTTETETIAKYEIMDGAPVKGESIPIRLFLAGYDPTPTMRDVNKKFSVRYFLNLVLVDEEDRRYFKQQEIILWRKAPEKLRKQRTNFHQRFESPESQASAEQPEM

SEQ ID NO: 96945 - protein, 327 aa, Homo sapiens; identical to SEQ ID NO: 96944
  Payload ID: 19340
  Gene Name: VPS26 retromer complex component A
  Uniprot ID: O75436
  ENSP ID: ENSP00000362480

SEQ ID NO: 96946 - protein, 251 aa, Homo sapiens
  Payload ID: 19340
  Gene Name: VPS26 retromer complex component A
  Uniprot ID: O75436
  ENSP ID: ENSP00000378532
MSFLGGFFGPICEIDIVLNDGETRKMAEMKTEDGKVEKHYLFYDGESVSGKVNLAFKQPGKRLEHQGIRIEFVGQIELFNDKSNTHEFVNLVKELALPGELTQSRSYDFEFMQVEKPYESYIGANVRLRYFLKVTIVRRLTDLVKEYDLIVHQLATYPDVNNSIKMEVGIEDCLHIEFEYNKSKYHLKDVIVGKIYFLLVRIKIQHMELQLIKKEITGIGPSTTTETETIAKYEIMDGAPVKGDNFMEKSS

SEQ ID NO: 96947 - protein, 63 aa, Homo sapiens
  Payload ID: 19340
  Gene Name: VPS26 retromer complex component A
  ENSP ID: ENSP00000473746
MSFLGGFFGPICEIDIVLNDGETRKMAEMKTEDGKVEKHYLFYDGESVSGKNFSMTRVILMNL

SEQ ID NO: 96948 - protein, 226 aa, Homo sapiens
  Payload ID: 19340
  Gene Name: VPS26 retromer complex component A
  ENSP ID: ENSP00000474611
MAEMKTEDGKVEKHYLFYDGESVSGKVNLAFKQPGKRLEHQGIRIEFVGQIELFNDKSNTHEFVNLVKELALPGELTQSRSYDFEFMQVEKPYESYIGANVRLRYFLKVTIVRRLTDLVKEYDLIVHQLATYPDVNNSIKMEVGIEDCLHIEFEYNKSKYHLKDVIVGKIYFLLVRIKIQHMELQLIKKEITGIGPSTTTETETIAKYEIMDGAPVKGDNFMEKSS

SEQ ID NO: 96949 - protein, 336 aa, Homo sapiens
  Payload ID: 19341
  Gene Name: VPS26 retromer complex component B
  Uniprot ID: Q4G0F5
  ENSP ID: ENSP00000281187
MSFFGFGQSVEVEILLNDAESRKRAEHKTEDGKKEKYFLFYDGETVSGKVSLALKNPNKRLEHQGIKIEFIGQIELYYDRGNHHEFVSLVKDLARPGEITQSQAFDFEFTHVEKPYESYTGQNVKLRYFLRATISRRLNDVVKEMDIVVHTLSTYPELNSSIKMEVGIEDCLHIEFEYNKSKYHLKDVIVGKIYFLLVRIKIKHMEIDIIKRETTGTGPNVYHENDTIAKYEIMDGAPVRGESIPIRLFLAGYELTPTMRDINKKFSVRYYLNLVLIDEEERRYFKQQEVVLWRKGDIVRKSMSHQAAIASQRFEGTTSLGEVRTPSQLSDNNCRQ

SEQ ID NO: 96950 - protein, 72 aa, Homo sapiens
  Payload ID: 19341
  Gene Name: VPS26 retromer complex component B
  ENSP ID: ENSP00000431672
  MOD_RES (1)..(1): Any amino acid
XAEHKTEDGKKEKYFLFYDGETVSGKVSLALKNPNKRLEHQGIKIEFIGQIAISFVLPSAAASMMLSKRWTL

SEQ ID NO: 96951 - protein, 336 aa, Homo sapiens; identical to SEQ ID NO: 96949
  Payload ID: 19341
  Gene Name: VPS26 retromer complex component B
  Uniprot ID: Q4G0F5
  ENSP ID: ENSP00000434162

SEQ ID NO: 96952 - protein, 48 aa, Homo sapiens
  Payload ID: 19341
  Gene Name: VPS26 retromer complex component B
  ENSP ID: ENSP00000486811
GEITQSQAFDFEFTHVEKPYESYTGQNVKLRGFVLSVCTAERKVLKPV

SEQ ID NO: 96953 - protein, 186 aa, Homo sapiens
  Payload ID: 19342
  Gene Name: VPS29 retromer complex component
  Uniprot ID: Q9UBQ0
  ENSP ID: ENSP00000353786
MAGHRLVLVLGDLHIPHRCNSLPAKFKKLLVPGKIQHILCTGNLCTKESYDYLKTLAGDVHIVRGDFDENLNYPEQKVVTVGQFKIGLIHGHQVIPWGDMASLALLQRQFDVDILISGHTHKFEAFEHENKFYINPGSATGAYNALETNIIPSFVLMDIQASTVVTYVYQLIGDDVKVERIEYKKP

SEQ ID NO: 96954 - protein, 87 aa, Homo sapiens
  Payload ID: 19342
  Gene Name: VPS29 retromer complex component
  ENSP ID: ENSP00000400048
MASLALLQRQFDVDILISGHTHKFEAFEHENKFYINPGSATGAYNALETNIIPSFVLMDIQASTVVTYVYQLIGDDVKVERIEYKKP

SEQ ID NO: 96955 - protein, 182 aa, Homo sapiens [sequence omitted]

SEQ ID NO: 96956 - protein, 87 aa, Homo sapiens; identical to SEQ ID NO: 96954
  Payload ID: 19342
  Gene Name: VPS29 retromer complex component
  ENSP ID: ENSP00000447634

SEQ ID NO: 96957 - protein, 214 aa, Homo sapiens
  Payload ID: 19342
  Gene Name: VPS29 retromer complex component
  ENSP ID: ENSP00000449044
MSRCALRGRDLALAIAGTVSFHGLLRLFRAGHRLVLVLGDLHIPHRCNSLPAKFKKLLVPGKIQHILCTGNLCTKESYDYLKTLAGDVHIVRGDFDENLNYPEQKVVTVGQFKIGLIHGHQVIPWGDMASLALLQRQFDVDILISGHTHKFEAFEHENKFYINPGSATGAYNALETNIIPSFVLMDIQASTVVTYVYQLIGDDVKVERIEYKKP

SEQ ID NO: 96958 - protein, 87 aa, Homo sapiens; identical to SEQ ID NO: 96954
  Payload ID: 19342
  Gene Name: VPS29 retromer complex component
  ENSP ID: ENSP00000449954

SEQ ID NO: 96959 - protein, 214 aa, Homo sapiens; identical to SEQ ID NO: 96957
  Payload ID: 19342
  Gene Name: VPS29 retromer complex component
  ENSP ID: ENSP00000480853

SEQ ID NO: 96960 - protein, 444 aa, Homo sapiens
  Payload ID: 19343
  Gene Name: VPS33B interacting protein, apical-basolateral polarity regulator, spe-39 homolog
  Uniprot ID: Q9H9C1
  ENSP ID: ENSP00000313098
MNRTKGDEEEYWNSSKFKAFTFDDEDDELSQLKESKRAVNSLRDFVDDDDDDDLERVSWSGEPVGSRTRPGSFQSLSDALSDTPAKSYAPELGRPKGEYRDYSNDWSPSDTVRRLRKGKVCSLERFRSLQDKLQLLEEAVSMHDGNVITAVLIFLKRTLSKEILFRELEVRQVALRHLIHFLKEIGDQKLLLDLFRFLDRTEELALSHYREHLNIQDPDKRKEFLKTCVGLPFSAEDSAHIQDHYTLLERQIIIEANDRHLESAGQTEIFRKHPRKASILNMPLVTTLFYSCFYHYTEAEGTFSSPVNLKKTFKIPDKQYVLTALAARAKLRAWNDVDALFTTKNWLGYTKKRAPIGFHRVVEILHKNNAPVQILQEYVNLVEDVDTKLNLATKFKCHDVVIDTYRDLKDRQQLLAYRSKVDKGSAEEEKIDALLSSSQIRWKN

SEQ ID NO: 96961 - protein, 493 aa, Homo sapiens
  Payload ID: 19343
  Gene Name: VPS33B interacting protein, apical-basolateral polarity regulator, spe-39 homolog
  Uniprot ID: Q9H9C1
  ENSP ID: ENSP00000339122
MNRTKGDEEEYWNSSKFKAFTFDDEDDELSQLKESKRAVNSLRDFVDDDDDDDLERVSWSGEPVGSISWSIRETAGNSGSTHEGREQLKSRNSFSSYAQLPKPTSTYSLSSFFRGRTRPGSFQSLSDALSDTPAKSYAPELGRPKGEYRDYSNDWSPSDTVRRLRKGKVCSLERFRSLQDKLQLLEEAVSMHDGNVITAVLIFLKRTLSKEILFRELEVRQVALRHLIHFLKEIGDQKLLLDLFRFLDRTEELALSHYREHLNIQDPDKRKEFLKTCVGLPFSAEDSAHIQDHYTLLERQIIIEANDRHLESAGQTEIFRKHPRKASILNMPLVTTLFYSCFYHYTEAEGTFSSPVNLKKTFKIPDKQYVLTALAARAKLRAWNDVDALFTTKNWLGYTKKRAPIGFHRVVEILHKNNAPVQILQEYVNLVEDVDTKLNLATKFKCHDVVIDTYRDLKDRQQLLAYRSKVDKGSAEEEKIDALLSSSQIRWKN

SEQ ID NO: 96962 - protein, 444 aa, Homo sapiens; identical to SEQ ID NO: 96960
  Payload ID: 19343
  Gene Name: VPS33B interacting protein, apical-basolateral polarity regulator, spe-39 homolog
  Uniprot ID: Q9H9C1
  ENSP ID: ENSP00000404815

SEQ ID NO: 96963 - protein, 519 aa, Homo sapiens
  Payload ID: 19343
  Gene Name: VPS33B interacting protein, apical-basolateral polarity regulator, spe-39 homolog
  ENSP ID: ENSP00000451857
MTTGLILFFQSGRPLGAGVRLGLGLRMNRTKGDEEEYWNSSKFKAFTFDDEDDELSQLKESKRAVNSLRDFVDDDDDDDLERVSWSGEPVGSISWSIRETAGNSGSTHEGREQLKSRNSFSSYAQLPKPTSTYSLSSFFRGRTRPGSFQSLSDALSDTPAKSYAPELGRPKGEYRDYSNDWSPSDTVRRLRKGKVCSLERFRSLQDKLQLLEEAVSMHDGNVITAVLIFLKRTLSKEILFRELEVRQVALRHLIHFLKEIGDQKLLLDLFRFLDRTEELALSHYREHLNIQDPDKRKEFLKTCVGLPFSAEDSAHIQDHYTLLERQIIIEANDRHLESAGQTEIFRKHPRKASILNMPLVTTLFYSCFYHYTEAEGTFSSPVNLKKTFKIPDKQYVLTALAARAKLRAWNDVDALFTTKNWLGYTKKRAPIGFHRVVEILHKNNAPVQILQEYVNLVEDVDTKLNLATKFKCHDVVIDTYRDLKDRQQLLAYRSKVDKGSAEEEKIDALLSSSQIRWKN

SEQ ID NO: 96964 - protein, 45 aa, Homo sapiens
  Payload ID: 19343
  Gene Name: VPS33B interacting protein, apical-basolateral polarity regulator, spe-39 homolog
  ENSP ID: ENSP00000452176
MNRTKGDEEEYWNSSKFKAFTFDDEDDELSQLKESKRAVNSLRDF

SEQ ID NO: 96965 - protein, 493 aa, Homo sapiens; identical to SEQ ID NO: 96961
  Payload ID: 19343
  Gene Name: VPS33B interacting protein, apical-basolateral polarity regulator, spe-39 homolog
  Uniprot ID: Q9H9C1
  ENSP ID: ENSP00000452181

SEQ ID NO: 96966 - protein, 493 aa, Homo sapiens; identical to SEQ ID NO: 96961
  Payload ID: 19343
  Gene Name: VPS33B interacting protein, apical-basolateral polarity regulator, spe-39 homolog
  Uniprot ID: Q9H9C1
  ENSP ID: ENSP00000452191

SEQ ID NO: 96967 - protein, 796 aa, Homo sapiens
  Payload ID: 19344
  Gene Name: VPS35 retromer complex component
  Uniprot ID: Q96QK1
  ENSP ID: ENSP00000299138
MPTTQQSPQDEQEKLLDEAIQAVKVQSFQMKRCLDKNKLMDALKHASNMLGELRTSMLSPKSYYELYMAISDELHYLEVYLTDEFAKGRKVADLYELVQYAGNIIPRLYLLITVGVVYVKSFPQSRKDILKDLVEMCRGVQHPLRGLFLRNYLLQCTRNILPDEGEPTDEETTGDISDSMDFVLLNFAEMNKLWVRMQHQGHSRDREKRERERQELRILVGTNLVRLSQLEGVNVERYKQIVLTGILEQVVNCRDALAQEYLMECIIQVFPDEFHLQTLNPFLRACAELHQNVNVKNIIIALIDRLALFAHREDGPGIPADIKLFDIFSQQVATVIQSRQDMPSEDVVSLQVSLINLAMKCYPDRVDYVDKVLETTVEIFNKLNLEHIATSSAVSKELTRLLKIPVDTYNNILTVLKLKHFHPLFEYFDYESRKSMSCYVLSNVLDYNTEIVSQDQVDSIMNLVSTLIQDQPDQPVEDPDPEDFADEQSLVGRFIHLLRSEDPDQQYLILNTARKHFGAGGNQRIRFTLPPLVFAAYQLAFRYKENSKVDDKWEKKCQKIFSFAHQTISALIKAELAELPLRLFLQGALAAGEIGFENHETVAYEFMSQAFSLYEDEISDSKAQLAAITLIIGTFERMKCFSEENHEPLRTQCALAASKLLKKPDQGRAVSTCAHLFWSGRNTDKNGEELHGGKRVMECLKKALKIANQCMDPSLQVQLFIEILNRYIYFYEKENDAVTIQVLNQLIQKIREDLPNLESSEETEQINKHFHNTLEHLRLRRESPESEGPIYEGLIL

SEQ ID NO: 96968 - protein, 48 aa, Homo sapiens
  Payload ID: 19344
  Gene Name: VPS35 retromer complex component
  ENSP ID: ENSP00000456274
MVSAEGAVAPGSTLLVAPALSHRPALQRVEKGPHRPFGIKTSPIWPAG

SEQ ID NO: 96969 - protein, 47 aa, Homo sapiens
  Payload ID: 19344
  Gene Name: VPS35 retromer complex component
  ENSP ID: ENSP00000461423
MPTTQQSPQDEQEKLLDEAIQAVKVQSFQMKRCLCFLYLKELLAFLS

SEQ ID NO: 96970 - protein, 41 aa, Homo sapiens
  Payload ID: 19344
  Gene Name: VPS35 retromer complex component
  ENSP ID: ENSP00000461469
MPTTQQSPQDEQEKLLDEAIQAVKVQSFQMKRCLELLAFLS

SEQ ID NO: 96971 - protein, 327 aa, Homo sapiens
  Payload ID: 19345
  Gene Name: VPS50 EARP/GARPII complex subunit
  Uniprot ID: Q96JG6
  ENSP ID: ENSP00000251739
MQKIKSLMTRQGLKSPQESLSDLGAIESLRVPGKEEFRELREQPSDPQAEQELINSIEQVYFSVDSFDIVKYELEKLPPVLNLQELEAYRDKLKQQQAAVSKKVADLILEKQPAYVKELERVTSLQTGLQLAAVICTNGRRHLNIAKEGFTQASLGLLANQRKRQLLIGLLKSLRTIKTLQRTDVRLSEMLEEEDYPGAIQLCLECQKAASTFKHYSCISELNSKLQDTLEQIEEQLDVALSKICKNFDINHYTKVQQAYRLLGKTQTAMDQLHMHFTQAIHNTVFQVVLGYVELCAGNTDTKFQKLQYKDLCTVCSDLITIHISLL

SEQ ID NO: 96972 - protein, 964 aa, Homo sapiens
  Payload ID: 19345
  Gene Name: VPS50 EARP/GARPII complex subunit
  Uniprot ID: Q96JG6
  ENSP ID: ENSP00000307666
MQKIKSLMTRQGLKSPQESLSDLGAIESLRVPGKEEFRELREQPSDPQAEQELINSIEQVYFSVDSFDIVKYELEKLPPVLNLQELEAYRDKLKQQQAAVSKKVADLILEKQPAYVKELERVTSLQTGLQLAAVICTNGRRHLNIAKEGFTQASLGLLANQRKRQLLIGLLKSLRTIKTLQRTDVRLSEMLEEEDYPGAIQLCLECQKAASTFKHYSCISELNSKLQDTLEQIEEQLDVALSKICKNFDINHYTKVQQAYRLLGKTQTAMDQLHMHFTQAIHNTVFQVVLGYVELCAGNTDTKFQKLQYKDLCTHVTPDSYIPCLADLCKALWEVMLSYYRTMEWHEKHDNEDTASASEGSNMIGTEETNFDRGYIKKKLEHGLTRIWQDVQLKVKTYLLGTDLSIFKYDDFIFVLDIISRLMQVGEEFCGSKSEVLQESIRKQSVNYFKNYHRTRLDELRMFLENETWELCPVKSNFSILQLHEFKFMEQSRSPSVSPSKQPVSTSSKTVTLFEQYCSGGNPFEIQANHKDEETEDVLASNGYESDEQEKSAYQEYDSDSDVPEELKRDYVDEQTGDGPVKSVSRETLKSRKKSDYSLNKVNAPILTNTTLNVIRLVGKYMQMMNILKPIAFDVIHFMSQLFDYYLYAIYTFFGRNDSLESTGLGLSSSRLRTTLNRIQESLIDLEVSADPTATLTAAEERKEKVPSPHLSHLVVLTSGDTLYGLAERVVATESLVFLAEQFEFLQPHLDAVMPAVKKPFLQQFYSQTVSTASELRKPIYWIVAGKALDYEQMLLLMANVKWDVKEIMSQHNIYVDALLKEFEQFNRRLNEVSKRVRIPLPVSNILWEHCIRLANRTIVEGYANVKKCSNEGRALMQLDFQQFLMKLEKLTDIRPIPDKEFVETYIKAYYLTENDMERWIKEHREYSTKQLTNLVNVCLGSHINKKARQKLLAAIDDIDRPKR

SEQ ID NO: 96973 - protein, 155 aa, Homo sapiens
  Payload ID: 19345
  Gene Name: VPS50 EARP/GARPII complex subunit
  ENSP ID: ENSP00000390584
  MOD_RES (1)..(1): Any amino acid
XRKPIYWIVAGKALDYEQMLLLMANVKWDVKEIMSQHNIYVDALLKEFEQFNRRLNEVSKRVRIPLPVSNILWEHCIRLANRTIVEGYANVKKCSNEGRALMQLDFQQFLMKLEKLTDIRPIPDKEFVETYIKAYYLTENDMERWIKEHRVRAGK

SEQ ID NO: 96974 - protein, 37 aa, Homo sapiens
  Payload ID: 19345
  Gene Name: VPS50 EARP/GARPII complex subunit
  ENSP ID: ENSP00000395433
MQKIKSLMTRQGLKSPQESLSDLGAIESLRVPGKLEP

SEQ ID NO: 96975 - protein, 189 aa, Homo sapiens
  Payload ID: 19345
  Gene Name: VPS50 EARP/GARPII complex subunit
  ENSP ID: ENSP00000405553
MQKIKSLMTRQGLKSPQESLSDLGAIESLRVPGKEEFRELREQPSDPQAEQELINSIEQVYFSVDSFDIVKYELELPPVLNLQELEAYRDKLKQQQAAVSKKVADLILEKQPAYVKELERVTSLQTGLQLAAVICTNGRRHLNIAKEGFTQASLGLLANQRKRQLLIGLLKSLRTIKTLQRTDVRLSEM

SEQ ID NO: 96976 - protein, 39 aa, Homo sapiens
  Payload ID: 19345
  Gene Name: VPS50 EARP/GARPII complex subunit
  ENSP ID: ENSP00000406787
MQKIKSLMTRQGLKSPQESLSDLGAIESLRVPGKVLSYT

SEQ ID NO: 96977 - protein, 469 aa, Homo sapiens
  Payload ID: 19345
  Gene Name: VPS50 EARP/GARPII complex subunit
  ENSP ID: ENSP00000414450
  MOD_RES (1)..(1): Any amino acid
XHYSCISELNSKLQDTLEQIEEQLDVALSKICKNFDINHYTKVQQAYRLLGKTQTAMDQLHMHFTQAIHNTVFQVVLGYVELCAGNTDTKFQKLQYKDLCTHVTPDSYIPCLADLCKALWEVMLSYYRTMEWHEKHDNEDTASASEGSNMIGTEETNFDRGYIKKKLEHGLTRIWQDVQLKVKTYLLGTDLSIFKYDDFIFVLDIISRLMQVGEEFCGSKSEVLQESIRKQSVNYFKNYHRTRLDELRMFLENETWELCPVKSNFSILQLHEFKFMEQSRSPSVSPSKQPVSTSSKTVTLFEQYCSGGNPFEIQANHKDEETEDVLASNGYESDEQEKSAYQEYDSDSDVPEELKRDYVDEQTGDGPVKSVSRETLKSRKKSDYSLNKVNAPILTNTTLNVIRLVDGVSLCCLGWSTVAHLHSLQAPPPGFKPFSCLSLPRSWDYRRPPPRPANFLYFLFFSRDGVSPC

SEQ ID NO: 96978 - protein, 39 aa, Homo sapiens; identical to SEQ ID NO: 96976
  Payload ID: 19345
  Gene Name: VPS50 EARP/GARPII complex subunit
  ENSP ID: ENSP00000415809

SEQ ID NO: 96979 - protein, 934 aa, Homo sapiens
  Payload ID: 19345
  Gene Name: VPS50 EARP/GARPII complex subunit
  Uniprot ID: Q96JG6
  ENSP ID: ENSP00000443104
MLTLEEFRELREQPSDPQAEQELINSIEQVYFSVDSFDIVKYELEKLPPVLNLQELEAYRDKLKQQQAAVSKKVADLILEKQPAYVKELERVTSLQTGLQLAAVICTNGRRHLNIAKEGFTQASLGLLANQRKRQLLIGLLKSLRTIKTLQRTDVRLSEMLEEEDYPGAIQLCLECQKAASTFKHYSCISELNSKLQDTLEQIEEQLDVALSKICKNFDINHYTKVQQAYRLLGKTQTAMDQLHMHFTQAIHNTVFQVVLGYVELCAGNTDTKFQKLQYKDLCTHVTPDSYIPCLADLCKALWEVMLSYYRTMEWHEKHDNEDTASASEGSNMIGTEETNFDRGYIKKKLEHGLTRIWQDVQLKVKTYLLGTDLSIFKYDDFIFVLDIISRLMQVGEEFCGSKSEVLQESIRKQSVNYFKNYHRTRLDELRMFLENETWELCPVKSNFSILQLHEFKFMEQSRSPSVSPSKQPVSTSSKTVTLFEQYCSGGNPFEIQANHKDEETEDVLASNGYESDEQEKSAYQEYDSDSDVPEELKRDYVDEQTGDGPVKSVSRETLKSRKKSDYSLNKVNAPILTNTTLNVIRLVGKYMQMMNILKPIAFDVIHFMSQLFDYYLYAIYTFFGRNDSLESTGLGLSSSRLRTTLNRIQESLIDLEVSADPTATLTAAEERKEKVPSPHLSHLVVLTSGDTLYGLAERVVATESLVFLAEQFEFLQPHLDAVMPAVKKPFLQQFYSQTVSTASELRKPIYWIVAGKALDYEQMLLLMANVKWDVKEIMSQHNIYVDALLKEFEQFNRRLNEVSKRVRIPLPVSNILWEHCIRLANRTIVEGYANVKKCSNEGRALMQLDFQQFLMKLEKLTDIRPIPDKEFVETYIKAYYLTENDMERWIKEHREYSTKQLTNLVNVCLGSHINKKARQKLLAAIDDIDRPKR

SEQ ID NO: 96980 - protein, 631 aa, Homo sapiens
  Payload ID: 19346
  Gene Name: VPS9 domain containing 1
  Uniprot ID: Q9Y2B5
  ENSP ID: ENSP00000374037
MAAAAGDGTVKPLQSAMKLANGAIELDTGNRPREAYTEYLRSIHYISQVLLEEVETTKEAGETVPPDTSKMLKLAQQCLERAQSTAAKLGKTRLKPTMPAAAPIPQPAGRHRRVYSDEGGKLSPFLPPEIFQKLQGAESQSCKKELTPLEEASLQNQKLKAAYEARMARLDPSQAMQKTSLTLSLQRQMMENLVIAKAREETLQRKMEERRLRLQEAANRRFCSQVALTPEEREQRALYAAILEYEQDHDWPKHWKAKLKRNPGDLSLVTSLVSHLLSLPDHPIAQLLRRLQCSVYSALYPAVSRAAAPAPGCCPPTPNPGSRRLRPSQSLHCMLSPPEPSAAPRPQDSPPTPPLQPGPVGSPSPLGDTASGLPDKDSSFEDLEQFLGTSERQGRGRGVQPEPQLQQLKTAVEEIHNAVDRLLSLTLLAFEGLNTAASKDRCLACIEEPFFSPLWPLLLALYRSVHRAREAALSRSMELYRNAPPTAIGIPTKLLPQNPEAKGATGYPYCAAAQELGLLVLESCPQKKLECIVRTLRIICVCAEDYCPTPEATPQAGPPPIAAAAIGADDLLPILSFVVLRSGLPQLVSECAALEEFIHEGYLIGEEGYCLTSLQSALSYVELLPRGGLAK

SEQ ID NO: 96981 - protein, 561 aa, Homo sapiens
  Payload ID: 19346
  Gene Name: VPS9 domain containing 1
  ENSP ID: ENSP00000454244
MLKLAQQCLERAQSTAAKLGKTRLKPTMPAAAPIPQPAGRHRRVYSDEGGKLSPFLPPEIFQKLQGAESQSCKKELTPLEEASLQNQKLKAAYEARMARLDPSQAMQKTSLTLSLQRQMMENLVIAKAREETLQRKMEERRLRLQEAANRRFCSQVALTPEEREQRALYAAILEYEQDHDWPKHWKAKLKRNPGDLSLVTSLVSHLLSLPDHPIAQLLRRLQCSVYSALYPAVSRAAAPAPGCCPPTPNPGSRRLRPSQSLHCMLSPPEPSAAPRPQDSPPTPPLQPGPVGSPSPLGDTASGLPDKDSSFEDLEQFLGTSERQGRGRGVQPEPQLQQLKTAVEEIHNAVDRLLSLTLLAFEGLNTAASKDRCLACIEEPFFSPLWPLLLALYRSVHRAREAALSRSMELYRNAPPTAIGIPTKLLPQNPEAKGATGYPYCAAAQELGLLVLESCPQKKLECIVRTLRIICVCAEDYCPTPEATPQAGPPPIAAAAIGADDLLPILSFVVLRSGLPQLVSECAALEEFIHEGYLIGEEGYCLTSLQSALSYVELLPRGGLAK

SEQ ID NO: 96982 - protein, 52 aa, Homo sapiens
  Payload ID: 19346
  Gene Name: VPS9 domain containing 1
  ENSP ID: ENSP00000454889
MAAAAGDGTVKPLQSAMKLANGAIELDTGNRPRRADATGGGLPAESEAEGCV

SEQ ID NO: 96983 - protein, 232 aa, Homo sapiens
  Payload ID: 19346
  Gene Name: VPS9 domain containing 1
  ENSP ID: ENSP00000455792
  MOD_RES (1)..(1): Any amino acid
XEPQLQQLKTAVEEIHNAVADRLLSLTLLAFEGLNTAASKDRCLACIEEPFFSPLWPLLLALYRSVHRAREAALSRSMELYRNAPPTAIGIPTKLLPQNPEAKGATGYPYCAAAQELGLLVLESCPQKKLECIVRTLRIICVCAEDYCPTPEATPQAGPPPIAAAAIGADDLLPILSFVVLRSGLPQLVSECAALEEFIHEGYLIGEEGYCLTSLQSALSYVELLPRGGLAK

SEQ ID NO: 96984 - protein, 438 aa, Homo sapiens
  Payload ID: 19346
  Gene Name: VPS9 domain containing 1
  ENSP ID: ENSP00000484791
MLLCPAQKTVFRLQLTTAAQCLWVYLRDKQVVVFLAYPTRAPGRNNGVTSLHWPDPTLSLSWTQEAYTEYLRSIHYISQVLLEEVETTKEAGETVPPDTSKMLKLAQQCLERAQSTAAKLGKTRLKPTMPAAAPIPQPAGRHRRVYSDEGGKLSPFLPPEIFQKLQGAESQSCKKELTPLEEASLQNQKLKAAYEARMARLDPSQAMQKTSLTLSLQRQMMENLVIAKAREETLQRKMEERRLRLQEAANRRFCSQVALTPEEREQRALYAAILEYEQDHDWPKHWKAKLKRNPGDLSLVTSLVSHLLSLPDHPIAQLLRRLQCSVYSALYPAVSRAAAPAPGCCPPTPNPGSRRLRPSQSLHCMLSPPEPSAAPRPQDSPPTPPLQPGPWGLPHPWGTPHLDCQTRTARSRTWSSSWGRLSGRAGAVGYSRSPSCSS

SEQ ID NO: 96985 - protein, 206 aa, Homo sapiens
  Payload ID: 19347
  Gene Name: v-ral simian leukemia viral oncogene homolog A (ras related)
  Uniprot ID: P11233
  ENSP ID: ENSP00000005257
MAANKPKGQNSLALHKVIMVGSGGVGKSALTLQFMYDEFVEDYEPTKADSYRKKVVLDGEEVQIDILDTAGQEDYAAIRDNYFRSGEGFLCVFSITEMESFAATADFREQILRVKEDENVPFLLVGNKSDLEDKRQVSVEEAKNRAEQWNVNYVETSAKTRANVDKVFFDLMREIRARKMEDSKEKNGKKKRKSLAKRIRERCCIL

SEQ ID NO: 96986 - protein, 101 aa, Homo sapiens
  Payload ID: 19347
  Gene Name: v-ral simian leukemia viral oncogene homolog A (ras related)
  ENSP ID: ENSP00000388975
MAANKPKGQNSLALHKVIMVGSGGVGKSALTLQFMYDEFVEDYEPTKADSYRKKVVLDGEEVQIDILDTAGQEDYAAIRDNYFRSGEGFLCVFSITEMESF

SEQ ID NO: 96987 - protein, 164 aa, Homo sapiens
  Payload ID: 19347
  Gene Name: v-ral simian leukemia viral oncogene homolog A (ras related)
  ENSP ID: ENSP00000413227
  MOD_RES (1)..(1): Any amino acid
XGQNSLALHKVIMVGSGGVGKSALTLQFMYDEFVEDYEPTKADSYRKKVVLDGEEVQIDILDTAGQEDYAAIRDNYFRSGEGFLCVFSITEMESFAATADFREQILRVKEDENVPFLLVGNKSDLEDKRQVSVEEAKNRAEQWNVNYVETSAKTRANVDKSGPS

SEQ ID NO: 96988 - protein, 206 aa, Homo sapiens
  Payload ID: 19348
  Gene Name: v-ral simian leukemia viral oncogene homolog B
  Uniprot ID: P11234
  ENSP ID: ENSP00000272519
MAANKSKGQSSLALHKVIMVGSGGVGKSALTLQFMYDEFVEDYEPTKADSYRKKVVLDGEEVQIDILDTAGQEDYAAIRDNYFRSGEGFLLVFSITEHESFTATAEFREQILRVKAEEDKIPLLVVGNKSDLEERRQVPVEEARSKAEEWGVQYVETSAKTRANVDKVFFDLMREIRTKKMSENKDKNGKKSSKNKKSFKERCCLL

SEQ ID NO: 96989 - protein, 46 aa, Homo sapiens
  Payload ID: 19348
  Gene Name: v-ral simian leukemia viral oncogene homolog B
  ENSP ID: ENSP00000393782
MAANKSKGQSSLALHKVIMVGSGGVGKSALTLQFMYDEECFKIIGI

SEQ ID NO: 96990 - protein, 167 aa, Homo sapiens
  Payload ID: 19348
  Gene Name: v-ral simian leukemia viral oncogene homolog B
  ENSP ID: ENSP00000398162
MAANKSKGQSSLALHKVIMVGSGGVGKSALTLQFMYDEFVEDYEPTKADSYRKKVVLDGEEVQIDILDTAGQEDYAAIRDNYFRSGEGFLLVFSITEHESFTATAEFREQILRVKAEEDKIPLLVVGNKSDLEERRQVPVEEARSKAEEWGVQYVETSAKTRANVDK

SEQ ID NO: 96991 - protein, 171 aa, Homo sapiens
  Payload ID: 19348
  Gene Name: v-ral simian leukemia viral oncogene homolog B
  ENSP ID: ENSP00000402866
MKQRQSALQWVICVSQPQKTSEMAANKSKGQSSLALHKVIMVGSGGVGKSALTLQFMYDEFVEDYEPTKADSYRKKVVLDGEEVQIDILDTAGQEDYAAIRDNYFRSGEGFLLVFSITEHESFTATAEFREQILRVKAEEDKIPLLVVGNKSDLEERRQVPVEEARSKAEE

SEQ ID NO: 96992 - protein, 112 aa, Homo sapiens
  Payload ID: 19348
  Gene Name: v-ral simian leukemia viral oncogene homolog B
  ENSP ID: ENSP00000407062
MAANKSKGQSSLALHKVIMVGSGGVGKSALTLQFMYDEFVEDYEPTKADSYRKKVVLDGEEVQIDILDTAGQEDYAAIRDNYFRSGEGFLLVFSITEHESFTATAEFREQIL

SEQ ID NO: 96993 - protein, 206 aa, Homo sapiens; identical to SEQ ID NO: 96988
  Payload ID: 19348
  Gene Name: v-ral simian leukemia viral oncogene homolog B
  Uniprot ID: P11234
  ENSP ID: ENSP00000414224

SEQ ID NO: 96994 - protein, 46 aa, Homo sapiens; identical to SEQ ID NO: 96989
  Payload ID: 19348
  Gene Name: v-ral simian leukemia viral oncogene homolog B
  ENSP ID: ENSP00000487037

SEQ ID NO: 96995 - protein, 619 aa, Homo sapiens
  Payload ID: 19349
  Gene Name: v-rel avian reticuloendotheliosis viral oncogene homolog
  Uniprot ID: Q04864
  ENSP ID: ENSP00000295025
MASGAYNPYIEIIEQPRQRGMRFRYKCEGRSAGSIPGEHSTDNNRTYPSIQIMNYYGKGKVRITLVTKNDPYKPHPHDLVGKDCRDGYYEAEFGQERRPLFFQNLGIRCVKKKEVKEAIITRIKAGINPFNVPEKQLNDIEDCDLNVVRLCFQVFLPDEHGNLTTALPPVVSNPIYDNRAPNTAELRICRVNKNCGSVRGGDEIFLLCDKVQKDDIEVRFVLNDWEAKGIFSQADVHRQVAIVFKTPPYCKAITEPVTVKMQLRRPSDQEVSESMDFRYLPDEKDTYGNKAKKQKTTLLFQKLCQDHVETGFRHVDQDGLELLTSGDPPTLASQSAGITVNFPERPRPGLLGSIGEGRYFKKEPNLFSHDAVVREMPTGVSSQAESYYPSPGPISSGLSHHASMAPLPSSSWSSVAHPTPRSGNTNPLSSFSTRTLPSNSQGIPPFLRIPVGNDLNASNACIYNNADDIVGMEASSMPSADLYGISDPNMLSNCSVNMMTTSSDSMGETDNPRLLSMNLENPSCNSVLDPRDLRQLHQMSSSSMSAGANSNTTVFVSQSDAFEGSDFSCADNSMINESGPSNSTNPNSHGFVQDSQYSGIGSMQNEQLSDSFPYEFFQV

SEQ ID NO: 96996 - protein, 587 aa, Homo sapiens
  Payload ID: 19349
  Gene Name: v-rel avian reticuloendotheliosis viral oncogene homolog
  Uniprot ID: Q04864
  ENSP ID: ENSP00000377989
MASGAYNPYIEIIEQPRQRGMRFRYKCEGRSAGSIPGEHSTDNNRTYPSIQIMNYYGKGKVRITLVTKNDPYKPHPHDLVGKDCRDGYYEAEFGQERRPLFFQNLGIRCVKKKEVKEAIITRIKAGINPFNVPEKQLNDIEDCDLNVVRLCFQVFLPDEHGNLTTALPPVVSNPIYDNRAPNTAELRICRVNKNCGSVRGGDEIFLLCDKVQKDDIEVRFVLNDWEAKGIFSQADVHRQVAIVFKTPPYCKAITEPVTVKMQLRRPSDQEVSESMDFRYLPDEKDTYGNKAKKQKTTLLFQKLCQDHVNFPERPRPGLLGSIGEGRYFKKEPNLFSHDAVVREMPTGVSSQAESYYPSPGPISSGLSHHASMAPLPSSSWSSVAHPTPRSGNTNPLSSFSTRTLPSNSQGIPPFLRIPVGNDLNASNACIYNNADDIVGMEASSMPSADLYGISDPNMLSNCSVNMMTTSSDSMGETDNPRLLSMNLENPSCNSVLDPRDLRQLHQMSSSSMSAGANSNTTVFVSQSDAFEGSDFSCADNSMINESGPSNSTNPNSHGFVQDSQYSGIGSMQNEQLSDSFPYEFFQV

SEQ ID NO: 96997 - protein, 548 aa, Homo sapiens
  Payload ID: 19350
  Gene Name: v-rel avian reticuloendotheliosis viral oncogene homolog A
  Uniprot ID: Q04206
  ENSP ID: ENSP00000311508
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 96998 - protein, 551 aa, Homo sapiens
  Payload ID: 19350
  Gene Name: v-rel avian reticuloendotheliosis viral oncogene homolog A
  Uniprot ID: Q04206
  ENSP ID: ENSP00000384273
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 96999 - protein, 161 aa, Homo sapiens
  Payload ID: 19350
  Gene Name: v-rel avian reticuloendotheliosis viral oncogene homolog A
  ENSP ID: ENSP00000431153
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQGDSAGPIRQAPPPAACPFS

SEQ ID NO: 97000 - protein, 72 aa, Homo sapiens
  Payload ID: 19350
  Gene Name: v-rel avian reticuloendotheliosis viral oncogene homolog A
  ENSP ID: ENSP00000431304
  MOD_RES (1)..(1): Any amino acid
XQVTVRDPSGRPLRLPPVLSHPIFDNHDRHRIEEKRKRTYETFKSIMKKSPFSGPTDPRPPPRRIAVPSRSS

SEQ ID NO: 97001 - protein, 377 aa, Homo sapiens
  Payload ID: 19350
  Gene Name: v-rel avian reticuloendotheliosis viral oncogene homolog A
  ENSP ID: ENSP00000432537
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPGKDFLLSHWNDRFSSVQLRSSGDEDSWAPLQTY

SEQ ID NO: 97002 - protein, 134 aa, Homo sapiens
  Payload ID: 19350
  Gene Name: v-rel avian reticuloendotheliosis viral oncogene homolog A
  ENSP ID: ENSP00000432922
MDELFPLIFPAEPAQASGPYVEIIEQPKQRGMRFRYKCEGRSAGSIPGERSTDTTKTHPTIKFPEPGNPVCEEAGPGAGYQSAHPDQQQPLPSSYRRAAWGLRPECCAALLPGDSAGPIRQAPPPAACPFSSHL

SEQ ID NO: 97003 - protein, 64 aa, Homo sapiens
  Payload ID: 19350
  Gene Name: v-rel avian reticuloendotheliosis viral oncogene homolog A
  ENSP ID: ENSP00000433144
MDELFPLIFPAEPAQASGPYVEIIEQPKQRGMRFRYKCEGRSAGSIPGERSTDTTKTHPTIKFL

SEQ ID NO: 97004 - protein, 418 aa, Homo sapiens
  Payload ID: 19350
  Gene Name: v-rel avian reticuloendotheliosis viral oncogene homolog A
  ENSP ID: ENSP00000433526
MDELFPLIFPAEPAQASGPYVEIIEQPKQRGMRFRYKCEGRSAGSIPGERSTDTTKTHPTIKVWMSGPLYFGQINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAP

SEQ ID NO: 97005 - protein, 29 aa, Homo sapiens
  Payload ID: 19350
  Gene Name: v-rel avian reticuloendotheliosis viral oncogene homolog A
  ENSP ID: ENSP00000433616
MRFRYKCEGRSAGSIPGERSTDTTKTHPT

SEQ ID NO: 97006 - protein, 49 aa, Homo sapiens
  Payload ID: 19350
  Gene Name: v-rel avian reticuloendotheliosis viral oncogene homolog A
  ENSP ID: ENSP00000434008
MDELFPLIFPADQWLHRTRDSAHLPGHQGPSSPASPPRACRKGLPGWLL

SEQ ID NO: 97007 - protein, 95 aa, Homo sapiens
  Payload ID: 19350
  Gene Name: v-rel avian reticuloendotheliosis viral oncogene homolog A
  ENSP ID: ENSP00000434098
MRFRYKCEGRSAGSIPGERSTDTTKTHPTIKINGYTGPGTVRISLVTKDPPHRPHPHELVGKDCRDGFYEAELCPDRCIHSFQNLGIQCVKKRDL

SEQ ID NO: 97008 - protein, 208 aa, Homo sapiens
  Payload ID: 19350
  Gene Name: v-rel avian reticuloendotheliosis viral oncogene homolog A
  ENSP ID: ENSP00000434372
MDEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCD

SEQ ID NO: 97009 - protein, 85 aa, Homo sapiens
  Payload ID: 19350
  Gene Name: v-rel avian reticuloendotheliosis viral oncogene homolog A
  ENSP ID: ENSP00000434745
MDELFPLIFPAEPAQASGPYVEIIEQPKQRGMRFRYKCEGRSAGSIPGERSTDTTKTHPTIKDQGQCASPWSPRTLLTGLTPTSL

SEQ ID NO: 97010 - protein, 237 aa, Homo sapiens
  Payload ID: 19350
  Gene Name: v-rel avian reticuloendotheliosis viral oncogene homolog A
  ENSP ID: ENSP00000435290
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKAHGIPVPARYRRSSPD

SEQ ID NO: 97011 - protein, 89 aa, Homo sapiens
  Payload ID: 19350
  Gene Name: v-rel avian reticuloendotheliosis viral oncogene homolog A
  ENSP ID: ENSP00000435531
MRFRYKCEGRSAGSIPGERSTDTTKTHPTIKINGYTGPGTVRISLVTKDPPHRPHPHELVGKDCRDGFYEAELCPDRCIHSFQNLGIQC

SEQ ID NO: 97012 - protein, 185 aa, Homo sapiens
  Payload ID: 19350
  Gene Name: v-rel avian reticuloendotheliosis viral oncogene homolog A
  ENSP ID: ENSP00000436545
MRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLC

SEQ ID NO: 97013 - protein, 153 aa, Homo sapiens
  Payload ID: 19350
  Gene Name: v-rel avian reticuloendotheliosis viral oncogene homolog A
  ENSP ID: ENSP00000437137
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSSYRRAAWGLRPECCAALLPGDSAGPIRQAPPPAACPFSSHL

SEQ ID NO: 97014 - protein, 246 aa, Homo sapiens
  Payload ID: 19350
  Gene Name: v-rel avian reticuloendotheliosis viral oncogene homolog A
  ENSP ID: ENSP00000479572
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEFCPQASTPALSLYVIPEHHQL

SEQ ID NO: 97015 - protein, 448 aa, Homo sapiens
  Payload ID: 19350
  Gene Name: v-rel avian reticuloendotheliosis viral oncogene homolog A
  ENSP ID: ENSP00000483705
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQRPPDPAPAPLGAPGLPNGLLSGDEDFSSIADMDFSALLSQISS

SEQ ID NO: 97016 - protein, 579 aa, Homo sapiens
  Payload ID: 19351
  Gene Name: v-rel avian reticuloendotheliosis viral oncogene homolog B
  Uniprot ID: Q01201
  ENSP ID: ENSP00000221452
MLRSGPASGPSVPTGRAMPSRRVARPPAAPELGALGSPDLSSLSLAVSRSTDELEIIDEYIKENGFGLDGGQPGPGEGLPRLVSRGAASLSTVTLGPVAPPATPPPWGCPLGRLVSPAPGPGPQPHLVITEQPKQRGMRFRYECEGRSAGSILGESSTEASKTLPAIELRDCGGLREVEVTACLVWKDWPHRVHPHSLVGKDCTDGICRVRLRPHVSPRHSFNNLGIQCVRKKEIEAAIERKIQLGIDPYNAGSLKNHQEVDMNVVRICFQASYRDQQGQMRRMDPVLSEPVYDKKSTNTSELRICRINKESGPCTGGEELYLLCDKVQKEDISVVFSRASWEGRADFSQADVHRQIAIVFKTPPYEDLEIVEPVTVNVFLQRLTDGVCSEPLPFTYLPRDHDSYGVDKKRKRGMPDVLGELNSSDPHGIESKRRKKKPAILDHFLPNHGSGPFLPPSALLPDPDFFSGTVSLPGLEPPGGPDLLDDGFAYDPTAPTLFTMLDLLPPAPPHASAVVCSGGAGAVVGETPGPEPLTLDSYQAPGPGDGGTASLVGSNMFPNHYREAAFGGGLLSPGPEAT

SEQ ID NO: 97017 - protein, 576 aa, Homo sapiens
  Payload ID: 19351
  Gene Name: v-rel avian reticuloendotheliosis viral oncogene homolog B
  ENSP ID: ENSP00000423287
MLRSGPASGPSVPTGRAMPSRRVARPPAAPELGALGSPDLSSLSLAVSRSTEIIDEYIKENGFGLDGGQPGPGEGLPRLVSRGAASLSTVTLGPVAPPATPPPWGCPLGRLVSPAPGPGPQPHLVITEQPKQRGMRFRYECEGRSAGSILGESSTEASKTLPAIELRDCGGLREVEVTACLVWKDWPHRVHPHSLVGKDCTDGICRVRLRPHVSPRHSFNNLGIQCVRKKEIEAAIERKIQLGIDPYNAGSLKNHQEVDMNVVRICFQASYRDQQGQMRRMDPVLSEPVYDKKSTNTSELRICRINKESGPCTGGEELYLLCDKVQKEDISVVFSRASWEGRADFSQADVHRQIAIVFKTPPYEDLEIVEPVTVNVFLQRLTDGVCSEPLPFTYLPRDHDSYGVDKKRKRGMPDVLGELNSSDPHGIESKRRKKKPAILDHFLPNHGSGPFLPPSALLPDPDFFSGTVSLPGLEPPGGPDLLDDGFAYDPTAPTLFTMLDLLPPAPPHASAVVCSGGAGAVVGETPGPEPLTLDSYQAPGPGDGGTASLVGSNMFPNHYREAAFGGGLLSPGPEAT

SEQ ID NO: 97018 - protein, 58 aa, Homo sapiens
  Payload ID: 19351
  Gene Name: v-rel avian reticuloendotheliosis viral oncogene homolog B
  ENSP ID: ENSP00000427348
MLRSGPASGPSVPTGRAMPSRRVARPPAAPELGALGSPDLSSLSLAVSRSTGSSSTDA

SEQ ID NO: 97019 - protein, 142 aa, Homo sapiens
  Payload ID: 19351
  Gene Name: v-rel avian reticuloendotheliosis viral oncogene homolog B
  ENSP ID: ENSP00000468460
  MOD_RES (1)..(1): Any amino acid
XSEPLPFTYLPRDHGPFLPPSALLPDPDFFSGTVSLPGLEPPGGPDLLDDGFAYDPTAPTLFTMLDLLPPAPPHASAVVCSGGAGAVVGETPGPEPLTLDSYQAPGPGDGGTASLVGSNMFPNHYREAAFGGGLLSPGPEAT

SEQ ID NO: 97020 - protein, 579 aa, Homo sapiens; identical to SEQ ID NO: 97016
  Payload ID: 19351
  Gene Name: v-rel avian reticuloendotheliosis viral oncogene homolog B
  Uniprot ID: Q01201
  ENSP ID: ENSP00000485826

SEQ ID NO: 97021 - protein, 387 aa, Homo sapiens
  Payload ID: 19352
  Gene Name: V-set and immunoglobulin domain containing 1
  Uniprot ID: Q86XK7
  ENSP ID: ENSP00000217957
MVFAFWKVFLILSCLAGQVSVVQVTIPDGFVNVTVGSNVTLICIYTTTVASREQLSIQWSFFHKKEMEPISIYFSQGGQAVAIGQFKDRITGSNDPGNASITISHMQPADSGIYICDVNNPPDFLGQNQGILNVSVLVKPSKPLCSVQGRPETGHTISLSCLSALGTPSPVYYWHKLEGRDIVPVKENFNPTTGILVIGNLTNFEQGYYQCTAINRLGNSSCEIDLTSSHPEVGIIVGALIGSLVGAAIIISVVCFARNKAKAKAKERNSKTIAELEPMTKINPRGESEAMPREDATQLEVTLPSSIHETGPDTIQEPDYEPKPTQEPAPEPAPGSEPMAVPDLDIELELEPETQSELEPEPEPEPESEPGVVVEPLSEDEKGVVKA

SEQ ID NO: 97022 - protein, 423 aa, Homo sapiens
  Payload ID: 19352
  Gene Name: V-set and immunoglobulin domain containing 1
  Uniprot ID: Q86XK7
  ENSP ID: ENSP00000402219
MVFAFWKVFLILSCLAGQVSVVQVTIPDGFVNVTVGSNVTLICIYTTTVASREQLSIQWSFFHKKEMEPISHSSCLSTEGMEEKAVSQCLKMTHARDARGRCSWTSEIYFSQGGQAVAIGQFKDRITGSNDPGNASITISHMQPADSGIYICDVNNPPDFLGQNQGILNVSVLVKPSKPLCSVQGRPETGHTISLSCLSALGTPSPVYYWHKLEGRDIVPVKENFNPTTGILVIGNLTNFEQGYYQCTAINRLGNSSCEIDLTSSHPEVGIIVGALIGSLVGAAIIISVVCFARNKAKAKAKERNSKTIAELEPMTKINPRGESEAMPREDATQLEVTLPSSIHETGPDTIQEPDYEPKPTQEPAPEPAPGSEPMAVPDLDIELELEPETQSELEPEPEPEPESEPGVVVEPLSEDEKGVVKA

SEQ ID NO: 97023 - protein, 168 aa, Homo sapiens
  Payload ID: 19352
  Gene Name: V-set and immunoglobulin domain containing 1
  ENSP ID: ENSP00000407102
MVFAFWKVFLILSCLAGQVSVVQVTIPDGFVNVTVGSNVTLICIYTTTVASREQLSIQWSFFHKKEMEPISHSSCLSTEGMEEKAVSQCLKMTHARDARGRCSWTSEIYFSQGGQAVAIGQFKDRITGSNDPGNASITISHMQPADSGIYICDVNNPPDFLGQNQGIL

SEQ ID NO: 97024 - protein, 540 aa, Homo sapiens
  Payload ID: 19353
  Gene Name: V-set and immunoglobulin domain containing 10
  Uniprot ID: Q8N0Z9
  ENSP ID: ENSP00000352172
MAAGGSAPEPRVLVCLGALLAGWVAVGLEAVVIGEVHENVTLHCGNISGLRGQVTWYRNNSEPVFLLSSNSSLRPAEPRFSLVDATSLHIESLSLGDEGIYTCQEILNVTQWFQVWLQVASGPYQIEVHIVATGTLPNGTLYAARGSQVDFSCNSSSRPPPVVEWWFQALNSSSESFGHNLTVNFFSLLLISPNLQGNYTCLALNQLSKRHRKVTTELLVYYPPPSAPQCWAQMASGSFMLQLTCRWDGGYPDPDFLWIEEPGGVIVGKSKLGVEMLSESQLSDGKKFKCVTSHIVGPESGASCMVQIRGPSLLSEPMKTCFTGGNVTLTCQVSGAYPPAKILWLRNLTQPEVIIQPSSRHLITQDGQNSTLTIHNCSQDLDEGYYICRADSPVGVREMEIWLSVKEPLNIGGIVGTIVSLLLLGLAIISGLLLHYSPVFCWKVGNTSRGQNMDDVMVLVDSEEEEEEEEEEEEDAAVGEQEGAREREELPKEIPKQDHIHRVTALVNGNIEQMGNGFQDLQDDSSEEQSDIVQEEDRPV

SEQ ID NO: 97025 - protein, 189 aa, Homo sapiens
  Payload ID: 19353
  Gene Name: V-set and immunoglobulin domain containing 10
  ENSP ID: ENSP00000442861
MAAGGSAPEPRVLVCLGALLAGWVAVGLEAVVIGEVHENVTLHCGNISGLRGQVTWYRNNSEPVFLLSSNSSLRPAEPRFSLVDATSLHIESLSLGDEGIYTCQEILNVTQWFQVWLQVANPPPSAPQCWAQMASGSFMLQLTCRWDGGYPDPDFLWIEEPGGVIVGKSKLGVEMLSESQLSDGKKFKC

SEQ ID NO: 97026 - protein, 867 aa, Homo sapiens
  Payload ID: 19354
  Gene Name: V-set and immunoglobulin domain containing 10 like
  Uniprot ID: Q86VR7
  ENSP ID: ENSP00000335623
MDNPQALPLFLLLASLVGILTLRASSGLQQTNFSSAFSSDSKSSSQGLGVEVPSIKPPSWKVPDQFLDSKASAGISDSSWFPEALSSNMSGSFWSNVSAEGQDLSPVSPFSETPGSEVFPDISDPQVPAKDPKPSFTVKTPASNISTQVSHTKLSVEAPDSKFSPDDMDLKLSAQSPESKFSAETHSAASFPQQVGGPLAVLVGTTIRLPLVPIPNPGPPTSLVVWRRGSKVLAAGGLGPGAPLISLDPAHRDHLRFDQARGVLELASAQLDDAGVYTAEVIRAGVSQQTHEFTVGVYEPLPQLSVQPKAPETEEGAAELRLRCLGWGPGRGELSWSRDGRALEAAESEGAETPRMRSEGDQLLIVRPVRSDHARYTCRVRSPFGHREAAADVSVFYGPDPPTITVSSDRDAAPARFVTAGSNVTLRCAAASRPPADITWSLADPAEAAVPAGSRLLLPAVGPGHAGTYACLAANPRTGRRRRSLLNLTVADLPPGAPQCSVEGGPGDRSLRFRCSWPGGAPAASLQFQGLPEGIRAGPVSSVLLAAVPAHPRLSGVPITCLARHLVATRTCTVTPEAPREVLLHPLVAETRLGEAEVALEASGCPPPSRASWAREGRPLAPGGGSRLRLSQDGRKLHIGNFSLDWDLGNYSVLCSGALGAGGDQITLIGPSISSWRLQRARDAAVLTWDVERGALISSFEIQAWPDGPALGRTSTYRDWVSLLILGPQERSAVVPLPPRNPGTWTFRILPILGGQPGTPSQSRVYRAGPTLSHGAIAGIVLGSLLGLALLAVLLLLCICCLCRFRGKTPEKKKHPSTLVPVVTPSEKKMHSVTPVEISWPLDLKVPLEDHSSTRAYQAQTPVQLSL

SEQ ID NO: 97027 - protein, 196 aa, Homo sapiens
  Payload ID: 19354
  Gene Name: V-set and immunoglobulin domain containing 10 like
  ENSP ID: ENSP00000473046
MTCPPGPHSAQLKGVPGTAASASAARGPAGPLLPPCSSRVSPKASAPGQCPLCCWRPSPPTPGSAASPSPALLATWWPRVPAQSRRRPPERCCCIRWWQRHGWGRQRWHWRPLVVPHPHGHPGPGKGGPWLQEAGVACGSVKMGGNSTSATSAWIGTWEITPCCAVGRWVLAVTRSPSLDPPYPRGGFREPEMQPC

SEQ ID NO: 97028 - protein, 327 aa, Homo sapiens
  Payload ID: 19355
  Gene Name: V-set and immunoglobulin domain containing 2
  Uniprot ID: Q96IQ7
  ENSP ID: ENSP00000318684
MAELPGPFLCGALLGFLCLSGLAVEVKVPTEPLSTPLGKTAELTCTYSTSVGDSFALEWSFVQPGKPISESHPILYFTNGHLYPTGSKSKRVSLLQNPPTVGVATLKLTDVHPSDTGTYLCQVNNPPDFYTNGLGLINLTVLVPPSNPLCSQSGQTSVGGSTALRCSSSEGAPKPVYNWVRLGTFPTPSPGSMVQDEVSGQLILTNLSLTSSGTYRCVATNQMGSASCELTLSVTEPSQGRVAGALIGVLLGVLLLSVAAFCLVRFQKERGKKPKETYGGSDLREDAIAPGISEHTCMRADSSKGFLERPSSASTVTTTKSKLPMVV

SEQ ID NO: 97029 - protein, 284 aa, Homo sapiens
  Payload ID: 19355
  Gene Name: V-set and immunoglobulin domain containing 2
  Uniprot ID: Q96IQ7
  ENSP ID: ENSP00000385013
MAELPGPFLCGALLGFLCLSGLAVEVKVPTEPLSTPLGKTAELTCTYSTSVGDSFALEWSFVQPGKPISESHPILYFTNGHLYPTGSKSKRVSLLQNPPTVGVATLKLTDVHPSDTGTYLCQVNNPPDFYTNGLGLINLTVLVPPSNPLCSQSGQTSVGGSTALRCSSSEGAPKPVYNWVRLGTFPTPSPGSMVQDEVSGQLILTNLSLTSSGTYRCVATNQMGSASCELTLSVTEPSQGRVAGALIGVLLGVLLLSVAAFCLVRFQKERGKKPKETYGGSDLR

SEQ ID NO: 97030 - protein, 399 aa, Homo sapiens
  Payload ID: 19356
  Gene Name: V-set and immunoglobulin domain containing 4
  Uniprot ID: Q9Y279
  ENSP ID: ENSP00000363869
MGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKLSVSKPTVTTGSGYGFTVPQGMRISLQCQARGSPPISYIWYKQQTNNQEPIKVATLSTLLFKPAVIADSGSYFCTAKGQVGSEQHSDIVKFVVKDSSKLLKTKTEAPTTMTYPLKATSTVKQSWDWTTDMDGYLGETSAGPGKSLPVFAIILIISLCCMVVFTMAYIMLCRKTSQQEHVYEAARAHAREANDSGETMRVAIFASGCSSDEPTSQNLGNNYSDEPCIGQEYQIIAQINGNYARLLDTVPLDYEFLATEGKSVC

SEQ ID NO: 97031 - protein, 274 aa, Homo sapiens
  Payload ID: 19356
  Gene Name: V-set and immunoglobulin domain containing 4
  ENSP ID: ENSP00000393108
  MOD_RES (1)..(1): Any amino acid
XDHIQQAKYQGRLHVSHKVPGDVSLQLSTLEMDDRSHYTCEVTWQTPDGNQVVRDKITELRVQKLSVSKPTVTTGSGYGFTVPQGMRISLQCQARGSPPISYIWYKQQTNNQEPIKVATLSTLLFKPAVIADSGSYFCTAKGQVGSEQHSDIVKFVVKDSSKLLKTKTEAPTTMTYPLKATSTVKQSWDWTTDMDGYLGETSAGPGKSLPVFAIILIISLCCMVVFTMAYIMLCRKTSQQEHVYEAASPKCPPTNTGAAGSHWLCPGICQMHLK

SEQ ID NO: 97032 - protein, 305 aa, Homo sapiens
  Payload ID: 19356
  Gene Name: V-set and immunoglobulin domain containing 4
  Uniprot ID: Q9Y279
  ENSP ID: ENSP00000394143
MGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKHSSKLLKTKTEAPTTMTYPLKATSTVKQSWDWTTDMDGYLGETSAGPGKSLPVFAIILIISLCCMVVFTMAYIMLCRKTSQQEHVYEAARAHAREANDSGETMRVAIFASGCSSDEPTSQNLGNNYSDEPCIGQEYQIIAQINGNYARLLDTVPLDYEFLATEGKSVC

SEQ ID NO: 97033 - protein, 321 aa, Homo sapiens
  Payload ID: 19356
  Gene Name: V-set and immunoglobulin domain containing 4
  Uniprot ID: Q9Y279
  ENSP ID: ENSP00000411581
MGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKLSVSKPTVTTGSGYGFTVPQGMRISLQCQARGSPPISYIWYKQQTNNQEPIKVATLSTLLFKPAVIADSGSYFCTAKGQVGSEQHSDIVKFVVKDSSKLLKTKTEAPTTMTYPLKATSTVKQSWDWTTDMDGYLGETSAGPGKSLPVFAIILIISLCCMVVFTMAYIMLCRKTSQQEHVYEAAR

SEQ ID NO: 97034 - protein, 414 aa, Homo sapiens
  Payload ID: 19357
  Gene Name: V-set and immunoglobulin domain containing 8
  Uniprot ID: Q5VU13
  ENSP ID: ENSP00000357080
MRVGGAFHLLLVCLSPALLSAVRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 97035 - protein, 236 aa, Homo sapiens
  Payload ID: 19358
  Gene Name: V-set and transmembrane domain containing 1
  Uniprot ID: Q6UX27
  ENSP ID: ENSP00000343366
MTAEFLSLLCLGLCLGYEDEKKNEKPPKPSLHAWPSSVVEAESNVTLKCQAHSQNVTFVLRKVNDSGYKQEQSSAENEAEFPFTDLKPKDAGRYFCAYKTTASHEWSESSEHLQLVVTDKHDELEAPSMKTDTRTIFVAIFSCISILLLFLSVFIIYRCSQHSSSSEESTKRTSHSKLPEQEAAEADLSNMERVSLSTADPQGVTYAELSTSALSEAASDTTQEPPGSHEYAALKV

SEQ ID NO: 97036 - protein, 205 aa, Homo sapiens
  Payload ID: 19358
  Gene Name: V-set and transmembrane domain containing 1
  Uniprot ID: Q6UX27
  ENSP ID: ENSP00000365813
MTAEFLSLLCLGLCLGYEDEKKNEKPPKPSLHAWPSSVVEAESNVTLKCQAHSQNVTFVLRKVNDSGYKQEQSSAENEAEFPFTDLKPKDAGRYFCAYKTTASHEWSESSEHLQLVVTDKHDELEAPSMKTGSSSEESTKRTSHSKLPEQEAAEADLSNMERVSLSTADPQGVTYAELSTSALSEAASDTTQEPPGSHEYAALKV

SEQ ID NO: 97037 - protein, 174 aa, Homo sapiens
  Payload ID: 19358
  Gene Name: V-set and transmembrane domain containing 1
  Uniprot ID: Q6UX27
  ENSP ID: ENSP00000401926
MTAEFLSLLCLGLCLGYEDEKKNEKPPKPSLHAWPSSVVEAESNVTLKCQAHSQNVTFVLRKVNDSGYKQEQSSAENEAEFPFTDLKPKDAGRYFCAYKTTASHEWSESSEHLQLVVTDKHDELEAPSMKTDTRTIFVAIFSCISILLLFLSVFIIYRCSQHSELRERKGREGE

SEQ ID NO: 97038 - protein, 126 aa, Homo sapiens
  Payload ID: 19358
  Gene Name: V-set and transmembrane domain containing 1
  ENSP ID: ENSP00000409412
EFPFTDLKPKDAGRYFCAYKTTASHEWSESSEHLQLVVTDKHDELEAPSMKTGSSSEESTKRTSHSKLPEQEAAEADLSNMERVSLSTADPQGVTYAELSTSALSEAASDTTQEPPGSHEYAALKV

SEQ ID NO: 97039 - protein, 143 aa, Homo sapiens
  Payload ID: 19358
  Gene Name: V-set and transmembrane domain containing 1
  ENSP ID: ENSP00000413006
MTAEFLSLLCLGLCLGYEDEKKNEKPPKPSLHAWPSSVVEAESNVTLKCQAHSQNVTFVLRKVNDSGYKQEQSSAENEAEFPFTDLKPKDAGRYFCAYKTTASHEWSESSEHLQLVVTDKHDELEAPSMKTVAHVCNTRTLGR

SEQ ID NO: 97040 - protein, 116 aa, Homo sapiens
  Payload ID: 19358
  Gene Name: V-set and transmembrane domain containing 1
  ENSP ID: ENSP00000444153
MTAEFLSLLCLDTRTIFVAIFSCISILLLFLSVFIIYRCSQHSSSSEESTKRTSHSKLPEQEAAEADLSNMERVSLSTADPQGVTYAELSTSALSEAASDTTQEPPGSHEYAALKV

SEQ ID NO: 97041 - protein, 116 aa, Homo sapiens; identical to SEQ ID NO: 97040
  Payload ID: 19358
  Gene Name: V-set and transmembrane domain containing 1
  ENSP ID: ENSP00000478214

SEQ ID NO: 97042 - protein, 143 aa, Homo sapiens; identical to SEQ ID NO: 97039
  Payload ID: 19358
  Gene Name: V-set and transmembrane domain containing 1
  ENSP ID: ENSP00000478333

SEQ ID NO: 97043 - protein, 236 aa, Homo sapiens; identical to SEQ ID NO: 97035
  Payload ID: 19358
  Gene Name: V-set and transmembrane domain containing 1
  ENSP ID: ENSP00000478582

SEQ ID NO: 97044 - protein, 205 aa, Homo sapiens; identical to SEQ ID NO: 97036
  Payload ID: 19358
  Gene Name: V-set and transmembrane domain containing 1
  ENSP ID: ENSP00000479198

SEQ ID NO: 97045 - protein, 143 aa, Homo sapiens; identical to SEQ ID NO: 97039
  Payload ID: 19358
  Gene Name: V-set and transmembrane domain containing 1
  ENSP ID: ENSP00000479448

SEQ ID NO: 97046 - protein, 116 aa, Homo sapiens; identical to SEQ ID NO: 97040
  Payload ID: 19358
  Gene Name: V-set and transmembrane domain containing 1
  ENSP ID: ENSP00000479529

SEQ ID NO: 97047 - protein, 148 aa, Homo sapiens
  Payload ID: 19358
  Gene Name: V-set and transmembrane domain containing 1
  ENSP ID: ENSP00000479639
LRSRQGPTRLPRLECSGAITAHCSLDLPGPDKHDELEAPSMKTDTRTIFVAIFSCISILLLFLSVFIIYRCSQHSSSSEESTKRTSHSKLPEQEAAEADLSNMERVSLSTADPQGVTYAELSTSALSEAASDTTQEPPGSHEYAALKV

SEQ ID NO: 97048 - protein, 205 aa, Homo sapiens; identical to SEQ ID NO: 97036
  Payload ID: 19358
  Gene Name: V-set and transmembrane domain containing 1
  ENSP ID: ENSP00000479748

SEQ ID NO: 97049 - protein, 116 aa, Homo sapiens; identical to SEQ ID NO: 97040
  Payload ID: 19358
  Gene Name: V-set and transmembrane domain containing 1
  ENSP ID: ENSP00000479856

SEQ ID NO: 97050 - protein, 116 aa, Homo sapiens; identical to SEQ ID NO: 97040
  Payload ID: 19358
  Gene Name: V-set and transmembrane domain containing 1
  ENSP ID: ENSP00000479956

SEQ ID NO: 97051 - protein, 205 aa, Homo sapiens; identical to SEQ ID NO: 97036
  Payload ID: 19358
  Gene Name: V-set and transmembrane domain containing 1
  ENSP ID: ENSP00000480383

SEQ ID NO: 97052 - protein, 143 aa, Homo sapiens; identical to SEQ ID NO: 97039
  Payload ID: 19358
  Gene Name: V-set and transmembrane domain containing 1
  ENSP ID: ENSP00000480528

SEQ ID NO: 97053 - protein, 236 aa, Homo sapiens; identical to SEQ ID NO: 97035
  Payload ID: 19358
  Gene Name: V-set and transmembrane domain containing 1
  ENSP ID: ENSP00000480533

SEQ ID NO: 97054 - protein, 236 aa, Homo sapiens; identical to SEQ ID NO: 97035
  Payload ID: 19358
  Gene Name: V-set and transmembrane domain containing 1
  ENSP ID: ENSP00000480547

SEQ ID NO: 97055 - protein, 116 aa, Homo sapiens; identical to SEQ ID NO: 97040
  Payload ID: 19358
  Gene Name: V-set and transmembrane domain containing 1
  ENSP ID: ENSP00000480671

SEQ ID NO: 97056 - protein, 143 aa, Homo sapiens; identical to SEQ ID NO: 97039
  Payload ID: 19358
  Gene Name: V-set and transmembrane domain containing 1
  ENSP ID: ENSP00000480734

SEQ ID NO: 97057 - protein, 143 aa, Homo sapiens; identical to SEQ ID NO: 97039
  Payload ID: 19358
  Gene Name: V-set and transmembrane domain containing 1
  ENSP ID: ENSP00000480873

SEQ ID NO: 97058 - protein, 205 aa, Homo sapiens; identical to SEQ ID NO: 97036
  Payload ID: 19358
  Gene Name: V-set and transmembrane domain containing 1
  ENSP ID: ENSP00000481140

SEQ ID NO: 97059 - protein, 148 aa, Homo sapiens; identical to SEQ ID NO: 97047
  Payload ID: 19358
  Gene Name: V-set and transmembrane domain containing 1
  ENSP ID: ENSP00000481221

SEQ ID NO: 97060 - protein, 148 aa, Homo sapiens; identical to SEQ ID NO: 97047
  Payload ID: 19358
  Gene Name: V-set and transmembrane domain containing 1
  ENSP ID: ENSP00000481287

SEQ ID NO: 97061 - protein, 174 aa, Homo sapiens; identical to SEQ ID NO: 97037
  Payload ID: 19358
  Gene Name: V-set and transmembrane domain containing 1
  Uniprot ID: Q6UX27
  ENSP ID: ENSP00000481977

SEQ ID NO: 97062 - protein, 236 aa, Homo sapiens; identical to SEQ ID NO: 97035
  Payload ID: 19358
  Gene Name: V-set and transmembrane domain containing 1
  ENSP ID: ENSP00000482197

SEQ ID NO: 97063 - protein, 116 aa, Homo sapiens; identical to SEQ ID NO: 97040
  Payload ID: 19358
  Gene Name: V-set and transmembrane domain containing 1
  ENSP ID: ENSP00000482300

SEQ ID NO: 97064 - protein, 236 aa, Homo sapiens; identical to SEQ ID NO: 97035
  Payload ID: 19358
  Gene Name: V-set and transmembrane domain containing 1
  ENSP ID: ENSP00000482555

SEQ ID NO: 97065 - protein, 143 aa, Homo sapiens; identical to SEQ ID NO: 97039
  Payload ID: 19358
  Gene Name: V-set and transmembrane domain containing 1
  ENSP ID: ENSP00000482726

SEQ ID NO: 97066 - protein, 143 aa, Homo sapiens; identical to SEQ ID NO: 97039
  Payload ID: 19358
  Gene Name: V-set and transmembrane domain containing 1
  ENSP ID: ENSP00000482869

SEQ ID NO: 97067 - protein, 236 aa, Homo sapiens; identical to SEQ ID NO: 97035
  Payload ID: 19358
  Gene Name: V-set and transmembrane domain containing 1
  Uniprot ID: Q6UX27
  ENSP ID: ENSP00000482985

SEQ ID NO: 97068 - protein, 205 aa, Homo sapiens; identical to SEQ ID NO: 97036
  Payload ID: 19358
  Gene Name: V-set and transmembrane domain containing 1
  ENSP ID: ENSP00000483104

SEQ ID NO: 97069 - protein, 116 aa, Homo sapiens; identical to SEQ ID NO: 97040
  Payload ID: 19358
  Gene Name: V-set and transmembrane domain containing 1
  ENSP ID: ENSP00000483406

SEQ ID NO: 97070 - protein, 205 aa, Homo sapiens; identical to SEQ ID NO: 97036
  Payload ID: 19358
  Gene Name: V-set and transmembrane domain containing 1
  ENSP ID: ENSP00000483411

SEQ ID NO: 97071 - protein, 236 aa, Homo sapiens; identical to SEQ ID NO: 97035
  Payload ID: 19358
  Gene Name: V-set and transmembrane domain containing 1
  ENSP ID: ENSP00000483412

SEQ ID NO: 97072 - protein, 116 aa, Homo sapiens; identical to SEQ ID NO: 97040
  Payload ID: 19358
  Gene Name: V-set and transmembrane domain containing 1
  ENSP ID: ENSP00000483560

SEQ ID NO: 97073 - protein, 148 aa, Homo sapiens; identical to SEQ ID NO: 97047
  Payload ID: 19358
  Gene Name: V-set and transmembrane domain containing 1
  ENSP ID: ENSP00000483778

SEQ ID NO: 97074 - protein, 205 aa, Homo sapiens; identical to SEQ ID NO: 97036
  Payload ID: 19358
  Gene Name: V-set and transmembrane domain containing 1
  ENSP ID: ENSP00000483797

SEQ ID NO: 97075 - protein, 143 aa, Homo sapiens; identical to SEQ ID NO: 97039
  Payload ID: 19358
  Gene Name: V-set and transmembrane domain containing 1
  ENSP ID: ENSP00000483798

SEQ ID NO: 97076 - protein, 148 aa, Homo sapiens; identical to SEQ ID NO: 97047
  Payload ID: 19358
  Gene Name: V-set and transmembrane domain containing 1
  ENSP ID: ENSP00000484093

SEQ ID NO: 97077 - protein, 148 aa, Homo sapiens; identical to SEQ ID NO: 97047
  Payload ID: 19358
  Gene Name: V-set and transmembrane domain containing 1
  ENSP ID: ENSP00000484173

SEQ ID NO: 97078 - protein, 148 aa, Homo sapiens; identical to SEQ ID NO: 97047
  Payload ID: 19358
  Gene Name: V-set and transmembrane domain containing 1
  ENSP ID: ENSP00000484513

SEQ ID NO: 97079 - protein, 148 aa, Homo sapiens; identical to SEQ ID NO: 97047
  Payload ID: 19358
  Gene Name: V-set and transmembrane domain containing 1
  ENSP ID: ENSP00000484547

SEQ ID NO: 97080 - protein, 143 aa, Homo sapiens; identical to SEQ ID NO: 97039
  Payload ID: 19358
  Gene Name: V-set and transmembrane domain containing 1
  ENSP ID: ENSP00000484653

SEQ ID NO: 97081 - protein, 205 aa, Homo sapiens; identical to SEQ ID NO: 97036
  Payload ID: 19358
  Gene Name: V-set and transmembrane domain containing 1
  Uniprot ID: Q6UX27
  ENSP ID: ENSP00000484699

SEQ ID NO: 97082 - protein, 116 aa, Homo sapiens; identical to SEQ ID NO: 97040
  Payload ID: 19358
  Gene Name: V-set and transmembrane domain containing 1
  ENSP ID: ENSP00000484758

SEQ ID NO: 97083 - protein, 236 aa, Homo sapiens; identical to SEQ ID NO: 97035
  Payload ID: 19358
  Gene Name: V-set and transmembrane domain containing 1
  Uniprot ID: Q6UX27
  ENSP ID: ENSP00000484806

SEQ ID NO: 97084 - protein, 236 aa, Homo sapiens; identical to SEQ ID NO: 97035
  Payload ID: 19358
  Gene Name: V-set and transmembrane domain containing 1
  ENSP ID: ENSP00000484844

SEQ ID NO: 97085 - protein, 205 aa, Homo sapiens; identical to SEQ ID NO: 97036
  Payload ID: 19358
  Gene Name: V-set and transmembrane domain containing 1
  Uniprot ID: Q6UX27
  ENSP ID: ENSP00000484886

SEQ ID NO: 97086 - protein, 132 aa, Homo sapiens
  Payload ID: 19359
  Gene Name: V-set and transmembrane domain containing 2 like
  Uniprot ID: Q96N03
  ENSP ID: ENSP00000362558
MGAPLAVALGALHYLALFLQLGGATRPAGHAPWDNHVSGHGGQGGGQQHLPQAAPVPGEAHGRRHLRVPRHRLQRRQGPAPQGQGLPAGAARGELRPASARSPSRRARPAAPQARQGAEEALGGPGGLQPLD

SEQ ID NO: 97087 - protein, 204 aa, Homo sapiens
  Payload ID: 19359
  Gene Name: V-set and transmembrane domain containing 2 like
  Uniprot ID: Q96N03
  ENSP ID: ENSP00000362560
MGAPLAVALGALHYLALFLQLGGATRPAGHAPWDNHVSGHALFTETPHDMTARTGEDVEMACSFRGSGSPSYSLEIQWWYVRSHRDWTDKQAWASNQLKASQQEDAGKEATKISVVKVVGSNISHKLRLSRVKPTDEGTYECRVIDFSDGKARHHKVKAYLRVQPGENSVLHLPEAPPAAPAPPPPKPGKELRKRSVDQEACSL

SEQ ID NO: 97088 - protein, 149 aa, Homo sapiens
  Payload ID: 19359
  Gene Name: V-set and transmembrane domain containing 2 like
  Uniprot ID: Q96N03
  ENSP ID: ENSP00000406537
MGAPLAVALGALHYLALFLQLGGATRPAGHAPWDNHVSGHALFTETPHDMTARTGEDVEMACSFRGSGSPSYSLEIQWWYVRSHRDWTDKQAWASNQVVKVVGSNISHKLRLSRVKPTDEGTYECRVIDFSDGKARHHKVKAYLRVQPG

SEQ ID NO: 97089 - protein, 244 aa, Homo sapiens
  Payload ID: 19360
  Gene Name: V-set and transmembrane domain containing 2A
  Uniprot ID: Q8TAG5
  ENSP ID: ENSP00000303108
MMGIFLVYVGFVFFSVLYVQQGLSSQAKFTEFPRNVTATEGQNVEMSCAFQSGSASVYLEIQWWFLRGPEDLDPGAEGAGAQVELLPDRDPDSDGTKISTVKVQGNDISHKLQISKVRKKDEGLYECRVTDANYGELQEHKAQAYLKVNANSHARRMQAFEASPMWLQDMKPRKNVSAAIPSSIHGSANQRTHSTSSPQVVAKIPKQSPQSGMETHFEPFILPLTNAPQKGQSYRVDRFMNGDF

SEQ ID NO: 97090 - protein, 240 aa, Homo sapiens
  Payload ID: 19360
  Gene Name: V-set and transmembrane domain containing 2A
  ENSP ID: ENSP00000384103
MMGIFLVYVGFVFFSVLYVQQGLSSQAKFTEFPRNVTATEGQNVEMSCAFQSGSASVYLEIQWWFLRGPEDLDPGAEGAGAQVELLPDRDPDSDGTKISTVKVQGNDISHKLQISKVRKKDEGLYECRVTDANYGELQEHKAQAYLKVNANSHARRMQAFEASPMWLQDMKPRKNVSAAIPSSIHGSANQRTHSTSSPQVVAKIPKQSPQSAKSKSPVKSTERTAKLTLNSKHHPAPTVL

SEQ ID NO: 97091 - protein, 309 aa, Homo sapiens
  Payload ID: 19360
  Gene Name: V-set and transmembrane domain containing 2A
  ENSP ID: ENSP00000384701
MMGIFLVYVGFVFFSVLYVQQGLSSQAKFTEFPRNVTATEGQNVEMSCAFQSGSASVYLEIQWWFLRGPEDLDPGAEGAGAQVELLPDRDPDSDGTKISTVKVQGNDISHKLQISKVRKKDEGLYECRVTDANYGELQEHKAQAYLKVNANSHARRMQAFEASPMWLQDMKPRKNVSAAIPSSIHGSANQRTHSTSSPQVVAKIPKQSPQSVSPILPEVKHLHRPPLLVLPFFSLSSLFSTDPLPTFPTSHRTVKRLPAPLPQPGHGSTPGVQSCVLAPPAKSKSPVKSTERTAKLTLNSKHHPAPTVL

SEQ ID NO: 97092 - protein, 236 aa, Homo sapiens
  Payload ID: 19360
  Gene Name: V-set and transmembrane domain containing 2A
  Uniprot ID: Q8TAG5
  ENSP ID: ENSP00000384967
MMGIFLVYVGFVFFSVLYVQQGLSSQAKFTEFPRNVTATEGQNVEMSCAFQSGSASVYLEIQWWFLRGPEDLDPGAEGAGAQVELLPDRDPDSDGTKISTVKVQGNDISHKLQISKVRKKDEGLYECRVTDANYGELQEHKAQAYLKVNANSHARRMQAFEASPMWLQDMKPRKNVSAAIPSSIHGSANQRTHSTSSPQVVAKIPKQSPQSGARIATSHGLSVLLLVCGFVKGALL

SEQ ID NO: 97093 - protein, 285 aa, Homo sapiens
  Payload ID: 19361
  Gene Name: V-set and transmembrane domain containing 2B
  Uniprot ID: A6NLU5
  ENSP ID: ENSP00000335038
MEQRNRLGALGYLPPLLLHALLLFVADAAFTEVPKDVTVREGDDIEMPCAFRASGATSYSLEIQWWYLKEPPRELLHELALSVPGARSKVTNKDATKISTVRVQGNDISHRLRLSAVRLQDEGVYECRVSDYSDDDTQEHKAQAMLRVLSRFAPPNMQAAEAVSHIQSSGPRRHGPASAANANNAGAASRTTSEPGRGDKSPPPGSPPAAIDPAVPEAAAASAAHTPTTTVAAAAAASSASPPSGQAVLLRQRHGSGTGRSYTTDPLLSLLLLALHKFLRLLLGH

SEQ ID NO: 97094 - protein, 191 aa, Homo sapiens
  Payload ID: 19362
  Gene Name: V-set and transmembrane domain containing 4
  Uniprot ID: Q8IW00
  ENSP ID: ENSP00000298454
MRLLALAAAALLARAPAPEVCAALNVTVSPGPVVDYLEGENATLLCHVSQKRRKDSLLAVRWFFAHSFDSQEALMVKMTKLRVVQYYGNFSRSAKRRRLRLLEEQRGALYRLSVLTLQPSDQGHYVCRVQEISRHRNKWTAWSNGSSATEMRGVSSHPVERGAFLGISLVILPHSLPFTADLTMASFLQSS

SEQ ID NO: 97095 - protein, 320 aa, Homo sapiens
  Payload ID: 19362
  Gene Name: V-set and transmembrane domain containing 4
  Uniprot ID: Q8IW00
  ENSP ID: ENSP00000331062
MRLLALAAAALLARAPAPEVCAALNVTVSPGPVVDYLEGENATLLCHVSQKRRKDSLLAVRWFFAHSFDSQEALMVKMTKLRVVQYYGNFSRSAKRRRLRLLEEQRGALYRLSVLTLQPSDQGHYVCRVQEISRHRNKWTAWSNGSSATEMRVISLKASEESSFEKTKETWAFFEDLYVYAVLVCCVGILSILLFMLVIVWQSVFNKRKSRVRHYLVKCPQNSSGETVTSVTSLAPLQPKKGKRQKEKPDIPPAVPAKAPIAPTFHKPKLLKPQRKVTLPKIAEENLTYAELELIKPHRAAKGAPTSTVYAQILFEENKL

SEQ ID NO: 97096 - protein, 20 aa, Homo sapiens
  Payload ID: 19363
  Gene Name: V-set and transmembrane domain containing 5
  ENSP ID: ENSP00000381277
  MOD_RES (1)..(1): Any amino acid
XRHKLKESTTEEIELEDVEC

SEQ ID NO: 97097 - protein, 200 aa, Homo sapiens
  Payload ID: 19363
  Gene Name: V-set and transmembrane domain containing 5
  Uniprot ID: A8MXK1
  ENSP ID: ENSP00000386607
MRPLPSGRRKTRGISLGLFALCLAAARCLQSQGVSLYIPQATINATVKEDILLSVEYSCHGVPTIEWTYSSNWGTQKIVEWKPGTQANISQSHKDRVCTFDNGSIQLFSVGVRDSGYYVITVTERLGSSQFGTIVLHVSEILYEDLHFVAVILAFLAAVAAVLISLMWVCNKCAYKFQRKRRHKLKESTTEEIELEDVEC

SEQ ID NO: 97098 - protein, 166 aa, Homo sapiens
  Payload ID: 19364
  Gene Name: V-set domain containing T cell activation inhibitor 1
  Uniprot ID: Q7Z7D3
  ENSP ID: ENSP00000328168
MASLGQILFWSIISIIIILAGAIALIIGFGISAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 97099 - protein, 285 aa, Homo sapiens
  Payload ID: 19364
  Gene Name: V-set domain containing T cell activation inhibitor 1
  ENSP ID: ENSP00000351899
MVLLTSRMKPLTSRIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 97100 - protein, 282 aa, Homo sapiens
  Payload ID: 19364
  Gene Name: V-set domain containing T cell activation inhibitor 1
  Uniprot ID: Q7Z7D3
  ENSP ID: ENSP00000358470
MASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 97101 - protein, 187 aa, Homo sapiens
  Payload ID: 19364
  Gene Name: V-set domain containing T cell activation inhibitor 1
  Uniprot ID: Q7Z7D3
  ENSP ID: ENSP00000444724
MFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 97102 - protein, 87 aa, Homo sapiens [sequence omitted]

SEQ ID NO: 97103 - protein, 220 aa, Homo sapiens
  Payload ID: 19365
  Gene Name: WAP four-disulfide core domain 1
  Uniprot ID: Q9HC57
  ENSP ID: ENSP00000219454
MPLTGVGPGSCRRQIIRALCLLLLLLHAGSAKNIWKRALPARLAEKSRAEEAGAPGGPRQPRADRCPPPPRTLPPGACQAARCQADSECPRHRRCCYNGCAYACLEAVPPPPVLDWLVQPKPRWLGGNGWLLDGPEEVLQAEACSTTEDGAEPLLCPSGYECHILSPGDVAEGIPNRGQCVKQRRQADGRILRHKLYKEYPEGDSKNVAEPGRGQQKHFQ

SEQ ID NO: 97104 - protein, 220 aa, Homo sapiens; identical to SEQ ID NO: 97103
  Payload ID: 19365
  Gene Name: WAP four-disulfide core domain 1
  Uniprot ID: Q9HC57
  ENSP ID: ENSP00000456920

SEQ ID NO: 97105 - protein, 66 aa, Homo sapiens
  Payload ID: 19365
  Gene Name: WAP four-disulfide core domain 1
  ENSP ID: ENSP00000481580
MPLTGVGPGSCRRQIIRALCLLLLLLHAGSAKNIWKRALPARLAEKSRVSAWDGEAGAACVGGSQP

SEQ ID NO: 97106 - protein, 79 aa, Homo sapiens
  Payload ID: 19366
  Gene Name: WAP four-disulfide core domain 10A
  Uniprot ID: Q9H1F0
  ENSP ID: ENSP00000361726
MAPQTLLPVLVLCVLLLQAQGGYRDKKRMQKTQLSPEIKVCQQQPKLYLCKHLCESHRDCQANNICCSTYCGNVCMSIL

SEQ ID NO: 97107 - protein, 73 aa, Homo sapiens
  Payload ID: 19367
  Gene Name: WAP four-disulfide core domain 10B
  Uniprot ID: Q8IUB3
  ENSP ID: ENSP00000327628
MAPQTLLLVLVLCVLLLQAQGGYRDKMRMQRIKVCEKRPSIDLCIHHCSYFQKCETNKICCSAFCGNICMSIL

SEQ ID NO: 97108 - protein, 89 aa, Homo sapiens
  Payload ID: 19367
  Gene Name: WAP four-disulfide core domain 10B
  Uniprot ID: Q8IUB3
  ENSP ID: ENSP00000337466
MVSCERRASKSVGQILLWDFGYTCRLSHRRRNSTEILSRNLPALYTGIKVCEKRPSIDLCIHHCSYFQKCETNKICCSAFCGNICMSIL

SEQ ID NO: 97109 - protein, 87 aa, Homo sapiens
  Payload ID: 19368
  Gene Name: WAP four-disulfide core domain 11
  Uniprot ID: Q8NEX6
  ENSP ID: ENSP00000318753
MVSLMKLWIPMLMTFFCTVLLSVLGEMRKKRYDRKELLLEECWGKPNVKECTNKCSKAFRCKDKNYTCCWTYCGNICWINVETSGDY

SEQ ID NO: 97110 - protein, 87 aa, Homo sapiens; identical to SEQ ID NO: 97109
  Payload ID: 19368
  Gene Name: WAP four-disulfide core domain 11
  Uniprot ID: Q8NEX6
  ENSP ID: ENSP00000348968

SEQ ID NO: 97111 - protein, 87 aa, Homo sapiens; identical to SEQ ID NO: 97109
  Payload ID: 19368
  Gene Name: WAP four-disulfide core domain 11
  Uniprot ID: Q8NEX6
  ENSP ID: ENSP00000479579

SEQ ID NO: 97112 - protein, 111 aa, Homo sapiens
  Payload ID: 19369
  Gene Name: WAP four-disulfide core domain 12
  Uniprot ID: Q8WWY7
  ENSP ID: ENSP00000361871
MGSSSFLVLMVSLVLVTLVAVEGVKEGIEKAGVCPADNVRCFKSDPPQCHTDQDCLGERKCCYLHCGFKCVIPVKELEEGGNKDEDVSRPYPEPGWEAKCPGSSSTRCPQK

SEQ ID NO: 97113 - protein, 93 aa, Homo sapiens
  Payload ID: 19370
  Gene Name: WAP four-disulfide core domain 13
  Uniprot ID: Q8IUB5
  ENSP ID: ENSP00000302938
MKPVLPLQFLVVFCLALQLVPGSPKQRVLKYILEPPPCISAPENCTHLCTMQEDCEKGFQCCSSFCGIVCSSETFQKRNRIKHKGSEVIMPAN

SEQ ID NO: 97114 - protein, 102 aa, Homo sapiens
  Payload ID: 19371
  Gene Name: WAP four-disulfide core domain 2
  Uniprot ID: Q14508
  ENSP ID: ENSP00000217425
MPACRLGPLAAALLLSLLLFGFTLVSGTGAEKTGVCPELQADQNCTQECVSDSECADNLKCCSAGCATFCSLPNALFHWHLKTRRLWEISGPRPRRPTWDSS

SEQ ID NO: 97115 - protein, 76 aa, Homo sapiens
  Payload ID: 19371
  Gene Name: WAP four-disulfide core domain 2
  Uniprot ID: Q14508
  ENSP ID: ENSP00000340215
MPACRLGPLAAALLLSLLLFGFTLVSDKEGSCPQVNINFPQLGLCRDQCQVDSQCPGQMKCCRNGCGKVSCVTPNF

SEQ ID NO: 97116 - protein, 73 aa, Homo sapiens
  Payload ID: 19371
  Gene Name: WAP four-disulfide core domain 2
  Uniprot ID: Q14508
  ENSP ID: ENSP00000342890
MLQVQVNLPVSPLPTYPYSFFYPDKEGSCPQVNINFPQLGLCRDQCQVDSQCPGQMKCCRNGCGKVSCVTPNF

SEQ ID NO: 97117 - protein, 124 aa, Homo sapiens
  Payload ID: 19371
  Gene Name: WAP four-disulfide core domain 2
  Uniprot ID: Q14508
  ENSP ID: ENSP00000361761
MPACRLGPLAAALLLSLLLFGFTLVSGTGAEKTGVCPELQADQNCTQECVSDSECADNLKCCSAGCATFCSLPNDKEGSCPQVNINFPQLGLCRDQCQVDSQCPGQMKCCRNGCGKVSCVTPNF

SEQ ID NO: 97118 - protein, 79 aa, Homo sapiens
  Payload ID: 19371
  Gene Name: WAP four-disulfide core domain 2
  ENSP ID: ENSP00000404760
MPACRLGPLAAALLLSLLLFGFTLVSGTGAEKTGVCPELQADQNCTQECVSDSECADNLKCCSAGCATFCSLPNGQLAE

SEQ ID NO: 97119 - protein, 231 aa, Homo sapiens
  Payload ID: 19372
  Gene Name: WAP four-disulfide core domain 3
  Uniprot ID: Q8IUB2
  ENSP ID: ENSP00000243938
MMLSCLFLLKALLALGSLESWITAGEHAKEGECPPHKNPCKELCQGDELCPAEQKCCTTGCGRICRDIPKGRKRDCPRVIRKQSCLKRCITDETCPGVKKCCTLGCNKSCVVPISKQKLAEFGGECPADPLPCEELCDGDASCPQGHKCCSTGCGRTCLGDIEGGRGGDCPKVLVGLCIVGCVMDENCQAGEKCCKSGCGRFCVPPVLPPKLTMNPNWTVRSDSELEIPVP

SEQ ID NO: 97120 - protein, 225 aa, Homo sapiens
  Payload ID: 19372
  Gene Name: WAP four-disulfide core domain 3
  ENSP ID: ENSP00000337815
  MOD_RES (1)..(1): Any amino acid
XIKEALLALGSLESWITAGEHAKEGECPPHKNPCKELCQGDELCPAEQKCCTTGCGRICRDIPKGRKRDCPRVIRKQSCLKRCITDETCPGVKKCCTLGCNKSCVVPISKQKLAEFGGECPADPLPCEELCDGDASCPQGHKCCSTGCGRTCLGDIEGGRGGDCPKVLVGLCIVGCVMDENCQAGEKCCKSGCGRFCVPPVLPPKLTMNPNWTVRSDSELEIPVP

SEQ ID NO: 97121 - protein, 94 aa, Homo sapiens
  Payload ID: 19372
  Gene Name: WAP four-disulfide core domain 3
  ENSP ID: ENSP00000361713
MMLSCLFLLKALLALGSLESWITAGEHGRGGDCPKVLVGLCIVGCVMDENCQAGEKCCKSGCGRFCVPPVLPPKLTMNPNWTVRSDSELEIPVP

SEQ ID NO: 97122 - protein, 137 aa, Homo sapiens
  Payload ID: 19372
  Gene Name: WAP four-disulfide core domain 3
  ENSP ID: ENSP00000361715
MMLSCLFLLKALLALGSLESWITAGEHAKEGECPPHKNPCKELCQGDELCPAEQKCCTTGCGRICRDIPKGRGGDCPKVLVGLCIVGCVMDENCQAGEKCCKSGCGRFCVPPVLPPKLTMNPNWTVRSDSELEIPVP

SEQ ID NO: 97123 - protein, 224 aa, Homo sapiens
  Payload ID: 19373
  Gene Name: WAP four-disulfide core domain 5
  Uniprot ID: Q8TCV5
  ENSP ID: ENSP00000312381
MRTQSLLLLGALLAVGSQLPAVFGRKKGEKSGGCPPDDGPCLLSVPDQCVEDSQCPLTRKCCYRACFRQCVPRVSVKLGSCPEDQLRCLSPMNHLCHKDSDCSGKKRCCHSACGRDCRDPARGTAPGCPGQANSDLGSVALHLSWGPTERVHDGRPGALPAGQHYLYQRWFQPSDNHWPADTSLQPIHPWFLLLGVKVHSLSSEEGLCITPVLCTTAIRASHPS

SEQ ID NO: 97124 - protein, 123 aa, Homo sapiens
  Payload ID: 19373
  Gene Name: WAP four-disulfide core domain 5
  Uniprot ID: Q8TCV5
  ENSP ID: ENSP00000361875
MRTQSLLLLGALLAVGSQLPAVFGRKKGEKSGGCPPDDGPCLLSVPDQCVEDSQCPLTRKCCYRACFRQCVPRVSVKLGSCPEDQLRCLSPMNHLCHKDSDCSGKKRCCHSACGRDCRDPARG

SEQ ID NO: 97125 - protein, 131 aa, Homo sapiens
  Payload ID: 19374
  Gene Name: WAP four-disulfide core domain 6
  Uniprot ID: Q9BQY6
  ENSP ID: ENSP00000361750
MGLSGLLPILVPFILLGDIQEPGHAEGILGKPCPKIKVECEVEEIDQCTKPRDCPENMKCCPFSRGKKCLDFRKIYAVCHRRLAPAWPPYHTGGTIKKTKICSEFIYGGSQGNNNNFQTEAICLVTCKKYH

SEQ ID NO: 97126 - protein, 86 aa, Homo sapiens
  Payload ID: 19374
  Gene Name: WAP four-disulfide core domain 6
  Uniprot ID: Q9BQY6
  ENSP ID: ENSP00000361755
MGLSGLLPILVPFILLGDIQEPGHAEGILGKPCPKIKVECEVEEIDQCTKPRDCPENMKCCPFSRGKKCLDFRKVSLTLYHKEELE

SEQ ID NO: 97127 - protein, 241 aa, Homo sapiens
  Payload ID: 19375
  Gene Name: WAP four-disulfide core domain 8
  Uniprot ID: Q8IUA0
  ENSP ID: ENSP00000289953
MWTVRTEGGHFPLHSPTFSWRNVAFLLLLSLALEWTSAMLTKKIKHKPGLCPKERLTCTTELPDSCNTDFDCKEYQKCCFFACQKKCMDPFQEPCMLPVRHGNCNHEAQRWHFDFKNYRCTPFKYRGCEGNANNFLNEDACRTACMLIVKDGQCPLFPFTERKECPPSCHSDIDCPQTDKCCESRCGFVCARAWTVKKGFCPRKPLLCTKIDKPKCLQDEECPLVEKCCSHCGLKCMDPRR

SEQ ID NO: 97128 - protein, 241 aa, Homo sapiens; identical to SEQ ID NO: 97127
  Payload ID: 19375
  Gene Name: WAP four-disulfide core domain 8
  Uniprot ID: Q8IUA0
  ENSP ID: ENSP00000361735

SEQ ID NO: 97129 - protein, 89 aa, Homo sapiens
  Payload ID: 19376
  Gene Name: WAP four-disulfide core domain 9
  Uniprot ID: Q8NEX5
  ENSP ID: ENSP00000320532
MKPWILLLVMFISGVVMLLPVLGSFWNKDPFLDMIRETEQCWVQPPYKYCEKRCTKIMTCVRPNHTCCWTYCGNICLDNEEPLKSMLNP

SEQ ID NO: 97130 - protein, 548 aa, Homo sapiens
  Payload ID: 19377
  Gene Name: WAP, follistatin/kazal, immunoglobulin, kunitz and netrin domain containing 1
  Uniprot ID: Q96NZ8
  ENSP ID: ENSP00000324763
MPALRPLLPLLLLLRLTSGAGLLPGLGSHPGVCPNQLSPNLWVDAQSTCERECSRDQDCAAAEKCCINVCGLHSCVAARFPGSPAAPTTAASCEGFVCPQQGSDCDIWDGQPVCRCRDRCEKEPSFTCASDGLTYYNRCYMDAEACLRGLHLHIVPCKHVLSWPPSSPGPPETTARPTPGAAPVPPALYSSPSPQAVQVGGTASLHCDVSGRPPPAVTWEKQSHQRENLIMRPDQMYGNVVVTSIGQLVLYNARPEDAGLYTCTARNAAGLLRADFPLSVVQREPARDAAPSIPAPAECLPDVQACTGPTSPHLVLWHYDPQRGGCMTFPARGCDGAARGFETYEACQQACARGPGDACVLPAVQGPCRGWEPRWAYSPLLQQCHPFVYGGCEGNGNNFHSRESCEDACPVPRTPPCRACRLRSKLALSLCRSDFAIVGRLTEVLEEPEAAGGIARVALEDVLKDDKMGLKFLGTKYLEVTLSGMDWACPCPNMTAGDGPLVIMGEVRDGVAVLDAGSYVRAASEKRVKKILELLEKQACELLNRFQD

SEQ ID NO: 97131 - protein, 576 aa, Homo sapiens
  Payload ID: 19378
  Gene Name: WAP, follistatin/kazal, immunoglobulin, kunitz and netrin domain containing 2
  Uniprot ID: Q8TEU8
  ENSP ID: ENSP00000311184
MWAPRCRRFWSRWEQVAALLLLLLLLGVPPRSLALPPIRYSHAGICPNDMNPNLWVDAQSTCRRECETDQECETYEKCCPNVCGTKSCVAARYMDVKGKKGPVGMPKEATCDHFMCLQQGSECDIWDGQPVCKCKDRCEKEPSFTCASDGLTYYNRCYMDAEACSKGITLAVVTCRYHFTWPNTSPPPPETTMHPTTASPETPELDMAAPALLNNPVHQSVTMGETVSFLCDVVGRPRPEITWEKQLEDRENVVMRPNHVRGNVVVTNIAQLVIYNAQLQDAGIYTCTARNVAGVLRADFPLSVVRGHQAAATSESSPNGTAFPAAECLKPPDSEDCGEEQTRWHFDAQANNCLTFTFGHCHRNLNHFETYEACMLACMSGPLAACSLPALQGPCKAYAPRWAYNSQTGQCQSFVYGGCEGNGNNFESREACEESCPFPRGNQRCRACKPRQKLVTSFCRSDFVILGRVSELTEEPDSGRALVTVDEVLKDEKMGLKFLGQEPLEVTLLHVDWACPCPNVTVSEMPLIIMGEVDGGMAMLRPDSFVGASSARRVRKLREVMHKKTCDVLKEFLGLH

SEQ ID NO: 97132 - protein, 483 aa, Homo sapiens
  Payload ID: 19378
  Gene Name: WAP, follistatin/kazal, immunoglobulin, kunitz and netrin domain containing 2
  ENSP ID: ENSP00000405889
MDVKGKKGPVGMPKEATCDHFMCLQQGSECDIWDGQPVCKCKDRCEKEPSFTCASDGLTYYNRCYMDAEACSKGITLAVVTCRYHFTWPNTSPPPPETTMHPTTASPETPELDMAAPALLNNPVHQSVTMGETVSFLCDVVGRPRPEITWEKQLEDRENVVMRPNHVRGNVVVTNIAQLVIYNAQLQDAGIYTCTARNVAGVLRADFPLSVVRGHQAAATSESSPNGTAFPAAECLKPPDSEDCGEEQTRWHFDAQANNCLTFTFGHCHRNLNHFETYEACMLACMSGPLAACSLPALQGPCKAYAPRWAYNSQTGQCQSFVYGGCEGNGNNFESREACEESCPFPRGNQRCRACKPRQKLVTSFCRSDFVILGRVSELTEEPDSGRALVTVDEVLKDEKMGLKFLGQEPLEVTLLHVDWACPCPNVTVSEMPLIIMGEVDGGMAMLRPDSFVGASSARRVRKLREVMHKKTCDVLKEFLGLH

SEQ ID NO: 97133 - protein, 402 aa, Homo sapiens
  Payload ID: 19379
  Gene Name: WAPL cohesin release factor
  ENSP ID: ENSP00000263070
MDLDRASLDLMIRLLELEQDASSAKLLNEKDMNKIKEKIRRLCETVHNKHLDLENITTGHLAMETLLSLTSKRAGDWFKEELRLLGGLDHIVDKVKECVDHLSRDEDEEKLVASLWGAERCLRVLESVTVHNPENQSYLIAYKDSQLIVSSAKALQHCEELIQQYNRAEDSICLADSKPLPHQNVTNHVGKAVEDCMRAIIGVLLNLTNDNEWGSTKTGEQDGLIGTALNCVLQVPKYLPQEQRFDIRVLLFLERERAAQLAESKTDELIKDAPTTQHDKSGEWQETSGEIQWVSTEKTDGTEEKHKKEEEDEELDLNKALQHAGKHMEDCIVASYTALLLGCLCQESPINVTTVREYLPEGDFSIMTEMLKKFLSFMNLTCAVGTTGQKSISRVIEYLEHC

SEQ ID NO: 97134 - protein, 1190 aa, Homo sapiens
  Payload ID: 19379
  Gene Name: WAPL cohesin release factor
  Uniprot ID: Q7Z5K2
  ENSP ID: ENSP00000298767
MTSRFGKTYSRKGGNGSSKFDEVFSNKRTTLSTKWGETTFMAKLGQKRPNFKPDIQEIPKKPKVEEESTGDPFGFDSDDESLPVSSKNLAQVKCSSYSESSEAAQLEEVTSVLEANSKISHVVVEDTVVSDKCFPLEDTLLGKEKSTNRIVEDDASISSCNKLITSDKVENFHEEHEKNSHHIHKNADDSTKKPNAETTVASEIKETNDTWNSQFGKRPESPSEISPIKGSVRTGLFEWDNDFEDIRSEDCILSLDSDPLLEMKDDDFKNRLENLNEAIEEDIVQSVLRPTNCRTYCRANKTKSSQGASNFDKLMDGTSQALAKANSESSKDGLNQAKKGGVSCGTSFRGTVGRTRDYTVLHPSCLSVCNVTIQDTMERSMDEFTASTPADLGEAGRLRKKADIATSKTTTRFRPSNTKSKKDVKLEFFGFEDHETGGDEGGSGSSNYKIKYFGFDDLSESEDDEDDDCQVERKTSKKRTKTAPSPSLQPPPESNDNSQDSQSGTNNAENLDFTEDLPGVPESVKKPINKQGDKSKENTRKIFSGPKRSPTKAVYNARHWNHPDSEELPGPPVVKPQSVTVRLSSKEPNQKDDGVFKAPAPPSKVIKTVTIPTQPYQDIVTALKCRREDKELYTVVQHVKHFNDVVEFGENQEFTDDIEYLLSGLKSTQPLNTRCLSVISLATKCAMPSFRMHLRAHGMVAMVFKTLDDSQHHQNLSLCTAALMYILSRDRLNMDLDRASLDLMIRLLELEQDASSAKLLNEKDMNKIKEKIRRLCETVHNKHLDLENITTGHLAMETLLSLTSKRAGDWFKEELRLLGGLDHIVDKVKECVDHLSRDEDEEKLVASLWGAERCLRVLESVTVHNPENQSYLIAYKDSQLIVSSAKALQHCEELIQQYNRAEDSICLADSKPLPHQNVTNHVGKAVEDCMRAIIGVLLNLTNDNEWGSTKTGEQDGLIGTALNCVLQVPKYLPQEQRFDIRVLGLGLLINLVEYSARNRHCLVNMETSCSFDSSICSGEGDDSLRIGGQVHAVQALVQLFLERERAAQLAESKTDELIKDAPTTQHDKSGEWQETSGEIQWVSTEKTDGTEEKHKKEEEDEELDLNKALQHAGKHMEDCIVASYTALLLGCLCQESPINVTTVREYLPEGDFSIMTEMLKKFLSFMNLTCAVGTTGQKSISRVIEYLEHC

SEQ ID NO: 97135 - protein, 402 aa, Homo sapiens; identical to SEQ ID NO: 97133
  Payload ID: 19379
  Gene Name: WAPL cohesin release factor
  ENSP ID: ENSP00000361145

SEQ ID NO: 97136 - protein, 1190 aa, Homo sapiens; identical to SEQ ID NO: 97134
  Payload ID: 19379
  Gene Name: WAPL cohesin release factor
  Uniprot ID: Q7Z5K2
  ENSP ID: ENSP00000481451

SEQ ID NO: 97137 - protein, 465 aa, Homo sapiens
  Payload ID: 19380
  Gene Name: WAS protein family homolog 1
  Uniprot ID: A8K0Z3
  ENSP ID: ENSP00000485627
MTPVRMQHSLAGQTYAVPFIQPDLRREEAVQQMADALQYLQKVSGDIFSRISQQVEQSRSQVQAIGEKVSLAQAKIEKIKGSKKAIKVFSSAKYPAPGRLQEYGSIFTGAQDPGLQRRPRHRIQSKHRPLDERALQEKLKDFPVCVSTKPEPEDDAEEGLGGLPSNISSVSSLLLFNTTENLYKKYVFLDPLAGAVTKTHVMLGAETEEKLFDAPLSISKREQLEQQVPENYFYVPDLGQVPEIHVPSYLPDLPGIANDLMYSADLGPGIAPSAPGTIPELPTFHTEVAEPLKVDLQDGVLTPPPPPPPPPPAPEVLASAPPLPPSTAAPVGQGARQDDSSSSASPSVQGAPREVVDPSGGWATLLESIRQAGGIGKAKLRSMKERKLEKQQQKEQEQVRATSQGGHLMSDLFNKLVMRRKGISGKGPGAGEGPGGAFVRVSDSIPPLPPPQQPQAEEDEDDWES

SEQ ID NO: 97138 - protein, 140 aa, Homo sapiens
  Payload ID: 19381
  Gene Name: WAS protein family, member 1
  ENSP ID: ENSP00000265601
MPLVKRNIDPRHLCHTALPRGIKNELECVTNISLANIIRQLSSLSKYAEDIFGELFNEAHSFSFRVNSLQERVDRLSVSVTQLDPKEEELSLQDITMRKAFRSSTIQDQQLFDRKTLPIPLQETYDVCEQPPPLNILTPY

SEQ ID NO: 97139 - protein, 559 aa, Homo sapiens
  Payload ID: 19381
  Gene Name: WAS protein family, member 1
  Uniprot ID: Q92558
  ENSP ID: ENSP00000352425
MPLVKRNIDPRHLCHTALPRGIKNELECVTNISLANIIRQLSSLSKYAEDIFGELFNEAHSFSFRVNSLQERVDRLSVSVTQLDPKEEELSLQDITMRKAFRSSTIQDQQLFDRKTLPIPLQETYDVCEQPPPLNILTPYRDDGKEGLKFYTNPSYFFDLWKEKMLQDTEDKRKEKRKQKQKNLDRPHEPEKVPRAPHDRRREWQKLAQGPELAEDDANLLHKHIEVANGPASHFETRPQTYVDHMDGSYSLSALPFSQMSELLTRAEERVLVRPHEPPPPPPMHGAGDAKPIPTCISSATGLIENRPQSPATGRTPVFVSPTPPPPPPPLPSALSTSSLRASMTSTPPPPVPPPPPPPATALQAPAVPPPPAPLQIAPGVLHPAPPPIAPPLVQPSPPVARAAPVCETVPVHPLPQGEVQGLPPPPPPPPLPPPGIRPSSPVTVTALAHPPSGLHPTPSTAPGPHVPLMPPSPPSQVIPASEPKRHPSTLPVISDARSVLLEAIRKGIQLRKVEEQREQEAKHERIENDVATILSRRIAVEYSDSEDDSEFDEVDWLE

SEQ ID NO: 97140 - protein, 140 aa, Homo sapiens; identical to SEQ ID NO: 97138
  Payload ID: 19381
  Gene Name: WAS protein family, member 1
  ENSP ID: ENSP00000357934

SEQ ID NO: 97141 - protein, 559 aa, Homo sapiens; identical to SEQ ID NO: 97139
  Payload ID: 19381
  Gene Name: WAS protein family, member 1
  Uniprot ID: Q92558
  ENSP ID: ENSP00000376365

SEQ ID NO: 97142 - protein, 559 aa, Homo sapiens; identical to SEQ ID NO: 97139
  Payload ID: 19381
  Gene Name: WAS protein family, member 1
  Uniprot ID: Q92558
  ENSP ID: ENSP00000376366

SEQ ID NO: 97143 - protein, 559 aa, Homo sapiens; identical to SEQ ID NO: 97139
  Payload ID: 19381
  Gene Name: WAS protein family, member 1
  Uniprot ID: Q92558
  ENSP ID: ENSP00000376367

SEQ ID NO: 97144 - protein, 559 aa, Homo sapiens; identical to SEQ ID NO: 97139
  Payload ID: 19381
  Gene Name: WAS protein family, member 1
  Uniprot ID: Q92558
  ENSP ID: ENSP00000376368

SEQ ID NO: 97145 - protein, 89 aa, Homo sapiens
  Payload ID: 19381
  Gene Name: WAS protein family, member 1
  ENSP ID: ENSP00000402663
MPLVKRNIDPRHLCHTALPRGIKNELECVTNISLANIIRQLSSLSKYAEDIFGELFNEAHSFSFRVNSLQERVDRLSVSVTQLDPKEEE

SEQ ID NO: 97146 - protein, 89 aa, Homo sapiens; identical to SEQ ID NO: 97145
  Payload ID: 19381
  Gene Name: WAS protein family, member 1
  ENSP ID: ENSP00000404142

SEQ ID NO: 97147 - protein, 180 aa, Homo sapiens
  Payload ID: 19381
  Gene Name: WAS protein family, member 1
  ENSP ID: ENSP00000407041
MPLVKRNIDPRHLCHTALPRGIKNELECVTNISLANIIRQLSSLSKYAEDIFGELFNEAHSFSFRVNSLQERVDRLSVSVTQLDPKEEELSLQDITMRKAFRSSTIQDQQLFDRKTLPIPLQETYDVCEQPPPLNILTPYRDDGKEGLKFYTNPSYFFDLWKEKMLQDTEDKRKEKRKQK

SEQ ID NO: 97148 - protein, 281 aa, Homo sapiens
  Payload ID: 19382
  Gene Name: WAS protein family, member 2
  Uniprot ID: Q9Y6W5
  ENSP ID: ENSP00000439883
MPLVTRNIEPRHLCRQTLPSVRSELECVTNITLANVIRQLGSLSKYAEDIFGELFTQANTFASRVSSLAERVDRLQVKVTQLDPKEEEVSLQGINTRKAFRSSTIQDQKLFDRNSLPVPVLETYNTCDTPPPLNNLTPYRDDGKEALKFYTDPSYFFDLWKEKMLQDTKDIMKEKRKHRKEKKDNPNRGNVNPRKIKTRKEEWEKMKMGQEFVESKEKLGTSGYPPTLVYQNGSIGCVENVDASSYPPPPQSDSASSPSPSFSEDNLPPPPAEFRFSAAQG

SEQ ID NO: 97149 - protein, 498 aa, Homo sapiens
  Payload ID: 19382
  Gene Name: WAS protein family, member 2
  Uniprot ID: Q9Y6W5
  ENSP ID: ENSP00000483313
MPLVTRNIEPRHLCRQTLPSVRSELECVTNITLANVIRQLGSLSKYAEDIFGELFTQANTFASRVSSLAERVDRLQVKVTQLDPKEEEVSLQGINTRKAFRSSTIQDQKLFDRNSLPVPVLETYNTCDTPPPLNNLTPYRDDGKEALKFYTDPSYFFDLWKEKMLQDTKDIMKEKRKHRKEKKDNPNRGNVNPRKIKTRKEEWEKMKMGQEFVESKEKLGTSGYPPTLVYQNGSIGCVENVDASSYPPPPQSDSASSPSPSFSEDNLPPPPAEFSYPVDNQRGSGLAGPKRSSVVSPSHPPPAPPLGSPPGPKPGFAPPPAPPPPPPPMIGIPPPPPPVGFGSPGTPPPPSPPSFPPHPDFAAPPPPPPPPAADYPTLPPPPLSQPTGGAPPPPPPPPPPGPPPPPFTGADGQPAIPPPLSDTTKPKSSLPAVSDARSDLLSAIRQGFQLRRVEEQREQEKRDVVGNDVATILSRRIAVEYSDSEDDSSEFDEDDWSD

SEQ ID NO: 97150 - protein, 502 aa, Homo sapiens
  Payload ID: 19383
  Gene Name: WAS protein family, member 3
  Uniprot ID: Q9UPY6
  ENSP ID: ENSP00000335055
MPLVKRNIEPRHLCRGALPEGITSELECVTNSTLAAIIRQLSSLSKHAEDIFGELFNEANNFYIRANSLQDRIDRLAVKVTQLDSTVEEVSLQDINMKKAFKSSTVQDQQVVSKNSIPNPVADIYNQSDKPPPLNILTPYRDDKKDGLKFYTDPSYFFDLWKEKMLQDTEDKRKEKRRQKEQKRIDGTTREVKKVRKARNRRQEWNMMAYDKELRPDNRLSQSVYHGASSEGSLSPDTRSHASDVTDYSYPATPNHSLHPQPVTPSYAAGDVPPHGPASQAAEHEYRPPSASARHMALNRPQQPPPPPPPQAPEGSQASAPMAPADYGMLPAQIIEYYNPSGPPPPPPPPVIPSAQTAFVSPLQMPMQPPFPASASSTHAAPPHPPSTGLLVTAPPPPGPPPPPPGPPGPGSSLSSSPMHGPPVAEAKRQEPAQPPISDARSDLLAAIRMGIQLKKVQEQREQEAKREPVGNDVATILSRRIAVEYSDSDDDSEFDENDWSD

SEQ ID NO: 97151 - protein, 499 aa, Homo sapiens
  Payload ID: 19383
  Gene Name: WAS protein family, member 3
  Uniprot ID: Q9UPY6
  ENSP ID: ENSP00000354325
MPLVKRNIEPRHLCRGALPEGITSELECVTNSTLAAIIRQLSSLSKHAEDIFGELFNEANNFYIRANSLQDRIDRLAVKVTQLDSTVEEVSLQDINMKKAFKSSTVQDQQVVSKNSIPNPVADIYNQSDKPPPLNILTPYRDDKKDGLKFYTDPSYFFDLWKEKMLQDTEDKRKEKRRQKREKHKLNPNRNQQVNVRKVRTRKEEWERRKMGIEFMSDAKKLEQAGSAKEDRVPSGSHASDVTDYSYPATPNHSLHPQPVTPSYAAGDVPPHGPASQAAEHEYRPPSASARHMALNRPQQPPPPPPPQAPEGSQASAPMAPADYGMLPAQIIEYYNPSGPPPPPPPPVIPSAQTAFVSPLQMPMQPPFPASASSTHAAPPHPPSTGLLVTAPPPPGPPPPPPGPPGPGSSLSSSPMHGPPVAEAKRQEPAQPPISDARSDLLAAIRMGIQLKKVQEQREQEAKREPVGNDVATILSRRIAVEYSDSDDDSEFDENDWSD

SEQ ID NO: 97152 - protein, 809 aa, Homo sapiens
  Payload ID: 19384
  Gene Name: WAS protein homolog associated with actin, golgi membranes and microtubules
  Uniprot ID: Q8TF30
  ENSP ID: ENSP00000286760
MEDEQPDSLEGWVPVREGLFAEPERHRLRFLVAWNGAEGKFAVTCHDRTAQQRRLREGARLGPEPEPKPEAAVSPSSWAGLLSAAGLRGAHRQLAALWPPLERCFPRLPPELDVGGGGAWGLGLGLWALLWPTRAGPGEAALQELCGQLERYLGAAADGCGGATVRDALFPAEGGAADCESPREFRERALRARWVEADARLRQVIQGHGKANTMVALMNVYQEEDEAYQELVTVATMFFQYLLQPFRAMREVATLCKLDILKSLDEDDLGPRRVVALEKEAEEWTRRAEEAVVSIQDITVNYFKETVKALAGMQKEMEQDAKRFGQAAWATAIPRLEKLQLMLARETLQLMRAKELCLNHKRAEIQGKMEDLPEQEKNTNVVDELEIQFYEIQLELYEVKFEILKNEEILLTTQLDSLKRLIKEKQDEVVYYDPCENPEELKVIDCVVGLQDDKNLEVKELRRQCQQLESKRGRICAKRASLRSRKDQCKENHRFRLQQAEESIRYSRQHHSIQMKRDKIKEEEQKKKEWINQERQKTLQRLRSFKDKRLAQSVRNTSGSEPVAPNLPSDLSQQMCLPASHAVSVIHPSSRKTRGVPLSEAGNVKSPKCQNCHGNIPVQVFVPVGDQTHSKSSEELSLPPPPPPPPPPPPPPPPPPPPLRALSSSSQAATHQNLGFRAPVKDDQPRPLVCESPAERPRDSLESFSCPGSMDEVLASLRHGRAPLRKVEVPAVRPPHASINEHILAAIRQGVKLKKVHPDLGPNPSSKPTSNRRTSDLERSIKAALQRIKRVSADSEEDSDEQDPGQWDG

SEQ ID NO: 97153 - protein, 510 aa, Homo sapiens
  Payload ID: 19385
  Gene Name: WAS/WASL interacting protein family, member 1
  Uniprot ID: O43516
  ENSP ID: ENSP00000272746
MPVPPPPAPPPPPTFALANTEKPTLNKTEQAGRNALLSDISKGKKLKKTVTNDRSAPILDKPKGAGAGGGGGGFGGGGGFGGGGGGGGGGSFGGGGPPGLGGLFQAGMPKLRSTANRDNDSGGSRPPLLPPGGRSTSAKPFSPPSGPGRFPVPSPGHRSGPPEPQRNRMPPPRPDVGSKPDSIPPPVPSTPRPIQSSPHNRGSPPVPGGPRQPSPGPTPPPFPGNRGTALGGGSIRQSPLSSSSPFSNRPPLPPTPSRALDDKPPPPPPPVGNRPSIHREAVPPPPPQNNKPPVPSTPRPSASSQAPPPPPPPSRPGPPPLPPSSSGNDETPRLPQRNLSLSSSTPPLPSPGRSGPLPPPPSERPPPPVRDPPGRSGPLPPPPPVSRNGSTSRALPATPQLPSRSGVDSPRSGPRPPLPPDRPSAGAPPPPPPSTSIRNGFQDSPCEDEWESRFYFHPISDLPPPEPYVQTTKSYPSKLARNESRSGSNRRERGAPPLPPIPRPPKQAAE

SEQ ID NO: 97154 - protein, 503 aa, Homo sapiens
  Payload ID: 19385
  Gene Name: WAS/WASL interacting protein family, member 1
  Uniprot ID: O43516
  ENSP ID: ENSP00000352802
MPVPPPPAPPPPPTFALANTEKPTLNKTEQAGRNALLSDISKGKKLKKTVTNDRSAPILDKPKGAGAGGGGGGFGGGGGFGGGGGGGGGGSFGGGGPPGLGGLFQAGMPKLRSTANRDNDSGGSRPPLLPPGGRSTSAKPFSPPSGPGRFPVPSPGHRSGPPEPQRNRMPPPRPDVGSKPDSIPPPVPSTPRPIQSSPHNRGSPPVPGGPRQPSPGPTPPPFPGNRGTALGGGSIRQSPLSSSSPFSNRPPLPPTPSRALDDKPPPPPPPVGNRPSIHREAVPPPPPQNNKPPVPSTPRPSASSQAPPPPPPPSRPGPPPLPPSSSGNDETPRLPQRNLSLSSSTPPLPSPGRSGPLPPPPSERPPPPVRDPPGRSGPLPPPPPVSRNGSTSRALPATPQLPSRSGVDSPRSGPRPPLPPDRPSAGAPPPPPPSTSIRNGFQDSPCEDEWESRFYFHPISDLPPPEPYVQTTKSYPSKLARNESRSGSNRRERGAPPLPPIPR

SEQ ID NO: 97155 - protein, 503 aa, Homo sapiens; identical to SEQ ID NO: 97154
  Payload ID: 19385
  Gene Name: WAS/WASL interacting protein family, member 1
  Uniprot ID: O43516
  ENSP ID: ENSP00000376329

SEQ ID NO: 97156 - protein, 503 aa, Homo sapiens; identical to SEQ ID NO: 97154
  Payload ID: 19385
  Gene Name: WAS/WASL interacting protein family, member 1
  Uniprot ID: O43516
  ENSP ID: ENSP00000376330

SEQ ID NO: 97157 - protein, 493 aa, Homo sapiens
  Payload ID: 19385
  Gene Name: WAS/WASL interacting protein family, member 1
  Uniprot ID: O43516
  ENSP ID: ENSP00000386431
MPVPPPPAPPPPPTFALANTEKPTLNKTEQAGRNALLSDISKGKKLKKTVTNDRSAPILDKPKGAGAGGGGGGFGGGGGFGGGGGGGGGGSFGGGGPPGLGGLFQAGMPKLRSTANRDNDSGGSRPPLLPPGGRSTSAKPFSPPSGPGRFPVPSPGHRSGPPEPQRNRMPPPRPDVGSKPDSIPPPVPSTPRPIQSSPHNRGSPPVPGGPRQPSPGPTPPPFPGNRGTALGGGSIRQSPLSSSSPFSNRPPLPPTPSRALDDKPPPPPPPVGNRPSIHREAVPPPPPQNNKPPVPSTPRPSASSQAPPPPPPPSRPGPPPLPPSSSGNDETPRLPQRNLSLSSSTPPLPSPGRSGPLPPPPSERPPPPVRDPPGRSGPLPPPPPVSRNGSTSRALPATPQLPSRSGVDSPRSGPRPPLPPDRPSAGAPPPPPPSTSIRNGFQDSPCEDEWESRFYFHPISDLPPPEPYVQTTKSYPSKLARNESRSEYFCQGF

SEQ ID NO: 97158 - protein, 131 aa, Homo sapiens
  Payload ID: 19385
  Gene Name: WAS/WASL interacting protein family, member 1
  ENSP ID: ENSP00000386757
MPVPPPPAPPPPPTFALANTEKPTLNKTEQAGRNALLSDISKGKKLKKTVTNDRSAPILDKPKGAGAGGGGGGFGGGGGFGGGGGGGGGGSFGGGGPPGLGGLFQAGMPKLRSTANRDNGLAGVGRKGRSK

SEQ ID NO: 97159 - protein, 403 aa, Homo sapiens
  Payload ID: 19385
  Gene Name: WAS/WASL interacting protein family, member 1
  ENSP ID: ENSP00000387150
MPVPPPPAPPPPPTFALANTEKPTLNKTEQAGRNALLSDISKGKKLKKTVTNDRSAPILDKPKGAGAGGGGGGFGGGGGFGGGGGGGGGGSFGGGGPPGLGGLFQAGMPKLRSTANRDNDSGGSRPPLLPPGGRSTSAKPFSPPSGPGRFPVPSPGHRSGPPEPQRNRMPPPRPDVGSKPDSIPPPVPSTPRPIQSSPHNRGSPPVPGGPRQPSPGPTPPPFPGNRGTALGGGSIRQSPLSSSSPFSNRPPLPPTPSRALDDKPPPPPPPVGNRPSIHREAVPPPPPQNNKPPVPSTPRPSASSQAPPPPPPPSRPGPPPLPPSSSGNDETPRLPQRNLSLSSSTPPLPSPGRSGPLPPPPSERPPPPVRDPPGRSGMTRRGVSCFQNPACPNVPIILSVKIV

SEQ ID NO: 97160 - protein, 99 aa, Homo sapiens
  Payload ID: 19385
  Gene Name: WAS/WASL interacting protein family, member 1
  ENSP ID: ENSP00000388454
MPVPPPPAPPPPPTFALANTEKPTLNKTEQAGRNALLSDISKGKKLKKTVTNDRSAPILDKPKGAGAGGGGGGFGGGGGFGGGGGGGGGGSFGGGGPPG

SEQ ID NO: 97161 - protein, 157 aa, Homo sapiens
  Payload ID: 19385
  Gene Name: WAS/WASL interacting protein family, member 1
  ENSP ID: ENSP00000391785
MPVPPPPAPPPPPTFALANTEKPTLNKTEQAGRNALLSDISKGKKLKKTVTNDRSAPILDRAGAGGGGGGFGGGGGFGGGGGGGGGGSFGGGGPPGLGGLFQAGMPKLRSTANRDNDSGGSRPPLLPPGGRSTSAKPFSPPSGPGRFPVPSPGHRSG

SEQ ID NO: 97162 - protein, 492 aa, Homo sapiens
  Payload ID: 19385
  Gene Name: WAS/WASL interacting protein family, member 1
  ENSP ID: ENSP00000479992
MPVPPPPAPPPPPTFALANTEKPTLNKTEQAGRNALLSDISKGKKLKKTVTNDRSAPILDKPKGAGAGGGGGGFGGGGGFGGGGGGGGGGSFGGGGPPGLGGLFQAGMPKLRSTANRDNDSGGSRPPLLPPGGRSTSAKPFSPPSGPGRFPVPSPGHRSGPPEPQRNRMPPPRPDVGSKPDSIPPPVPSTPRPIQSSPHNRGSPPVPGGPRQPSPGPTPPPFPGNRGTALGGGSIRQSPLSSSSPFSNRPPLPPTPSRALDDKPPPPPPPVGNRPSIHREAVPPPPPQNNKPPVPSTPRPSAPHRPHLRPPPSRPGPPPLPPSSSGNDETPRLPQRNLSLSSSTPPLPSPGRSGPLPPPPSERPPPPVRDPPGRSGPLPPPPPVSRNGSTSRALPATPQLPSRSGVDSPRSGPRPPLPPDRPSAGAPPPPPPSTSIRNGFQDSPCEDEWESRFYFHPISDLPPPEPYVQTTKSYPSKLARNESRSEYFCQGF

SEQ ID NO: 97163 - protein, 440 aa, Homo sapiens
  Payload ID: 19386
  Gene Name: WAS/WASL interacting protein family, member 2
  Uniprot ID: Q8TF74
  ENSP ID: ENSP00000320924
MPIPPPPPPPPGPPPPPTFHQANTEQPKLSRDEQRGRGALLQDICKGTKLKKVTNINDRSAPILEKPKGSSGGYGSGGAALQPKGGLFQGGVLKLRPVGAKDGSENLAGKPALQIPSSRAAAPRPPVSAASGRPQDDTDSSRASLPELPRMQRPSLPDLSRPNTTSSTGMKHSSSAPPPPPPGRRANAPPTPLPMHSSKAPAYNREKPLPPTPGQRLHPGREGPPAPPPVKPPPSPVNIRTGPSGQSLAPPPPPYRQPPGVPNGPSSPTNESAPELPQRHNSLHRKTPGPVRGLAPPPPTSASPSLLSNRPPPPARDPPSRGAAPPPPPPVIRNGARDAPPPPPPYRMHGSEPPSRGKPPPPPSRTPAGPPPPPPPPLRNGHRDSITTVRSFLDDFESKYSFHPVEDFPAPEEYKHFQRIYPSKTNRAARGAPPLPPILR

SEQ ID NO: 97164 - protein, 182 aa, Homo sapiens
  Payload ID: 19386
  Gene Name: WAS/WASL interacting protein family, member 2
  ENSP ID: ENSP00000377663
MPIPPPPPPPPGPPPPPTFHQANTEQPKLSRDEQRGRGALLQDICKGTKLKKVTNINDRSAPILETPPPPPPVIRNGARDAPPPPPPYRMHGSEPPSRGKPPPPPSRTPAGPPPPPPPPLRNGHRDSITTVRSFLDDFESKYSFHPVEDFPAPEEYKHFQRIYPSKTNRAARGAPPLPPILR

SEQ ID NO: 97165 - protein, 440 aa, Homo sapiens; identical to SEQ ID NO: 97163
  Payload ID: 19386
  Gene Name: WAS/WASL interacting protein family, member 2
  Uniprot ID: Q8TF74
  ENSP ID: ENSP00000462350

SEQ ID NO: 97166 - protein, 63 aa, Homo sapiens
  Payload ID: 19386
  Gene Name: WAS/WASL interacting protein family, member 2
  ENSP ID: ENSP00000462386
MHGSEPPSRGKPPPPPSRTPAGPPPPPPPPLRNGHRDSITTVRSFLDDFESKYSFHPVEDFPA

SEQ ID NO: 97167 - protein, 440 aa, Homo sapiens; identical to SEQ ID NO: 97163
  Payload ID: 19386
  Gene Name: WAS/WASL interacting protein family, member 2
  Uniprot ID: Q8TF74
  ENSP ID: ENSP00000462826

SEQ ID NO: 97168 - protein, 103 aa, Homo sapiens
  Payload ID: 19386
  Gene Name: WAS/WASL interacting protein family, member 2
  ENSP ID: ENSP00000463149
MPIPPPPPPPPGPPPPPTFHQANTEQPKLSRDEQRGRGALLQDICKGTKLKKVTNINDRSAPILEKPKGSSGGYGSGGAALQPKGGLFQGGVLKLRPVGAKDG

SEQ ID NO: 97169 - protein, 79 aa, Homo sapiens
  Payload ID: 19386
  Gene Name: WAS/WASL interacting protein family, member 2
  ENSP ID: ENSP00000463869
MPIPPPPPPPPGPPPPPTFHQANTEQPKLSRDEQRGRGALLQDICKGTKLKKSRKEAVVAMALEELPCSPREVSSKEEC

SEQ ID NO: 97170 - protein, 483 aa, Homo sapiens
  Payload ID: 19387
  Gene Name: WAS/WASL interacting protein family, member 3
  Uniprot ID: A6NGB9
  ENSP ID: ENSP00000242140
MPVPPPPPPPLPPPPPPLGAPPPPPPSAPPVSTDTSSLRRADPKGRSALLADIQQGTRLRKVTQINDRSAPQIESSKGTNKEGGGSANTRGASTPPTLGDLFAGGFPVLRPAGQRDVAGGKTGQGPGSRAPSPRLPNKTISGPLIPPASPRLGNTSEAHGAARTAPPRPNVPAPPPPTPPPPPPPLPPPLPSSSPIKTPLVSPPGPLTKGNLPVVAPPVPCAPPPPPPPPPPTPPPLPPASVLSDKAVKPQLAPLHLPPIPPPLPLLPPCGYPGLKAEPASPAQDAQEPPAPPPPLPPYASCSPRASLPAPPLPGVNSSSETPPPLPPKSPSFQAPPQKAGAQALPAPPAPPGSQPFLQKKRHGRPGAGGGKLNPPPAPPARSPTTELSSKSQQATAWTPTQQPGGQLRNGSLHIIDDFESKFTFHSVEDFPPPDEYKPCQKIYPSKIPRSRTPGPWLQAEAVGQSSDDIKGRNSQLSLKTLR

SEQ ID NO: 97171 - protein, 483 aa, Homo sapiens
  Payload ID: 19387
  Gene Name: WAS/WASL interacting protein family, member 3
  ENSP ID: ENSP00000386790
MPVPPPPPPPLPPPPPPLGAPPPPPPSAPPVSTDTSSLRRADPKGRSALLADIQQGTRLRKVTQINDRSAPQIESSKGTNKEGGGSANTRGASTPPTLGDLFAGGFPVLRPAGQRDVAGGKTGQGPGSRAPSPRLPNKTISGPLIPPASPRLGNTSEAHGAARTAPPRPNVPAPPPPTPPPPPPPLPPPLPSSSPIKTPLVSPPGPLTKGNLPVVAPPVPCAPPPPPPPPPPTPPPLPPASVLSDKAVKPQLAPLHLPPIPPPLPLLPPCGYPGLKAEPASPAQDAQEPPAPPPPLPPYASCSPRASLPAPPLPGVNSSSETPPPLPPKSPSFQAPPQKAGAQALPAPPAPPGSQPFLQKKRHGRPGAGGGKLNPPPAPPARSPTTELSSKSQQATAWTPTQQPGGQLRNGSLHIIDDFESKFTFHSVEDFPPPDEYKPCQKIYPSKIPRSRTPGPWLQAEAVGQSSDDIKGRNSQVTQASCL

SEQ ID NO: 97172 - protein, 483 aa, Homo sapiens; identical to SEQ ID NO: 97170
  Payload ID: 19387
  Gene Name: WAS/WASL interacting protein family, member 3
  Uniprot ID: A6NGB9
  ENSP ID: ENSP00000386878

SEQ ID NO: 97173 - protein, 309 aa, Homo sapiens
  Payload ID: 19388
  Gene Name: WBP2 N-terminal like
  Uniprot ID: Q6ICG8
  ENSP ID: ENSP00000328800
MAVNQSHTENRRGALIPNGESLLKRSPNVELSFPQRSEGSNVFSGRKTGTLFLTSYRVIFITSCSISDPMLSFMMPFDLMTNLTVEQPVFAANFIKGTIQAAPYGGWEGQATFKLVFRNGDAIEFAQLMVKAASAAARGFPLRTLNDWFSSMGIYVITGEGNMCTPQMPCSVIVYGAPPAGYGAPPPGYGAPPAGYGAQPVGNEGPPVGYRASPVRYGAPPLGYGAPPAGYGAPPLGYGAPPLGYGTPPLGYGAPPLGYGAPPAGNEGPPAGYRASPAGSGARPQESTAAQAPENEASLPSASSSQVHS

SEQ ID NO: 97174 - protein, 309 aa, Homo sapiens; identical to SEQ ID NO: 97173
  Payload ID: 19388
  Gene Name: WBP2 N-terminal like
  Uniprot ID: Q6ICG8
  ENSP ID: ENSP00000332983

SEQ ID NO: 97175 - protein, 273 aa, Homo sapiens
  Payload ID: 19388
  Gene Name: WBP2 N-terminal like
  ENSP ID: ENSP00000389598
MAVNQSHTENRRGALIPNGESLLKRSPNVELSFPQRSEGSNVFSGRKTGTLFLTSYRVIFITSCSISDPMLSFMMPFDLMTNLTVEQPVFAANFIKGTIQAAPYGGWEGQATFKLVFRNGDAIEFAQLMVKAASAVIVYGAPPAGYGAPPPGYGAPPAGYGAQPVGNEGPPVGYRASPVRYGAPPLGYGAPPAGYGAPPLGYGAPPLGYGTPPLGYGAPPLGYGAPPAGNEGPPAGYRASPAGSGARPQESTAAQAPENEASLPSASSSQVHS

SEQ ID NO: 97176 - protein, 83 aa, Homo sapiens
  Payload ID: 19388
  Gene Name: WBP2 N-terminal like
  ENSP ID: ENSP00000400236
MAVNQSHTENRRGALIPNGESLLKRSPNVELSFPQRSEGSNVFSGRKTGTLFLTSYRYLLQTSLRELFRQLHMVAGKDKLLLN

SEQ ID NO: 97177 - protein, 309 aa, Homo sapiens; identical to SEQ ID NO: 97173
  Payload ID: 19388
  Gene Name: WBP2 N-terminal like
  Uniprot ID: Q6ICG8
  ENSP ID: ENSP00000401002

SEQ ID NO: 97178 - protein, 235 aa, Homo sapiens [sequence omitted]

SEQ ID NO: 97179 - protein, 677 aa, Homo sapiens
  Payload ID: 19389
  Gene Name: WD and tetratricopeptide repeats 1
  Uniprot ID: Q8N5D0
  ENSP ID: ENSP00000317971
MAKVNITRDLIRRQIKERGALSFERRYHVTDPFIRRLGLEAELQGHSGCVNCLEWNEKGDLLASGSDDQHTIVWDPLHHKKLLSMHTGHTANIFSVKFLPHAGDRILITGAADSKVHVHDLTVKETIHMFGDHTNRVKRIATAPMWPNTFWSAAEDGLIRQYDLRENSKHSEVLIDLTEYCGQLVEAKCLTVNPQDNNCLAVGASGPFVRLYDIRMIHNHRKSMKQSPSAGVHTFCDRQKPLPDGAAQYYVAGHLPVKLPDYNNRLRVLVATYVTFSPNGTELLVNMGGEQVYLFDLTYKQRPYTFLLPRKCHSSGEVQNGKMSTNGVSNGVSNGLHLHSNGFRLPESRGHVSPQVELPPYLERVKQQANEAFACQQWTQAIQLYSKAVQRAPHNAMLYGNRAAAYMKRKWDGDHYDALRDCLKAISLNPCHLKAHFRLARCLFELKYVAEALECLDDFKGKFPEQAHSSACDALGRDITAALFSKNDGEEKKGPGGGAPVRLRSTSRKDSISEDEMVLRERSYDYQFRYCGHCNTTTDIKEANFFGSNAQYIVSGSDDGSFFIWEKETTNLVRVLQGDESIVNCLQPHPSYCFLATSGIDPVVRLWNPRPESEDLTGRVVEDMEGASQANQRRMNADPLEVMLLNMGYRITGLSSGGAGASDDEDSSEGQVQCRPS

SEQ ID NO: 97180 - protein, 676 aa, Homo sapiens
  Payload ID: 19389
  Gene Name: WD and tetratricopeptide repeats 1
  Uniprot ID: Q8N5D0
  ENSP ID: ENSP00000355317
MAKVNITRDLIRRQIKERGALSFERRYHVTDPFIRRLGLEAELQGHSGCVNCLEWNEKGDLLASGSDDQHTIVWDPLHHKKLLSMHTGHTANIFSVKFLPHAGDRILITGAADSKVHVHDLTVKETIHMFGDHTNRVKRIATAPMWPNTFWSAAEDGLIRQYDLRENSKHSEVLIDLTEYCGQLVEAKCLTVNPQDNNCLAVGASGPFVRLYDIRMIHNHRKSMKQSPSAGVHTFCDRQKPLPDGAAQYYVAGHLPVKLPDYNNRLRVLVATYVTFSPNGTELLVNMGGEQVYLFDLTYKQRPYTFLLPRKCHSSGVQNGKMSTNGVSNGVSNGLHLHSNGFRLPESRGHVSPQVELPPYLERVKQQANEAFACQQWTQAIQLYSKAVQRAPHNAMLYGNRAAAYMKRKWDGDHYDALRDCLKAISLNPCHLKAHFRLARCLFELKYVAEALECLDDFKGKFPEQAHSSACDALGRDITAALFSKNDGEEKKGPGGGAPVRLRSTSRKDSISEDEMVLRERSYDYQFRYCGHCNTTTDIKEANFFGSNAQYIVSGSDDGSFFIWEKETTNLVRVLQGDESIVNCLQPHPSYCFLATSGIDPVVRLWNPRPESEDLTGRVVEDMEGASQANQRRMNADPLEVMLLNMGYRITGLSSGGAGASDDEDSSEGQVQCRPS

SEQ ID NO: 97181 - protein, 615 aa, Homo sapiens
  Payload ID: 19389
  Gene Name: WD and tetratricopeptide repeats 1
  Uniprot ID: Q8N5D0
  ENSP ID: ENSP00000434578
MAKVNITRDLIRRQIKERGALSFERRYHVTDPFIRRLGLEAELQGHSGCVNCLEWNEKGDLLASGSDDQHTIVWDPLHHKKLLSMHTGHTANIFSVKFLPHAGDRILITGAADSKVHVHDLTVKETIHMFGDHTNRVKRIATAPMWPNTFWSAAEDGLIRQYDLRENSKHSEVLIDLTEYCGQLVEAKCLTVNPQDNNCLAVGASGPFVRLYDIRMIHNHRKSMKQSPSAGVHTFCDRQKPLPDGAAQYYVAGHLPVKLPDYNNRLRVLVATYVTFSPNGTELLVNMGGEQVYLFDLTYKQRPYTFLLPRKCHSSGEVQNGKMSTNGVSNGVSNGLHLHSNGFRLPESRGHVSPQVELPPYLERVKQQANEAFACQQWTQAIQLYSKAVQRAPHNAMLYGNRAAAYMKRKWDGDHYDALRDCLKAISLNPCHLKAHFRLARCLFELKYVAEALECLDDFKGKFPEQAHSSACDALGRDITAALFSKNDGEEKKGPGGGAPVRLRSTSRKDSISEDEMVLRERSYDYQFRYCGHCNTTTDIKEANFFGRRPPTWSVCSKGMSPLSTACSHTPATASWPPVASILLCGSGTPDQRVKTSQAESWKIWRVLHRPTSGA

SEQ ID NO: 97182 - protein, 125 aa, Homo sapiens
  Payload ID: 19389
  Gene Name: WD and tetratricopeptide repeats 1
  ENSP ID: ENSP00000435903
IVSGSDDGSFFIWEKETTNLVRVLQGDESIVNCLQPHPSYCFLATSGIDPVVRLWNPRPESEDLTGRVVEDMEGASQANQRRMNADPLEVMLLNMGYRITGLSSGGAGASDDEDSSEGQVQCRPS

SEQ ID NO: 97183 - protein, 410 aa, Homo sapiens
  Payload ID: 19390
  Gene Name: WD repeat and FYVE domain containing 1
  Uniprot ID: Q8IWB7
  ENSP ID: ENSP00000233055
MAAEIHSRPQSSRPVLLSKIEGHQDAVTAALLIPKEDGVITASEDRTIRVWLKRDSGQYWPSIYHTMASPCSAMAYHHDSRRIFVGQDNGAVMEFHVSEDFNKMNFIKTYPAHQNRVSAIIFSLATEWVISTGHDKCVSWMCTRSGNMLGRHFFTSWASCLQYDFDTQYAFVGDYSGQITLLKLEQNTCSVITTLKGHEGSVACLWWDPIQRLLFSGASDNSIIMWDIGGRKGRTLLLQGHHDKVQSLCYLQLTRQLVSCSSDGGIAVWNMDVSREEAPQWLESDSCQKCEQPFFWNIKQMWDTKTLGLRQHHCRKCGQAVCGKCSSKRSSYPVMGFEFQVRVCDSCYDSIKDEDRTSLATFHEGKHNISHMSMDIARGLMVTCGTDRIVKIWDMTPVVGCSLATGFSPH

SEQ ID NO: 97184 - protein, 215 aa, Homo sapiens
  Payload ID: 19390
  Gene Name: WD repeat and FYVE domain containing 1
  ENSP ID: ENSP00000395416
MAAEIHSRPQSSRPVLLSKIEGHQDAVTAALLIPKEDGVITASEDRTIRVWLKRDSGQYWPSIYHTMASHQNRVSAIIFSLATEWVISTGHDKCVSWMCTRSGNMLGRHFFTSWASCLQYDFDTQYAFVGDYSGQITLLKLEQNTCSVITTLKGHEGSVACLWWDPIQRLLFSGASDNSIIMWDIGGRKGRTLLLQGHHDKVQSLCYLQLTRQLV

SEQ ID NO: 97185 - protein, 400 aa, Homo sapiens
  Payload ID: 19391
  Gene Name: WD repeat and FYVE domain containing 2
  Uniprot ID: Q96P53
  ENSP ID: ENSP00000298125
MAAEIQPKPLTRKPILLQRMEGSQEVVNMAVIVPKEEGVISVSEDRTVRVWLKRDSGQYWPSVYHAMPSPCSCMSFNPETRRLSIGLDNGTISEFILSEDYNKMTPVKNYQAHQSRVTMILFVLELEWVLSTGQDKQFAWHCSESGQRLGGYRTSAVASGLQFDVETRHVFIGDHSGQVTILKLEQENCTLVTTFRGHTGGVTALCWDPVQRVLFSGSSDHSVIMWDIGGRKGTAIELQGHNDRVQALSYAQHTRQLISCGGDGGIVVWNMDVERQETPEWLDSDSCQKCDQPFFWNFKQMWDSKKIGLRQHHCRKCGKAVCGKCSSKRSSIPLMGFEFEVRVCDSCHEAITDEERAPTATFHDSKHNIVHVHFDATRGWLLTSGTDKVIKLWDMTPVVS

SEQ ID NO: 97186 - protein, 62 aa, Homo sapiens
  Payload ID: 19391
  Gene Name: WD repeat and FYVE domain containing 2
  ENSP ID: ENSP00000482942
MAAEIQPKPLTRKPILLQRMEGSQEVVNMAVIVPKEEGVISVSEDRSNGKHCKHTPVASILQ

SEQ ID NO: 97187 - protein, 3526 aa, Homo sapiens
  Payload ID: 19392
  Gene Name: WD repeat and FYVE domain containing 3
  Uniprot ID: Q8IZQ1
  ENSP ID: ENSP00000295888
MNMVKRIMGRPRQEECSPQDNALGLMHLRRLFTELCHPPRHMTQKEQEEKLYMMLPVFNRVFGNAPPNTMTEKFSDLLQFTTQVSRLMVTEIRRRASNKSTEAASRAIVQFLEINQSEEASRGWMLLTTINLLASSGQKTVDCMTTMSVPSTLVKCLYLFFDLPHVPEAVGGAQNELPLAERRGLLQKVFVQILVKLCSFVSPAEELAQKDDLQLLFSAITSWCPPYNLPWRKSAGEVLMTISRHGLSVNVVKYIHEKECLSTCVQNMQQSDDLSPLEIVEMFAGLSCFLKDSSDVSQTLLDDFRIWQGYNFLCDLLLRLEQAKEAESKDALKDLVNLITSLTTYGVSELKPAGITTGAPFLLPGFAVPQPAGKGHSVRNVQAFAVLQNAFLKAKTSFLAQIILDAITNIYMADNANYFILESQHTLSQFAEKISKLPEVQNKYFEMLEFVVFSLNYIPCKELISVSILLKSSSSYHCSIIAMKTLLKFTRHDYIFKDVFREVGLLEVMVNLLHKYAALLKDPTQALNEQGDSRNNSSVEDQKHLALLVMETLTVLLQGSNTNAGIFREFGGARCAHNIVKYPQCRQHALMTIQQLVLSPNGDDDMGTLLGLMHSAPPTELQLKTDILRALLSVLRESHRSRTVFRKVGGFVYITSLLVAMERSLSCPPKNGWEKVNQNQVFELLHTVFCTLTAAMRYEPANSHFFKTEIQYEKLADAVRFLGCFSDLRKISAMNVFPSNTQPFQRLLEEDVISIESVSPTLRHCSKLFIYLYKVATDSFDSRAEQIPPCLTSESSLPSPWGTPALSRKRHAYHSVSTPPVYPPKNVADLKLHVTTSSLQSSDAVIIHPGAMLAMLDLLASVGSVTQPEHALDLQLAVANILQSLVHTERNQQVMCEAGLHARLLQRCSAALADEDHSLHPPLQRMFERLASQALEPMVLREFLRLASPLNCGAWDKKLLKQYRVHKPSSLSYEPEMRSSMITSLEGLGTDNVFSLHEDNHYRISKSLVKSAEGSTVPLTRVKCLVSMTTPHDIRLHGSSVTPAFVEFDTSLEGFGCLFLPSLAPHNAPTNNTVTTGLIDGAVVSGIGSGERFFPPPSGLSYSSWFCIEHFSSPPNNHPVRLLTVVRRANSSEQHYVCLAIVLSAKDRSLIVSTKEELLQNYVDDFSEESSFYEILPCCARFRCGELIIEGQWHHLVLVMSKGMLKNSTAALYIDGQLVNTVKLHYVHSTPGGSGSANPPVVSTVYAYIGTPPAQRQIASLVWRLGPTHFLEEVLPSSNVTTIYELGPNYVGSFQAVCMPCKDAKSEGVVPSPVSLVPEEKVSFGLYALSVSSLTVARIRKVYNKLDSKAIAKQLGISSHENATPVKLIHNSAGHLNGSARTIGAALIGYLGVRTFVPKPVATTLQYVGGAAAILGLVAMASDVEGLYAAVKALVCVVKSNPLASKEMERIKGYQLLAMLLKKKRSLLNSHILHLTFSLVGTVDSGHETSIIPNSTAFQDLLCDFEVWLHAPYELHLSLFEHFIELLTESSEASKNAKLMREFQLIPKLLLTLRDMSLSQPTIAAISNVLSFLLQGFPSSNDLLRFGQFISSTLPTFAVCEKFVVMEINNEEKLDTGTEEEFGGLVSANLILLRNRLLDILLKLIYTSKEKTSINLQACEELVKTLGFDWIMMFMEEHLHSTTVTAAMRILVVLLSNQSILIKFKEGLSGGGWLEQTDSVLTNKIGTVLGFNVGRSAGGRSTVREINRDACHFPGFPVLQSFLPKHTNVPALYFLLMALFLQQPVSELPENLQVSVPVISCRSKQGCQFDLDSIWTFIFGVPASSGTVVSSIHNVCTEAVFLLLGMLRSMLTSPWQSEEEGSWLREYPVTLMQFFRYLYHNVPDLASMWMSPDFLCALAATVFPFNIRPYSEMVTDLDDEVGSPAEEFKAFAADTGMNRSQSEYCNVGTKTYLTNHPAKKFVFDFMRVLIIDNLCLTPASKQTPLIDLLLEASPERSTRTQQKEFQTYILDSVMDHLLAADVLLGEDASLPITSGGSYQVLVNNVFYFTQRVVDKLWQGMFNKESKLLIDFIIQLIAQSKRRSQGLSLDAVYHCLNRTILYQFSRAHKTVPQQVALLDSLRVLTVNRNLILGPGNHDQEFISCLAHCLINLHVGSNVDGFGLEAEARMTTWHIMIPSDIEPDGSYSQDISEGRQLLIKAVNRVWTELIHSKKQVLEELFKVTLPVNERGHVDIATARPLIEEAALKCWQNHLAHEKKCISRGEALAPTTQSKLSRVSSGFGLSKLTGSRRNRKESGLNKHSLSTQEISQWMFTHIAVVRDLVDTQYKEYQERQQNALKYVTEEWCQIECELLRERGLWGPPIGSHLDKWMLEMTEGPCRMRKKMVRNDMFYNHYPYVPETEQETNVASEIPSKQPETPDDIPQKKPARYRRAVSYDSKEYYMRLASGNPAIVQDAIVESSEGEAAQQEPEHGEDTIAKVKGLVKPPLKRSRSAPDGGDEENQEQLQDQIAEGSSIEEEEKTDNATLLRLLEEGEKIQHMYRCARVQGLDTSEGLLLFGKEHFYVIDGFTMTATREIRDIETLPPNMHEPIIPRGARQGPSQLKRTCSIFAYEDIKEVHKRRYLLQPIAVEVFSGDGRNYLLAFQKGIRNKVYQRFLAVVPSLTDSSESVSGQRPNTSVEQGSGLLSTLVGEKSVTQRWERGEISNFQYLMHLNTLAGRSYNDLMQYPVFPWILADYDSEEVDLTNPKTFRNLAKPMGAQTDERLAQYKKRYKDWEDPNGETPAYHYGTHYSSAMIVASYLVRMEPFTQIFLRLQGGHFDLADRMFHSVREAWYSASKHNMADVKELIPEFFYLPEFLFNSNNFDLGCKQNGTKLGDVILPPWAKGDPREFIRVHREALECDYVSAHLHEWIDLIFGYKQQGPAAVEAVNVFHHLFYEGQVDIYNINDPLKETATIGFINNFGQIPKQLFKKPHPPKRVRSRLNGDNAGISVLPGSTSDKIFFHHLDNLRPSLTPVKELKEPVGQIVCTDKGILAVEQNKVLIPPTWNKTFAWGYADLSCRLGTYESDKAMTVYECLSEWGQILCAICPNPKLVITGGTSTVVCVWEMGTSKEKAKTVTLKQALLGHTDTVTCATASLAYHIIVSGSRDRTCIIWDLNKLSFLTQLRGHRAPVSALCINELTGDIVSCAGTYIHVWSINGNPIVSVNTFTGRSQQIICCCMSEMNEWDTQNVIVTGHSDGVVRFWRMEFLQVPETPAPEPAEVLEMQEDCPEAQIGQEAQDEDSSDSEADEQSISQDPKDTPSQPSSTSHRPRAASCRATAAWCTDSGSDDSRRWSDQLSLDEKDGFIFVNYSEGQTRAHLQGPLSHPHPNPIEVRNYSRLKPGYRWERQLVFRSKLTMHTAFDRKDNAHPAEVTALGISKDHSRILVGDSRGRVFSWSVSDQPGRSAADHWVKDEGGDSCSGCSVRFSLTERRHHCRNCGQLFCQKCSRFQSEIKRLKISSPVRVCQNCYYNLQHERGSEDGPRNC

SEQ ID NO: 97188 - protein, 9 aa, Homo sapiens
  Payload ID: 19392
  Gene Name: WD repeat and FYVE domain containing 3
  ENSP ID: ENSP00000422741
MNMVKRIMG

SEQ ID NO: 97189 - protein, 639 aa, Homo sapiens
  Payload ID: 19392
  Gene Name: WD repeat and FYVE domain containing 3
  ENSP ID: ENSP00000424987
RKKMVRNDMFYNHYPYVPETEQETNVAKPARYRRAVSYDSKEYYMRLASGNPAIVQDAIVESSEGEAAQQEPEHGEDTIAKVKGLVKPPLKRSRSAPDGGDEENQEQLQDQIAEGSSIEEEEKTDNATLLRLLEEGEKIQHMYRCARVQGLDTSEGLLLFGKEHFYVIDGFTMTATREIRDIETLPPNMHEPIIPRGARQGPSQLKRTCSIFAYEDIKEVHKRRYLLQPIAVEVFSGDGRNYLLAFQKGIRNKVYQRFLAVVPSLTDSSESVSGQRPNTSVEQGSGLLSTLVGEKSVTQRWERGEISNFQYLMHLNTLAGRSYNDLMQYPVFPWILADYDSEEVDLTNPKTFRNLAKPMGAQTDERLAQYKKRYKDWEDPNGETPAYHYGTHYSSAMIVASYLVRMEPFTQIFLRLQGGHFDLADRMFHSVREAWYSASKHNMADVKELIPEFFYLPEFLFNSNNFDLGCKQNGTKLGDVILPPWAKGDPREFIRVHREALECDYVSAHLHEWIDLIFGYKQQGPAAVEAVNVFHHLFYEGQVDIYNINDPLKETATIGFINNFGQIPKQLFKKPHPPKRVRSRLNGDNAGISVLPGSTSDKIFFHHLDNLRPSLTPVKELKEPVGQIVCTDKGILAVE

SEQ ID NO: 97190 - protein, 60 aa, Homo sapiens
  Payload ID: 19392
  Gene Name: WD repeat and FYVE domain containing 3
  ENSP ID: ENSP00000425699
MNMVKRIMGRPRQEECSPQDNALGLMHLRRLFTELCHPPRHMTQKEQEEKLYMMLPVFNR

SEQ ID NO: 97191 - protein, 80 aa, Homo sapiens
  Payload ID: 19392
  Gene Name: WD repeat and FYVE domain containing 3
  ENSP ID: ENSP00000426813
  MOD_RES (1)..(1): Any amino acid
XAPPNTMTEKFSDLLQFTTQVSRLMVTEIRRRASNKSTEKQCALLSPKDFKATTPSEAASRAIVQFLEINQSEEASRGWM

SEQ ID NO: 97192 - protein, 1129 aa, Homo sapiens
  Payload ID: 19393
  Gene Name: WD repeat and HMG-box DNA binding protein 1
  Uniprot ID: O75717
  ENSP ID: ENSP00000353793
MPATRKPMRYGHTEGHTEVCFDDSGSFIVTCGSDGDVRIWEDLDDDDPKFINVGEKAYSCALKSGKLVTAVSNNTIQVHTFPEGVPDGILTRFTTNANHVVFNGDGTKIAAGSSDFLVKIVDVMDSSQQKTFRGHDAPVLSLSFDPKDIFLASASCDGSVRVWQISDQTCAISWPLLQKCNDVINAKSICRLAWQPKSGKLLAIPVEKSVKLYRRESWSHQFDLSDNFISQTLNIVTWSPCGQYLAAGSINGLIIVWNVETKDCMERVKHEKGYAICGLAWHPTCGRISYTDAEGNLGLLENVCDPSGKTSSSKVSSRVEKDYNDLFDGDDMSNAGDFLNDNAVEIPSFSKGIINDDEDDEDLMMASGRPRQRSHILEDDENSVDISMLKTGSSLLKEEEEDGQEGSIHNLPLVTSQRPFYDGPMPTPRQKPFQSGSTPLHLTHRFMVWNSIGIIRCYNDEQDNAIDVEFHDTSIHHATHLSNTLNYTIADLSHEAILLACESTDELASKLHCLHFSSWDSSKEWIIDLPQNEDIEAICLGQGWAAAATSALLLRLFTIGGVQKEVFSLAGPVVSMAGHGEQLFIVYHRGTGFDGDQCLGVQLLELGKKKKQILHGDPLPLTRKSYLAWIGFSAEGTPCYVDSEGIVRMLNRGLGNTWTPICNTREHCKGKSDHYWVVGIHENPQQLRCIPCKGSRFPPTLPRPAVAILSFKLPYCQIATEKGQMEEQFWRSVIFHNHLDYLAKNGYEYEESTKNQATKEQQELLMKMLALSCKLEREFRCVELADLMTQNAVNLAIKYASRSRKLILAQKLSELAVEKAAELTATQVEEEEEEEDFRKKLNAGYSNTATEWSQPRFRNQVEEDAEDSGEADDEEKPEIHKPGQNSFSKSTNSSDVSAKSGAVTFSSQGRVNPFKVSASSKEPAMSMNSARSTNILDNMGKSSKKSTALSRTTNNEKSPIIKPLIPKPKPKQASAASYFQKRNSQTNKTEEVKEENLKNVLSETPAICPPQNTENQRPKTGFQMWLEENRSNILSDNPDFSDEADIIKEGMIRFRVLSTEERKVWANKAKGETASEGTEAKKRKRVVDESDETENQEEKAKENLNLSKKQKPLDFSTNQKLSAFAFKQE

SEQ ID NO: 97193 - protein, 1006 aa, Homo sapiens
  Payload ID: 19393
  Gene Name: WD repeat and HMG-box DNA binding protein 1
  Uniprot ID: O75717
  ENSP ID: ENSP00000399349
MDSSQQKTFRGHDAPVLSLSFDPKDIFLASASCDGSVRVWQISDQTCAISWPLLQKCNDVINAKSICRLAWQPKSGKLLAIPVEKSVKLYRRESWSHQFDLSDNFISQTLNIVTWSPCGQYLAAGSINGLIIVWNVETKDCMERVKHEKGYAICGLAWHPTCGRISYTDAEGNLGLLENVCDPSGKTSSSKVSSRVEKDYNDLFDGDDMSNAGDFLNDNAVEIPSFSKGIINDDEDDEDLMMASGRPRQRSHILEDDENSVDISMLKTGSSLLKEEEEDGQEGSIHNLPLVTSQRPFYDGPMPTPRQKPFQSGSTPLHLTHRFMVWNSIGIIRCYNDEQDNAIDVEFHDTSIHHATHLSNTLNYTIADLSHEAILLACESTDELASKLHCLHFSSWDSSKEWIIDLPQNEDIEAICLGQGWAAAATSALLLRLFTIGGVQKEVFSLAGPVVSMAGHGEQLFIVYHRGTGFDGDQCLGVQLLELGKKKKQILHGDPLPLTRKSYLAWIGFSAEGTPCYVDSEGIVRMLNRGLGNTWTPICNTREHCKGKSDHYWVVGIHENPQQLRCIPCKGSRFPPTLPRPAVAILSFKLPYCQIATEKGQMEEQFWRSVIFHNHLDYLAKNGYEYEESTKNQATKEQQELLMKMLALSCKLEREFRCVELADLMTQNAVNLAIKYASRSRKLILAQKLSELAVEKAAELTATQVEEEEEEEDFRKKLNAGYSNTATEWSQPRFRNQVEEDAEDSGEADDEEKPEIHKPGQNSFSKSTNSSDVSAKSGAVTFSSQGRVNPFKVSASSKEPAMSMNSARSTNILDNMGKSSKKSTALSRTTNNEKSPIIKPLIPKPKPKQASAASYFQKRNSQTNKTEEVKEENLKNVLSETPAICPPQNTENQRPKTGFQMWLEENRSNILSDNPDFSDEADIIKEGMIRFRVLSTEERKVWANKAKGETASEGTEAKKRKRVVDESDETENQEEKAKENLNLSKKQKPLDFSTNQKLSAFAFKQE

SEQ ID NO: 97194 - protein, 168 aa, Homo sapiens
  Payload ID: 19393
  Gene Name: WD repeat and HMG-box DNA binding protein 1
  ENSP ID: ENSP00000413435
MPATRKPMRYGHTEGHTEVCFDDSGSFIVTCGSDGDVRIWEDLDDDDPKFINVGEKAYSCALKSGKLVTAVSNNTIQVHTFPEGVPDGILTRFTTNANHVVFNGDGTKIAAGSSDFLVKIVDVMDSSQQKTFRGHDAPVLSLSFDPKDIFLASASCDGSVRVWQISDQ

SEQ ID NO: 97195 - protein, 64 aa, Homo sapiens
  Payload ID: 19393
  Gene Name: WD repeat and HMG-box DNA binding protein 1
  ENSP ID: ENSP00000456806
  MOD_RES (1)..(1): Any amino acid
XGSSLLKEEEEDGQEGSIHNLPLVTSQRPFYDGPMPTPRQKPFQSGSTPLHLTHRFMQASLPAL

SEQ ID NO: 97196 - protein, 421 aa, Homo sapiens
  Payload ID: 19394
  Gene Name: WD repeat and SOCS box containing 1
  Uniprot ID: Q9Y6I7
  ENSP ID: ENSP00000262394
MASFPPRVNEKEIVRLRTIGELLAPAAPFDKKCGRENWTVAFAPDGSYFAWSQGHRTVKLVPWSQCLQNFLLHGTKNVTNSSSLRLPRQNSDGGQKNKPREHIIDCGDIVWSLAFGSSVPEKQSRCVNIEWHRFRFGQDQLLLATGLNNGRIKIWDVYTGKLLLNLVDHTEVVRDLTFAPDGSLILVSASRDKTLRVWDLKDDGNMMKVLRGHQNWVYSCAFSPDSSMLCSVGASKAVFLWNMDKYTMIRKLEGHHHDVVACDFSPDGALLATASYDTRVYIWDPHNGDILMEFGHLFPPPTPIFAGGANDRWVRSVSFSHDGLHVASLADDKMVRFWRIDEDYPVQVAPLSNGLCCAFSTDGSVLAAGTHDGSVYFWATPRQVPSLQHLCRMSIRRVMPTQEVQELPIPSKLLEFLSYRI

SEQ ID NO: 97197 - protein, 275 aa, Homo sapiens
  Payload ID: 19394
  Gene Name: WD repeat and SOCS box containing 1
  Uniprot ID: Q9Y6I7
  ENSP ID: ENSP00000327055
MASFPPRVNEKEIGKLLLNLVDHTEVVRDLTFAPDGSLILVSASRDKTLRVWDLKDDGNMMKVLRGHQNWVYSCAFSPDSSMLCSVGASKAVFLWNMDKYTMIRKLEGHHHDVVACDFSPDGALLATASYDTRVYIWDPHNGDILMEFGHLFPPPTPIFAGGANDRWVRSVSFSHDGLHVASLADDKMVRFWRIDEDYPVQVAPLSNGLCCAFSTDGSVLAAGTHDGSVYFWATPRQVPSLQHLCRMSIRRVMPTQEVQELPIPSKLLEFLSYRI

SEQ ID NO: 97198 - protein, 213 aa, Homo sapiens
  Payload ID: 19394
  Gene Name: WD repeat and SOCS box containing 1
  ENSP ID: ENSP00000416112
MASFPPRVNEKEIDGSYFAWSQGHRTVKLVPWSQCLQNFLLHGTKNVTNSSSLRLPRQNSDGGQKNKPREHIIDCGDIVWSLAFGSSVPEKQSRCVNIEWHRFRFGQDQLLLATGLNNGRIKIWDVYTGKLLLNLVDHTEVVRDLTFAPDGSLILVSASRDKTLRVWDLKDDGNMMKVLRGHQNWVYSCAFSPDSSMLCSVGASKAVVAAILV

SEQ ID NO: 97199 - protein, 98 aa, Homo sapiens
  Payload ID: 19394
  Gene Name: WD repeat and SOCS box containing 1
  ENSP ID: ENSP00000461991
MASFPPRVNEKEIGKLLLNLVDHTEVVRDLTFAPDGSLILVSASRDKTLRVWDLKDDGNMMKVLRGHQNWVYSCAFSPDSSMLCSVGASKAVVAAILV

SEQ ID NO: 97200 - protein, 78 aa, Homo sapiens
  Payload ID: 19394
  Gene Name: WD repeat and SOCS box containing 1
  ENSP ID: ENSP00000462365
MASFPPRVNEKEIAPAAPFDKKCGRENWTVAFAPDGSYFAWSQGHRTVKLVPWSQCLQNFLLHGTKNVTNSSSLRLPR

SEQ ID NO: 97201 - protein, 54 aa, Homo sapiens
  Payload ID: 19394
  Gene Name: WD repeat and SOCS box containing 1
  ENSP ID: ENSP00000462595
MASFPPRVNEKEIGNMMKVLRGHQNWVYSCAFSPDSSMLCSVGASKAVVAAILV

SEQ ID NO: 97202 - protein, 207 aa, Homo sapiens
  Payload ID: 19394
  Gene Name: WD repeat and SOCS box containing 1
  ENSP ID: ENSP00000462737
MASFPPRVNEKEIVFLFFLLVRLRTIGELLAPAAPFDKKCGRENWTVAFAPDGSYFAWSQGHRTVKLVPWSQCLQNFLLHGTKNVTNSSSLRLPRQNSDGGQKNKPREHIIDCGDIVWSLAFGSSVPEKQSRCVNIEWHRFRFGQDQLLLATGLNNGRIKIWDVYTGKLLLNLVDHTEVVRDLTFAPDGSLILVSASRDKTLRVWDL

SEQ ID NO: 97203 - protein, 143 aa, Homo sapiens
  Payload ID: 19394
  Gene Name: WD repeat and SOCS box containing 1
  ENSP ID: ENSP00000462900
MASFPPRVNEKEIGKLLLNLVDHTEVVRDLTFAPDGSLILVSASRDKTLRVWDLKDDGNMMKVLRGHQNWVYSCAFSPDSSMLCSVGASKAVFLWNMDKYTMIRKLEGHHHDVVACDFSPDGALLATASYDTRVYIWDPHNGD

SEQ ID NO: 97204 - protein, 74 aa, Homo sapiens
  Payload ID: 19394
  Gene Name: WD repeat and SOCS box containing 1
  ENSP ID: ENSP00000463621
MASFPPRVNEKEIVRLRTIGELLAPAAPFDKKCGRENWTVAFAPDGSYFAWSQGHRTVKLVPWSQCLQNLKTPP

SEQ ID NO: 97205 - protein, 247 aa, Homo sapiens
  Payload ID: 19394
  Gene Name: WD repeat and SOCS box containing 1
  ENSP ID: ENSP00000464109
MASFPPRVNEKEIVRLRTIGELLAPAAPFDKKCGRENWTVAFAPDGSYFAWSQGHRTVKLVPWSQCLQNFLLHGTKNVTNSSSLRLPRQNSDGGQKNKPREHIIDCGDIVWSLAFGSSVPEKQSRCVNIEWHRFRFGQDQLLLATGLNNGRIKIWDVYTGKLLLNLVDHTEVVRDLTFAPDGSLILVSASRDKTLRVWDLKDDGNMMKVLRGHQNWVYSCAFSPDSSMLCSVGASKAVRVKVLVHSL

SEQ ID NO: 97206 - protein, 404 aa, Homo sapiens
  Payload ID: 19395
  Gene Name: WD repeat and SOCS box containing 2
  Uniprot ID: Q9NYS7
  ENSP ID: ENSP00000319474
MEAGEEPLLLAELKPGRPHQFDWKSSCETWSVAFSPDGSWFAWSQGHCIVKLIPWPLEEQFIPKGFEAKSRSSKNETKGRGSPKEKTLDCGQIVWGLAFSPWPSPPSRKLWARHHPQVPDVSCLVLATGLNDGQIKIWEVQTGLLLLNLSGHQDVVRDLSFTPSGSLILVSASRDKTLRIWDLNKHGKQIQVLSGHLQWVYCCSISPDCSMLCSAAGEKSVFLWSMRSYTLIRKLEGHQSSVVSCDFSPDSALLVTASYDTNVIMWDPYTGERLRSLHHTQVDPAMDDSDVHISSLRSVCFSPEGLYLATVADDRLLRIWALELKTPIAFAPMTNGLCCTFFPHGGVIATGTRDGHVQFWTAPRVLSSLKHLCRKALRSFLTTYQVLALPIPKKMKEFLTYRTF

SEQ ID NO: 97207 - protein, 421 aa, Homo sapiens
  Payload ID: 19395
  Gene Name: WD repeat and SOCS box containing 2
  Uniprot ID: Q9NYS7
  ENSP ID: ENSP00000409131
MRVDRESRFLRGTGTGEAVAVEEPLLLAELKPGRPHQFDWKSSCETWSVAFSPDGSWFAWSQGHCIVKLIPWPLEEQFIPKGFEAKSRSSKNETKGRGSPKEKTLDCGQIVWGLAFSPWPSPPSRKLWARHHPQVPDVSCLVLATGLNDGQIKIWEVQTGLLLLNLSGHQDVVRDLSFTPSGSLILVSASRDKTLRIWDLNKHGKQIQVLSGHLQWVYCCSISPDCSMLCSAAGEKSVFLWSMRSYTLIRKLEGHQSSVVSCDFSPDSALLVTASYDTNVIMWDPYTGERLRSLHHTQVDPAMDDSDVHISSLRSVCFSPEGLYLATVADDRLLRIWALELKTPIAFAPMTNGLCCTFFPHGGVIATGTRDGHVQFWTAPRVLSSLKHLCRKALRSFLTTYQVLALPIPKKMKEFLTYRTF

SEQ ID NO: 97208 - protein, 61 aa, Homo sapiens
  Payload ID: 19395
  Gene Name: WD repeat and SOCS box containing 2
  ENSP ID: ENSP00000438433
MEAGEEPLLLAELKPGRPHQFDWKSSCETWSVAFSPDGSWFAWSQGHCIVKLIPWPLEEQL

SEQ ID NO: 97209 - protein, 406 aa, Homo sapiens
  Payload ID: 19395
  Gene Name: WD repeat and SOCS box containing 2
  ENSP ID: ENSP00000439450
MLSPAPEEPLLLAELKPGRPHQFDWKSSCETWSVAFSPDGSWFAWSQGHCIVKLIPWPLEEQFIPKGFEAKSRSSKNETKGRGSPKEKTLDCGQIVWGLAFSPWPSPPSRKLWARHHPQVPDVSCLVLATGLNDGQIKIWEVQTGLLLLNLSGHQDVVRDLSFTPSGSLILVSASRDKTLRIWDLNKHGKQIQVLSGHLQWVYCCSISPDCSMLCSAAGEKSVFLWSMRSYTLIRKLEGHQSSVVSCDFSPDSALLVTASYDTNVIMWDPYTGERLRSLHHTQVDPAMDDSDVHISSLRSVCFSPEGLYLATVADDRLLRIWALELKTPIAFAPMTNGLCCTFFPHGGVIATGTRDGHVQFWTAPRVLSSLKHLCRKALRSFLTTYQVLALPIPKKMKEFLTYRTF

SEQ ID NO: 97210 - protein, 245 aa, Homo sapiens
  Payload ID: 19395
  Gene Name: WD repeat and SOCS box containing 2
  ENSP ID: ENSP00000440386
MLSPAPEEPLLLAELKPGRPHQFDWKSSCETWSVAFSPDGSWFAWSQGHCIVKLIPWPLEEQFIPKGFEAKSRSSKNETKGRGSPKEKTLDCGQIVWGLAFSPWPSPPSRKLWARHHPQVPDVSCLVLATGLNDGQIKIWEVQTGLLLLNLSGHQDVVRDLSFTPSGSLILVSASRDKTLRIWDLNKHGKQIQVLSGHLQWVYCCSISPDCSMLCSAAGEKSVFLWSMRSYTLIRKLEGHQSSVV

SEQ ID NO: 97211 - protein, 194 aa, Homo sapiens
  Payload ID: 19395
  Gene Name: WD repeat and SOCS box containing 2
  Uniprot ID: Q9NYS7
  ENSP ID: ENSP00000444431
MLCSAAGEKSVFLWSMRSYTLIRKLEGHQSSVVSCDFSPDSALLVTASYDTNVIMWDPYTGERLRSLHHTQVDPAMDDSDVHISSLRSVCFSPEGLYLATVADDRLLRIWALELKTPIAFAPMTNGLCCTFFPHGGVIATGTRDGHVQFWTAPRVLSSLKHLCRKALRSFLTTYQVLALPIPKKMKEFLTYRTF

SEQ ID NO: 97212 - protein, 56 aa, Homo sapiens
  Payload ID: 19395
  Gene Name: WD repeat and SOCS box containing 2
  ENSP ID: ENSP00000445547
MLCSAAGEKSVFLWSMRSYTLIRKLEGHQSSVVSCDFSPDSALLVTASYDTNPHPG

SEQ ID NO: 97213 - protein, 746 aa, Homo sapiens
  Payload ID: 19396
  Gene Name: WD repeat containing planar cell polarity effector
  Uniprot ID: O95876
  ENSP ID: ENSP00000272321
MRREFCWDAYSKAAGSRASSPLPRQDRDSFCHQMSFCLTELHLWSLKNTLHIADRDIGIYQYYDKKDPPATEHGNLEKKQKLAESRDYPWTLKNRRPEKLRDSLKELEELMQNSRCVLSKWKNKYVCQLLFGSGVLVSLSLSGPQLEKVVIDRSLVGKLISDTISDALLTDSFIILSFLAQNKLCFIQFTKKMESSDVNKRLEKLSALDYKIFYYEIPGPINKTTERHLAINCVHDRVVCWWPLVNDDAWPWAPISSEKDRANLLLLGYAQGRLEVLSSVRTEWDPLDVRFGTKQPYQVFTVEHSVSVDKEPMADSCIYECIRNKIQCVSVTRIPLKSKAISCCRNVTEDKLILGCEDSSLILYETHRRVTLLAQTELLPSLISCHPSGAILLVGSNQGELQIFDMALSPINIQLLAEDRLPRETLQFSKLFDASSSLVQMQWIAPQVVSQKGEGSDIYDLLFLRFERGPLGVLLFKLGVFTRGQLGLIDIIFQYIHCDEIYEAINILSSMNWDTLGHQCFISMSAIVNHLLRQKLTPEREAQLETSLGTFYAPTRPLLDSTILEYRDQISKYARRFFHHLLRYQRFEKAFLLAVDVGARDLFMDIHYLALDKGELALAEVARKRASDIDAESITSGVELLGPLDRGDMLNEAFIGLSLAPQGEDSFPDNLPPSCPTHRHILQQRILNGSSNRQIIDRRNELEKDICSGFLMTNTCNAEDGELREDGREQEIRDGGSLKMIHFGLV

SEQ ID NO: 97214 - protein, 587 aa, Homo sapiens
  Payload ID: 19396
  Gene Name: WD repeat containing planar cell polarity effector
  Uniprot ID: O95876
  ENSP ID: ENSP00000381552
MFSSLHSALLTDSFIILSFLAQNKLCFIQFTKKMESSDVNKRLEKLSALDYKIFYYEIPGPINKTTERHLAINCVHDRVVCWWPLVNDDAWPWAPISSEKDRANLLLLGYAQGRLEVLSSVRTEWDPLDVRFGTKQPYQVFTVEHSVSVDKEPMADSCIYECIRNKIQCVSVTRIPLKSKAISCCRNVTEDKLILGCEDSSLILYETHRRVTLLAQTELLPSLISCHPSGAILLVGSNQGELQIFDMALSPINIQLLAEDRLPRETLQFSKLFDASSSLVQMQWIAPQVVSQKGEGSDIYDLLFLRFERGPLGVLLFKLGVFTRGQLGLIDIIFQYIHCDEIYEAINILSSMNWDTLGHQCFISMSAIVNHLLRQKLTPEREAQLETSLGTFYAPTRPLLDSTILEYRDQISKYARRFFHHLLRYQRFEKAFLLAVDVGARDLFMDIHYLALDKGELALAEVARKRASDIDAESITSGVELLGPLDRGDMLNEAFIGLSLAPQGEDSFPDNLPPSCPTHRHILQQRILNGSSNRQIIDRRNELEKDICSGFLMTNTCNAEDGELREDGREQEIRDGGSLKMIHFGLV

SEQ ID NO: 97215 - protein, 554 aa, Homo sapiens
  Payload ID: 19396
  Gene Name: WD repeat containing planar cell polarity effector
  ENSP ID: ENSP00000386592
MESSDVNKRLEKLSALDYKIFYYEIPGPINKTTERHLAINCVHDRVVCWWPLVNDDAWPWAPISSEKDRANLLLLGYAQGRLEVLSSVRTEWDPLDVRFGTKQPYQVFTVEHSVSVDKEPMADSCIYECIRNKIQCVSVTRIPLKSKAISCCRNVTEDKLILGCEDSSLILYETHRRVTLLAQTELLPSLISCHPSGAILLVGSNQGELQIFDMALSPINIQLLAEDRLPRETLQFSKLFDASSSLVQMQWIAPQVVSQKGEGSDIYDLLFLRFERGPLGVLLFKLGVFTRGQLGLIDIIFQYIHCDEIYEAINILSSMNWDTLGHQCFISMSAIVNHLLRQKLTPEREAQLETSLGTFYAPTRPLLDSTILEYRDQISKYARRFFHHLLRYQRFEKAFLLAVDVGARDLFMDIHYLALDKGELALAEVARKRASDIDAESITSGVELLGPLDRGDMLNEAFIGLSLAPQGEDSFPDNLPPSCPTHRHILQQRILNGSSNRQIIDRRNELEKDICSGFLMTNTCNAEDGELREDGREQEIRDGGSLKMIHFGLV

SEQ ID NO: 97216 - protein, 554 aa, Homo sapiens; identical to SEQ ID NO: 97215
  Payload ID: 19396
  Gene Name: WD repeat containing planar cell polarity effector
  ENSP ID: ENSP00000386769

SEQ ID NO: 97217 - protein, 402 aa, Homo sapiens
  Payload ID: 19396
  Gene Name: WD repeat containing planar cell polarity effector
  ENSP ID: ENSP00000386795
YYEIPGPINKTTERHLAINCVHDRVVCWWPLVNDDAWPWAPISSEKDRANLLLLGYAQGRLEVLSSVRTEWDPLDVRFGTKQPYQVFTVEHSVSVDKEPMADSCIYECIRNKIQCVSVTRIPLKSKAISCCRNVTEDKLILGCEDSSLILYETHRRVTLLAQTELLPSLISCHPSGAILLVGSNQGELQIFDMALSPINIQLLAEDRLPRETLQFSKLFDASSSLVQMQWIAPQVVSQKGEGSDIYDLLFLRFERGPLGVLLFKLGVFTRGQLGLIDIIFQYIHCDEIYEAINILSSMNWDTLGHQCFISMSAIVNHLLRQKLTPEREAQLETSLGTFYAPTRPLLDSTILEYRDQISKYARRFFHHLLRYQRFEKAFLLAVDVGARDLFMNSWDPWTEGIC

SEQ ID NO: 97218 - protein, 618 aa, Homo sapiens
  Payload ID: 19396
  Gene Name: WD repeat containing planar cell polarity effector
  Uniprot ID: O95876
  ENSP ID: ENSP00000387222
MRREFCWDAYSKAAGSRASSPLPRQDRDSFCHQMSFCLTELHLWSLKNTLHIADRDIGIYQYYDKKDPPATEHGNLEKKQKLAESRDYPWTLKNRRPEKLRDSLKELEELMQNSRCVLSKWKNKYVCQLLFGSGVLVSLSLSGPQLEKVVIDRSLVGKLISDTISDALLTDSFIILSFLAQNKLCFIQFTKKMESSDVNKRLEKLSALDYKIFYYEIPGPINKTTERHLAINCVHDRVVCWWPLVNDDAWPWAPISSEKDRANLLLLGYAQGRLEVLSSVRTEWDPLDVRFGTKQPYQVFTVEHSVSVDKEPMADSCIYECIRNKIQCVSVTRIPLKSKAISCCRNVTEDKLILGCEDSSLILYETHRRVTLLAQTELLPSLISCHPSGAILLVGSNQGELQIFDMALSPINIQLLAEDRLPRETLQFSKLFDASSSLVQMQWIAPQVVSQKGEGSDIYDLLFLRFERGPLGVLLFKLGVFTRGQLGLIDIIFQYIHCDEIYEAINILSSMNWDTLGHQCFISMSAIVNHLLRQKLTPEREAQLETSLGTFYAPTRPLLDSTILEYRDQISKYARRFFHHLLRYQRFEKAFLLAVDVGARDLFMASCYLTSNYTTRLQ

SEQ ID NO: 97219 - protein, 84 aa, Homo sapiens
  Payload ID: 19396
  Gene Name: WD repeat containing planar cell polarity effector
  ENSP ID: ENSP00000396226
MRREFCWDAYSKAAGSRASSPLPRQDRDSFCHQMSFCLTELHLWSLKNTLHIADRDIGIYQYYDKKDPPARDYPWTLKNRRPEK

SEQ ID NO: 97220 - protein, 132 aa, Homo sapiens
  Payload ID: 19396
  Gene Name: WD repeat containing planar cell polarity effector
  ENSP ID: ENSP00000409982
  MOD_RES (1)..(1): Any amino acid
XREFCWDAYSKAAGSRASSPLPRQDRDSFCHQMSFCLTELHLWSLKNTLHIADRDIGIYQYYDKKDPPATEHGNLEKKQKLAESRDYPWTLKNRRPEKLRDSLKELEELMQNSRCVLSKWKNKYVCQVCWCL

SEQ ID NO: 97221 - protein, 46 aa, Homo sapiens
  Payload ID: 19396
  Gene Name: WD repeat containing planar cell polarity effector
  ENSP ID: ENSP00000411429
MRREFCWDAYSKAAGSRASSPLPRQKTMINSGQNTENPQLSEGTGE

SEQ ID NO: 97222 - protein, 8 aa, Homo sapiens
  Payload ID: 19396
  Gene Name: WD repeat containing planar cell polarity effector
  ENSP ID: ENSP00000430288
MESSDVNK

SEQ ID NO: 97223 - protein, 548 aa, Homo sapiens
  Payload ID: 19397
  Gene Name: WD repeat containing, antisense to TP53
  Uniprot ID: Q9BUR4
  ENSP ID: ENSP00000324203
MKTLETQPLAPDCCPSDQDPAPAHPSPHASPMNKNADSELMPPPPERGDPPRLSPDPVAGSAVSQELREGDPVSLSTPLETEFGSPSELSPRIEEQELSENTSLPAEEANGSLSEEEANGPELGSGKAMEDTSGEPAAEDEGDTAWNYSFSQLPRFLSGSWSEFSTQPENFLKGCKWAPDGSCILTNSADNILRIYNLPPELYHEGEQVEYAEMVPVLRMVEGDTIYDYCWYSLMSSAQPDTSYVASSSRENPIHIWDAFTGELRASFRAYNHLDELTAAHSLCFSPDGSQLFCGFNRTVRVFSTARPGRDCEVRATFAKKQGQSGIISCIAFSPAQPLYACGSYGRSLGLYAWDDGSPLALLGGHQGGITHLCFHPDGNRFFSGARKDAELLCWDLRQSGYPLWSLGREVTTNQRIYFDLDPTGQFLVSGSTSGAVSVWDTDGPGNDGKPEPVLSFLPQKDCTNGVSLHPSLPLLATASGQRVFPEPTESGDEGEELGLPLLSTRHVHLECRLQLWWCGGAPDSSIPDDHQGEKGQGGTEGGVGELI

SEQ ID NO: 97224 - protein, 548 aa, Homo sapiens; identical to SEQ ID NO: 97223
  Payload ID: 19397
  Gene Name: WD repeat containing, antisense to TP53
  Uniprot ID: Q9BUR4
  ENSP ID: ENSP00000379727

SEQ ID NO: 97225 - protein, 548 aa, Homo sapiens; identical to SEQ ID NO: 97223
  Payload ID: 19397
  Gene Name: WD repeat containing, antisense to TP53
  Uniprot ID: Q9BUR4
  ENSP ID: ENSP00000397219

SEQ ID NO: 97226 - protein, 548 aa, Homo sapiens; identical to SEQ ID NO: 97223
  Payload ID: 19397
  Gene Name: WD repeat containing, antisense to TP53
  Uniprot ID: Q9BUR4
  ENSP ID: ENSP00000411061

SEQ ID NO: 97227 - protein, 287 aa, Homo sapiens
  Payload ID: 19397
  Gene Name: WD repeat containing, antisense to TP53
  ENSP ID: ENSP00000432991
MKTLETQPLAPDCCPSDQDPAPAHPSPHASPMNKNADSELMPPPPERGDPPRLSPDPVAGSAVSQELREGDPVSLSTPLETEFGSPSELSPRIEEQELSENTSLPAEEANGSLSEEEANGPELGSGKAMEDTSGEPAAEDEGDTAWNYSFSQLPRFLSGSWSEFSTQPENFLKGCKWAPDGSCILTNSADNILRIYNLPPELYHEGEQVEYAEMVPVLRMVEGDTIYDYCWYSLMSSAQPDTSYTGVSVSMSLSAWPAAAGRTRFISGTHSLESSGLPFAPTTTWMS

SEQ ID NO: 97228 - protein, 515 aa, Homo sapiens
  Payload ID: 19397
  Gene Name: WD repeat containing, antisense to TP53
  ENSP ID: ENSP00000434999
MKTLETQPLAPDCCPSDQDPAPAHPSPHASPMNKNADSELMPPPPERGDPPRLSPDPVAGSAVSQELREGDPVSLSTPLETEFGSPSELSPRIEEQELSENTSLPAEEANGSLSEEEANGPELGSGKAMEDTSGEPAAEDEGDTAPDGSCILTNSADNILRIYNLPPELYHEGEQVEYAEMVPVLRMVEGDTIYDYCWYSLMSSAQPDTSYVASSSRENPIHIWDAFTGELRASFRAYNHLDELTAAHSLCFSPDGSQLFCGFNRTVRVFSTARPGRDCEVRATFAKKQGQSGIISCIAFSPAQPLYACGSYGRSLGLYAWDDGSPLALLGGHQGGITHLCFHPDGNRFFSGARKDAELLCWDLRQSGYPLWSLGREVTTNQRIYFDLDPTGQFLVSGSTSGAVSVWDTDGPGNDGKPEPVLSFLPQKDCTNGVSLHPSLPLLATASGQRVFPEPTESGDEGEELGLPLLSTRHVHLECRLQLWWCGGAPDSSIPDDHQGEKGQGGTEGGVGELI

SEQ ID NO: 97229 - protein, 46 aa, Homo sapiens
  Payload ID: 19397
  Gene Name: WD repeat containing, antisense to TP53
  ENSP ID: ENSP00000465025
DELTAAHSLCFSPDGSQLFCGFNRTVRVFSTARPGRDCEVRATFGC

SEQ ID NO: 97230 - protein, 460 aa, Homo sapiens
  Payload ID: 19398
  Gene Name: WD repeat containing, antisense to TP73
  Uniprot ID: Q9P2S5
  ENSP ID: ENSP00000270708
MNFSEVFKLSSLLCKFSPDGKYLASCVQYRLVVRDVNTLQILQLYTCLDQIQHIEWSADSLFILCAMYKRGLVQVWSLEQPEWHCKIDEGSAGLVASCWSPDGRHILNTTEFHLRITVWSLCTKSVSYIKYPKACLQGITFTRDGRYMALAERRDCKDYVSIFVCSDWQLLRHFDTDTQDLTGIEWAPNGCVLAVWDTCLEYKILLYSLDGRLLSTYSAYEWSLGIKSVAWSPSSQFLAVGSYDGKVRILNHVTWKMITEFGHPAAINDPKIVVYKEAEKSPQLGLGCLSFPPPRAGAGPLPSSESKYEIASVPVSLQTLKPVTDRANPKIGIGMLAFSPDSYFLATRNDNIPNAVWVWDIQKLRLFAVLEQLSPVRAFQWDPQQPRLAICTGGSRLYLWSPAGCMSVQVPGEGDFAVLSLCWHLSGDSMALLSKDHFCLCFLETEAVVGTACRQLGGHT

SEQ ID NO: 97231 - protein, 435 aa, Homo sapiens
  Payload ID: 19398
  Gene Name: WD repeat containing, antisense to TP73
  ENSP ID: ENSP00000367573
MNFSEVFKLSSLLCKFSPDGKYLASCVQYRLVVRDVNTLQILQLYTCLDQIQHIEWSADSLFILCAMYKRGLVQVWSLEQPEWHCKIDEGSAGLVASCWSPDGRHILNTTEFHLRITVWSLCTKSVSYIKYPKACLQGITFTRDGRYMALAERRDCKDYVSIFVCSDWQLLRHFDTDTQDLTGIEWAPNGCVLAVWDTCLEYKILLYSLDGRLLSTYSAYEWSLGIKSVAWSPSSQFLAVGSYDGKVRILNHVTWKMITEFGHPAAINDPKIVVYKEAEKSPQLGLGCLSFPPPRAGAGPLPSSESKYEIASVPVSLQTLKPVTDRANPKIGIGMLAFSPDSYFLATRNDNIPNAVWVWDIQKLRLFAVLEQLSPVRAFQWDPQQPRLAICTGGSRLYLWSPAGCMSVQVPGEGKHIPEATDVAALLCAVWHHTG

SEQ ID NO: 97232 - protein, 179 aa, Homo sapiens
  Payload ID: 19398
  Gene Name: WD repeat containing, antisense to TP73
  ENSP ID: ENSP00000389738
MNFSEVFKLSSLLCKFSPDGKYLASCVQYRLVVRDVNTLQILQLYTCLDQIQHIEWSADSLFILCAMYKRGLVQVWSLEQPEWHCKIDEGSAGLVASCWSPDGRHILNTTEFHLRITVWSLCTKSVSYIKYPKACLQGITFTRDGRYMALAERRDCKDYVSIFVCSDWQLLRYKILLYS

SEQ ID NO: 97233 - protein, 304 aa, Homo sapiens
  Payload ID: 19398
  Gene Name: WD repeat containing, antisense to TP73
  ENSP ID: ENSP00000416192
MNFSEVFKLSSLLCKFSPDGKYLASCVQYRLVVRDVNTLQILQLYTCLDQIQHIEWSADSLFILCAMYKRGLVQVWSLEQPEWHCKIDEGSAGLVASCWSPDGRHILNTTEFHLRITVWSLCTKSVSYIKYPKACLQGITFTRDGRYMALAERRDCKDYVSIFVCSDWQLLRHFDTDTQDLTGIEWAPNGCVLAVWDTCLEVRILNHVTWKMITEFGHPAAINDPKIVVYKEAEKSPQLGLGCLSFPPPRAGAGPLPSSESKYEIASVPVSLQTLKPVTDRANPKIGIGMLAFSPDSYFLATRN

SEQ ID NO: 97234 - protein, 200 aa, Homo sapiens
  Payload ID: 19398
  Gene Name: WD repeat containing, antisense to TP73
  ENSP ID: ENSP00000463084
MYKRGLVQVWSLEQPEWHCKIDEGSAGLVASCWSPDGRHILNTTEFHLRITVWSLCTKSVSYIKYPKACLQGITFTRDGRYMALAERRDCKDYVSIFVCSDWQLLRHFDTDTQDLTGIEWAPNGCVLAVWDTCLEYKILLYSLDGRLLSTYSAYEWSLGIKSVAWSPSSQFLAVGSYDGKVRILNHVTWKMITEFGHPAA

SEQ ID NO: 97235 - protein, 466 aa, Homo sapiens
  Payload ID: 19399
  Gene Name: WD repeat domain 1
  Uniprot ID: O75083
  ENSP ID: ENSP00000371889
MPYEIKKVFASLPQVERGVSKIIGGDPKGNNFLYTNGKCVILRNIDDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 97236 - protein, 606 aa, Homo sapiens
  Payload ID: 19399
  Gene Name: WD repeat domain 1
  Uniprot ID: O75083
  ENSP ID: ENSP00000371890
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTIGDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 97237 - protein, 245 aa, Homo sapiens
  Payload ID: 19399
  Gene Name: WD repeat domain 1
  ENSP ID: ENSP00000425481
MPRRICVSAEKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTIGDHSRFVNCVRFSPDGNRFATASADGQIYIYDGKTGEKVCALGGSKAHDGGIYAVS

SEQ ID NO: 97238 - protein, 466 aa, Homo sapiens; identical to SEQ ID NO: 97235
  Payload ID: 19399
  Gene Name: WD repeat domain 1
  Uniprot ID: O75083
  ENSP ID: ENSP00000426725

SEQ ID NO: 97239 - protein, 606 aa, Homo sapiens; identical to SEQ ID NO: 97236
  Payload ID: 19399
  Gene Name: WD repeat domain 1
  Uniprot ID: O75083
  ENSP ID: ENSP00000427687

SEQ ID NO: 97240 - protein, 1224 aa, Homo sapiens
  Payload ID: 19400
  Gene Name: WD repeat domain 11
  Uniprot ID: Q9BZH6
  ENSP ID: ENSP00000263461
MLPYTVNFKVSARTLTGALNAHNKAAVDWGWQGLIAYGCHSLVVVIDSITAQTLQVLEKHKADVVKVKWARENYHHNIGSPYCLRLASADVNGKIIVWDVAAGVAQCEIQEHAKPIQDVQWLWNQDASRDLLLAIHPPNYIVLWNADTGTKLWKKSYADNILSFSFDPFDPSHLTLLTSEGIVFISDFSPSKPPSGPGKKVYISSPHSSPAHNKLATATGAKKALNKVKILITQEKPSAEFITLNDCLQLAYLPSKRNHMLLLYPREILILDLEVNQTVGVIAIERTGVPFLQVIPCFQRDGLFCLHENGCITLRVRRSYNNIFTTSNEEPDPDPVQELTYDLRSQCDAIRVTKTVRPFSMVCCPVNENAAALVVSDGRVMIWELKSAVCNRNSRNSSSGVSPLYSPVSFCGIPVGVLQNKLPDLSLDNMIGQSAIAGEEHPRGSILREVHLKFLLTGLLSGLPAPQFAIRMCPPLTTKNIKMYQPLLAVGTSNGSVLVYHLTSGLLHKELSIHSCEVKGIEWTSLTSFLSFATSTPNNMGLVRNELQLVDLPTGRSIAFRGERGNDESAIEMIKVSHLKQYLAVVFRDKPLELWDVRTCTLLREMSKNFPTITALEWSPSHNLKSLRKKQLATREAMARQTVVSDTELSIVESSVISLLQEAESKSELSQNISAREHFVFTDIDGQVYHLTVEGNSVKDSARIPPDGSMGSITCIAWKGDTLVLGDMDGNLNFWDLKGRVSRGIPTHRSWVRKIRFAPGKGNQKLIAMYNDGAEVWDTKEVQMVSSLRSGRNVTFRILDVDWCTSDKVILASDDGCIRVLEMSMKSACFRMDEQELTEPVWCPYLLVPRASLALKAFLLHQPWNGQYSLDISHVDYPENEEIKNLLQEQLNSLSNDIKKLLLDPEFTLLQRCLLVSRLYGDESELHFWTVAAHYLHSLSQEKSASTTAPKEAAPRDKLSNPLDICYDVLCENAYFQKFQLERVNLQEVKRSTYDHTRKCTDQLLLLGQTDRAVQLLLETSADNQHYYCDSLKACLVTTVTSSGPSQSTIKLVATNMIANGKLAEGVQLLCLIDKAADACRYLQTYGEWNRAAWLAKVRLNPEECADVLRRWVDHLCSPQVNQKSKALLVLLSLGCFFSVAETLHSMRYFDRAALFVEACLKYGAFEVTEDTEKLITAIYADYARSLKNLGFKQGAVLFASKAGAAGKDLLNELESPKEEPIEE

SEQ ID NO: 97241 - protein, 199 aa, Homo sapiens
  Payload ID: 19400
  Gene Name: WD repeat domain 11
  ENSP ID: ENSP00000474595
MLLLYPREILILDLEVNQTVGVIAIERTGVPFLQVIPCFQRDGLFCLHENGCITLRVRRSYNNIFTTSNEEPDPDPVQELTYDLRSQCDAIRVTKTVRPFSMVCCPVNENAAALVVSDGRVMIWELKSAVCNRNSRNRAKCNCWGRTSQRFNSAGSAPQVPADGTAFRTARTTVCYSYVSTVDHKKHQDVSATAGCWYK

SEQ ID NO: 97242 - protein, 312 aa, Homo sapiens
  Payload ID: 19400
  Gene Name: WD repeat domain 11
  ENSP ID: ENSP00000474880
MLLLYPREILILDLEVNQTVGVIAIERTGVPFLQVIPCFQRDGLFCLHENGCITLRVRRSYNNIFTTSNEEPDPDPVQELTYDLRSQCDAIRVTKTVRPFSMVCCPVNENAAALVVSDGRVMIWELKSAVCNRNSRNSSSGVSPLYSPVSFCGIPVGVLQNKLPDLSLDNMIGQSAIAGEEHPRGSILREVHLKFLLTGLLSGLPAPQFAIRMCPPLTTKNIKMYQPLLAVGTSNGSVLVYHLTSGLLHKELSIHSCEVKGIEWTSLTSFLSFATSTPNNMGLVRNELQLVDLPTGRSIAFRGERGNDESAI

SEQ ID NO: 97243 - protein, 95 aa, Homo sapiens
  Payload ID: 19400
  Gene Name: WD repeat domain 11
  ENSP ID: ENSP00000475076
MLPYTVNFKVSARTLTGALNAHNKAAVDWGWQGLIAYGCHSLVVVIDSITAQTLQVPADGTAFRTARTTVCYSYVSTVDHKKHQDVSATAGCWYK

SEQ ID NO: 97244 - protein, 423 aa, Homo sapiens [sequence omitted]

SEQ ID NO: 97245 - protein, 485 aa, Homo sapiens
  Payload ID: 19402
  Gene Name: WD repeat domain 13
  Uniprot ID: Q9H1Z4
  ENSP ID: ENSP00000218056
MAAVWQQVLAVDARYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRPPGSVVPTSAAEASRAMAGDTSLSENYAFAGMYHVFDQHVDEAVPRVRFANDDRHRLACCSLDGSISLCQLVPAPPTVLRVLRGHTRGVSDFAWSLSNDILVSTSLDATMRIWASEDGRCIREIPDPDSAELLCCTFQPVNNNLTVVGNAKHNVHVMNISTGKKVKGGSSKLTGRVLALSFDAPGRLLWAGDDRGSVFSFLFDMATGKLTKAKRLVVHEGSPVTSISARSWVSREARDPSLLINACLNKLLLYRVVDNEGTLQLKRSFPIEQSSHPVRSIFCPLMSFRQGACVVTGSEDMCVHFFDVERAAKAAVNKLQGHSAPVLDVSFNCDESLLASSDASGMVIVWRREQK

SEQ ID NO: 97246 - protein, 485 aa, Homo sapiens; identical to SEQ ID NO: 97245
  Payload ID: 19402
  Gene Name: WD repeat domain 13
  Uniprot ID: Q9H1Z4
  ENSP ID: ENSP00000365919

SEQ ID NO: 97247 - protein, 107 aa, Homo sapiens
  Payload ID: 19402
  Gene Name: WD repeat domain 13
  ENSP ID: ENSP00000480532
MKLAPQQQGVLPPGVWSSRPFHFGVARHKGHEPESVDVLAFVVHAAAGGHARGGGRGMAAVWQQVLAVDARYNAYRTPTFPQFRTQYIRRRSQLLRENAKAGHPPAL

SEQ ID NO: 97248 - protein, 43 aa, Homo sapiens
  Payload ID: 19402
  Gene Name: WD repeat domain 13
  ENSP ID: ENSP00000482667
MAAVWQQVLAVDASFGRSISAGAASCCGRMPRLGTPQRCVGST

SEQ ID NO: 97249 - protein, 187 aa, Homo sapiens
  Payload ID: 19402
  Gene Name: WD repeat domain 13
  ENSP ID: ENSP00000483191
LLCCTFQPVNNNLTVVRLQDTHSPRVGNAKHNVHVMNISTGKKVKGGSSKLTGRVLALSFDAPGRLLWAGDDRGSVFSFLFDMATGKLTKAKRLVVHEGSPVTSISARSWVSREARDPSLLINACLNKLLLYRVVDNEGTLQLKRSFPIEQSSHPVRSIFCPLMSFRQGACVVTGSEDMCVHFFDVE

SEQ ID NO: 97250 - protein, 43 aa, Homo sapiens; identical to SEQ ID NO: 97248
  Payload ID: 19402
  Gene Name: WD repeat domain 13
  ENSP ID: ENSP00000484996

SEQ ID NO: 97251 - protein, 1322 aa, Homo sapiens
  Payload ID: 19403
  Gene Name: WD repeat domain 17
  Uniprot ID: Q8IZU2
  ENSP ID: ENSP00000280190
MAWMTYISNWFEQDDWYEGLQRANMSQVRQVGLLAAGCQPWNKDVCAASGDRFAYCATLAIYIYQLDHRYNEFKLHAIMSEHKKTITAISWCPHNPDLFASGSTDNLVIIWNVAEQKVIAKLDSTKGIPASLSWCWNAEDVVAFVSHRGPLFIWTISGPDSGVIVHKDAHSFLSDICMFRWHTHQKGKVVFGHIDGSLSIFHPGNKNQKHVLRPESLEGTDEEDPVTALEWDPLSTDYLLVVNLHYGIRLVDSESLSCITTFNLPSAAASVQCLAWVPSAPGMFITGDSQVGVLRIWNVSRTTPIDNLKLKKTGFHCLHVLNSPPRKKFSVQSPTKNHYTSSTSEAVPPPTLTQNQAFSLPPGHAVCCFLDGGVGLYDMGAKKWDFLRDLGHVETIFDCKFKPDDPNLLATASFDGTIKVWDINTLTAVYTSPGNEGVIYSLSWAPGGLNCIAGGTSRNGAFIWNVQKGKIIQRFNEHGTNGIFCIAWSHKDSKRIATCSSDGFCIIRTIDGKVLHKYKHPAAVFGCDWSQNNKDMIATGCEDTNVRVYYVATSSDQPLKVFSGHTAKVFHVKWSPLREGILCSGSDDGTVRIWDYTQDACINILNGHTAPVRGLMWNTEIPYLLISGSWDYTIKVWDTREGTCVDTVYDHGADVYGLTCHPSRPFTMASCSRDSTVRLWSLTALVTPVQINILADRSWEEIIGNTDYAIEPGTPPLLCGKVSRDIRQEIEKLTANSQVKKLRWFSECLSPPGGSDNLWNLVAVIKGQDDSLLPQNYCKGIMHLKHLIKFRTSEAQELTTVKMSKFGGGIGVPAKEERLKEAAEIHLRLGQIQRYCELMVELGEWDKALSIAPGVSVKYWKKLMQRRADQLIQEDKDDVIPYCIAIGDVKKLVHFFMSRGQLKEALLVAQAACEGNMQPLHVSVPKGASYSDDIYKEDFNELLHKVSKELAEWYFQDGRAVLAACCHLAIDNIELAMAYLIRGNELELAVCVGTVLGESAAPATHYALELLARKCMMISVCFPCVGYSVPFCYVNRNLAADLLLMIPDNELHLIKLCAFYPGCTEEINDLHDKCKLPTVEECMQLAETARADDNIFETVKYYLLSQEPEKALPIGISFVKEYISSSDWTLDTIYPVLDLLSYIRTEKLLLHTCTEARNELLILCGYIGALLAIRRQYQSIVPALYEYTSQLLKRREVSVPLKIEYLSEELDAWRACTQSTNRSLEDSPYTPPSDSQRMIYATLLKRLKEESLKGIIGPDYVTGSNLPSHSDIHISCLTGLKIQGPVFFLEDGKSAISLNDALMWAKVNPFSPLGTGIRLNPF

SEQ ID NO: 97252 - protein, 1297 aa, Homo sapiens
  Payload ID: 19403
  Gene Name: WD repeat domain 17
  ENSP ID: ENSP00000422200
MAWMTYISNWFEQDDWYEGLQRANMSQVRQVGLLAAGCQPWNKDVCAASGDRFAYCATLAIYIYQLDHRYNEFKLHAIMSEHKKTITAISWCPHNPDLFASGSTDNLVIIWNVAEQKVIAKLDSTKGIPASLSWCWNAEDVVAFVSHRGPLFIWTISGPDSGVIVHKDAHSFLSDICMFRWHTHQKGKVVFGHIDGSLSIFHPDEEDPVTALEWDPLSTDYLLVVNLHYGIRLVDSESLSCITTFNLPSAAASVQCLAWVPSAPGMFITGDSQVGVLRIWNVSRTTPIDNLKLKKTGFHCLHVLNSPPRKKFSVQSPTKNHYTSSTSEAVPPPTLTQNQAFSLPPGHAVCCFLDGGVGLYDMGAKKWDFLRDLGHVETIFDCKFKPDDPNLLATASFDGTIKVWDINTLTAVYTSPGNEGVIYSLSWAPGGLNCIAGGTSRNGAFIWNVQKGKIIQRFNEHGTNGIFCIAWSHKDSKRIATCSSDGFCIIRTIDGKVLHKYKHPAAVFGCDWSQNNKDMIATGCEDTNVRVYYVATSSDQPLKVFSGHTAKVFHVKWSPLREGILCSGSDDGTVRIWDYTQDACINILNGHTAPVRGLMWNTEIPYLLISGSWDYTIKVWDTREGTCVDTVYDHGADVYGLTCHPSRPFTMASCSRDSTVRLWSLTALVTPVQINILADRSWEEIIGNTDYAIEPGTPPLLCGKVSRDIRQEIEKLTANSQVKKLRWFSECLSPPGGSDNLWNLVAVIKGQDDSLLPQNYCKGIMHLKHLIKFRTSEAQELTTVKMSKFGGGIGVPAKEERLKEAAEIHLRLGQIQRYCELMVELGEWDKALSIAPGVSVKYWKKLMQRRADQLIQEDKDDVIPYCIAIGDVKKLVHFFMSRGQLKEALLVAQAACEGNMQPLHVSVPKGASYSDDIYKEDFNELLHKVSKELAEWYFQDGRAVLAACCHLAIDNIELAMAYLIRGNELELAVCVGTVLGESAAPATHYALELLARKCMMISVCFPCVGYRNLAADLLLMIPDNELHLIKLCAFYPGCTEEINDLHDKCKLPTVEECMQLAETARADDNIFETVKYYLLSQEPEKALPIGISFVKEYISSSDWTLDTIYPVLDLLSYIRTEKLLLHTCTEARNELLILCGYIGALLAIRRQYQSIVPALYEYTSQLLKRREVSVPLKIEYLSEELDAWRACTQSTNRSLEDSPYTPPSDSQRMIYATLLKRLKEESLKGIIGPDYVTGSNLPSHSDIHISCLTGLKIQGPVFFLEDGKSAISLNDALMWAKVNPFSPLGTGIRLNPF

SEQ ID NO: 97253 - protein, 1283 aa, Homo sapiens
  Payload ID: 19403
  Gene Name: WD repeat domain 17
  Uniprot ID: Q8IZU2
  ENSP ID: ENSP00000422763
MSQVRQVGLLAAGCQPWNKDVCAASGDRFAYCATLAIYIYQLDHRYNEFKLHAIMSEHKKTITAISWCPHNPDLFASGSTDNLVIIWNVAEQKVIAKLDSTKGIPASLSWCWNAEDVVAFVSHRGPLFIWTISGPDSGVIVHKDAHSFLSDICMFRWHTHQKGKVVFGHIDGSLSIFHPGNKNQKHVLRPESLEGTDEEDPVTALEWDPLSTDYLLVVNLHYGIRLVDSESLSCITTFNLPSAAASVQCLAWVPSAPGMFITGDSQVGVLRIWNVSRTTPIDNLKLKKTGFHCLHVLNSPPRKKFSVQSPTKNHYTSSTSEAVPPPTLTQNQAFSLPPGHAVCCFLDGGVGLYDMGAKKWDFLRDLGHVETIFDCKFKPDDPNLLATASFDGTIKVWDINTLTAVYTSPGNEGVIYSLSWAPGGLNCIAGGTSRNGAFIWNVQKGKIIQRFNEHGTNGIFCIAWSHKDSKRIATCSSDGFCIIRTIDGKVLHKYKHPAAVFGCDWSQNNKDMIATGCEDTNVRVYYVATSSDQPLKVFSGHTAKVFHVKWSPLREGILCSGSDDGTVRIWDYTQDACINILNGHTAPVRGLMWNTEIPYLLISGSWDYTIKVWDTREGTCVDTVYDHGADVYGLTCHPSRPFTMASCSRDSTVRLWSLTALVTPVQINILADRSWEEIIGNTDYAIEPGTPPLLCGKVSRDIRQEIEKLTANSQVKKLRWFSECLSPPGGSDNLWNLVAVIKGQDDSLLPQNYCKGIMHLKHLIKFRTSEAQELTTVKMSKFGGGIGVPAKEERLKEAAEIHLRLGQIQRYCELMVELGEWDKALSIAPGVSVKYWKKLMQRRADQLIQEDKDDVIPYCIAIGDVKKLVHFFMSRGQLKEALLVAQAACEGNMQPLHVSVPKGASYSDDIYKEDFNELLHKVSKELAEWYFQDGRAVLAACCHLAIDNIELAMAYLIRGNELELAVCVGTVLGESAAPATHYALELLARKCMMISVWNLAADLLLMIPDNELHLIKLCAFYPGCTEEINDLHDKCKLPTVEECMQLAETARADDNIFETVKYYLLSQEPEKALPIGISFVKEYISSSDWTLDTIYPVLDLLSYIRTEKLLLHTCTEARNELLILCGYIGALLAIRRQYQSIVPALYEYTSQLLKRREVSVPLKIEYLSEELDAWRACTQSTNRSLEDSPYTPPSDSQRMIYATLLKRLKEESLKGIIGPDYVTGSNLPSHSDIHISCLTGLKIQGPVFFLEDGKSAISLNDALMWAKVNPFSPLGTGIRLNPF

SEQ ID NO: 97254 - protein, 226 aa, Homo sapiens
  Payload ID: 19403
  Gene Name: WD repeat domain 17
  ENSP ID: ENSP00000426847
  MOD_RES (1)..(1): Any amino acid
XIPASLSWCWNAEDVVAFVSHRGPLFIWTISGPDSGVIVHKDAHSFLSDICMFRWHTHQKGKVVFGHIDGSLSIFHPVSVQSPTKNHYTSSTSEAVPPPTLTQNQAFSLPPGHAVCCFLDGGVGLYDMGAKKWDFLRDLGHVETIFDCKFKPDDPNLLATASFDGTIKVWDINTLTAVYTSPGNEGVIYSLSWAPGGLNCIAGGTSRNGAFIWNVQKGKIIQRFNE

SEQ ID NO: 97255 - protein, 557 aa, Homo sapiens
  Payload ID: 19403
  Gene Name: WD repeat domain 17
  ENSP ID: ENSP00000426985
  MOD_RES (1)..(1): Any amino acid
XWNLVAVIKGQDDSLLPQNYCKGIMHLKHLIKFRTSEAQELTTVKMSKFGGGIGVPAKEERLKEAAEIHLRLGQIQRYCELMVELGEWDKALSIAPGVSVKYWKKLMQRRADQLIQEDKDDVIPYCIAIGDVKKLVHFFMSRGQLKEALLVAQAACEGNMQPLHVSVPKGASYSDDIYKEDFNELLHKVSKELAEWYFQDGRAVLAACCHLAIDNIELAMAYLIRGNELELAVCVGTVLGESAAPATHYALELLARKCMMISVCFPCVGYRNLAADLLLMIPDNELHLIKLCAFYPGCTEEINDLHDKCKLPTVEECMQLAETARADDNIFETVKYYLLSQEPEKALPIGISFVKEYISSSDWTLDTIYPVLDLLSYIRTEKLLLHTCTEARNELLILCGYIGALLAIRRQYQSIVPALYEYTSQLLKRREVSVPLKIEYLSEELDAWRACTQSTNRSLEDSPYTPPSDSQRMIYATLLKRLKEESLKGIIGPDYVTGSNLPSHSDIHISCLTGLKIQGPVFFLEDGKSAISLNDALMWAKVNPFSPLGTGIRLNPF

SEQ ID NO: 97256 - protein, 101 aa, Homo sapiens
  Payload ID: 19403
  Gene Name: WD repeat domain 17
  ENSP ID: ENSP00000427502
MAWMTYISNWFEQDDWYEGLQRANMSQVRQVGLLAAGCQPWNKDVCAASGDRFAYCATLAIYIYQGSLLLLVGAGMQRMWWHLFPTEAHCSFGPSQDQIVE

SEQ ID NO: 97257 - protein, 429 aa, Homo sapiens
  Payload ID: 19404
  Gene Name: WD repeat domain 18
  ENSP ID: ENSP00000251289
  MOD_RES (1)..(1): Any amino acid
XAPMEVAVCTDSAAPMWSCIVWELHSGANLLTYRGGQAGPRGLALLNGEYLLAAQLGKNYISAWELQRKDQLQQKIMCPGPVTCLTASPNGLYVLAGVAESIHLWEVSTGNLLVILSRHYQDVSCLQFTGDSSHFISGGKDCLVLVWSLCSVLQADPSRIPAPRHVWSHHALPITDLHCGFGGPLARVATSSLDQTVKLWEVSSGELLLSVLFDVSIMAVTMDLAEHHMFCGGSEGSIFQVDLFTWPGQRERSFHPEQDAGKVFKGNQVTCLSVSTDGSVLLSGSHDETVRLWDVQSKQCIRTVALKGPVTNAAILLAPVSMLSSDFRPSLPLPHFNKHLLGAEHGDEPRHGGLTLRLGLHQQGSEPSYLDRTEQLQAVLCSTMEKSVLGGQDQLRVRVTELEDEVRNLRKINRDLFDFSTRFITRPAK

SEQ ID NO: 97258 - protein, 409 aa, Homo sapiens
  Payload ID: 19404
  Gene Name: WD repeat domain 18
  ENSP ID: ENSP00000464855
MAAPMEVAVCTDSAAPMWSCIVWELHSGANLLTYRGGQAGPRGLALLNGEYLLAAQLGKNYISAWELQRKDQLQQKIMCPGPVTCLTASPNGLYVLAGVAESIHLWEVSTGNLLVILSRHYQDVSCLQFTGDSSHFISGGKDCLVLVWSLCSVLQADPSRIPAPRHVWSHHALPITDLHCGFGGPLARVATSSLDQTVKLWEVSSGELLLSVLFDVSIMAVTMDLAEHHMFCGGSEGSIFQVDLFTWPGQRERSFHPEQDAGKVFKGHRNQVTCLSVSTDGSVLLSGSHDETVRLWDVQSKQCIRTVALKGPVTNAAILLAPVSMLSSDFRPSLPLPHFNKHLLGAEHGDEPRHGGLTLRLGLHQQSVLGGQDQLRVRVTELEDEVRNLRKINRDLFDFSTRFITRPAK

SEQ ID NO: 97259 - protein, 152 aa, Homo sapiens
  Payload ID: 19404
  Gene Name: WD repeat domain 18
  ENSP ID: ENSP00000465826
MAAPMEVAVCTDSAAPMWSCIVWELHSGANLLTYRGGQAGPRGLALLNGEYLLAAQLGKNYISAWELQRKDQLQQKIMCPGPVTCLTASPNGLYVLAGVAESIHLWEVSTGNLLVILSRHYQDVSCLQFTGDSSHFISGGKDCLVLVWSLCR

SEQ ID NO: 97260 - protein, 268 aa, Homo sapiens
  Payload ID: 19404
  Gene Name: WD repeat domain 18
  ENSP ID: ENSP00000466551
  MOD_RES (1)..(1): Any amino acid
XAPMEVAVCTDSAAPMWSCIVWELHSGANLLTYRGGQAGPRGLALLNGEYLLAAQLGKNYISAWELQRKDQLQQKIMCPGPVTCLTASPNGLYVLAGVAESIHLWEVSTGNLLVILSRHYQDVSCLQFTGDSSHFISGGKDCLVLVWSLCSVLQADPSRIPAPRHVWSHHALPITDLHCGFGGPLARVATSSLDQTVKLWEVSSGELLLSVLFDVSIMAVTMDLAEHHMFCGGSEGSIFQVDLFTWPGQRERSFHPEQDAGKVFKGHR

SEQ ID NO: 97261 - protein, 394 aa, Homo sapiens
  Payload ID: 19404
  Gene Name: WD repeat domain 18
  ENSP ID: ENSP00000475744
  MOD_RES (1)..(1): Any amino acid
XAPMEVAVCTDSAAPMWSCIVWELHSGANLLTYRGGQAGPRGLALLNGEYLLAAQLGKNYISAWELQRKVSTGNLLVILSRHYQDVSCLQFTGDSSHFISGGKDCLVLVWSLCSVLQADPSRIPAPRHVWSHHALPITDLHCGFGGPLARVATSSLDQTVKLWEVSSGELLLSVLFDVSIMAVTMDLAEHHMFCGGSEGSIFQVDLFTWPGQRERSFHPEQDAGKVFKGHRNQVTCLSVSTDGSVLLSGSHDETVRLWDVQSKQCIRTVALKGPVTNAAILLAPVSMLSSDFRPSLPLPHFNKHLLGAEHGDEPRHGGLTLRLGLHQQGSEPSYLDRTEQLQAVLCSTMEKSVLGGQDQLRVRVTELEDEVRNLRKINRDLFDFSTRFITRPAK

SEQ ID NO: 97262 - protein, 48 aa, Homo sapiens
  Payload ID: 19404
  Gene Name: WD repeat domain 18
  ENSP ID: ENSP00000475953
  MOD_RES (1)..(1): Any amino acid
XKGHRNQVTCLSVSTDGSVLLSGSHDETVRLWDVQSKQCIRTVALKAC

SEQ ID NO: 97263 - protein, 432 aa, Homo sapiens
  Payload ID: 19404
  Gene Name: WD repeat domain 18
  Uniprot ID: Q9BV38
  ENSP ID: ENSP00000476117
MAAPMEVAVCTDSAAPMWSCIVWELHSGANLLTYRGGQAGPRGLALLNGEYLLAAQLGKNYISAWELQRKDQLQQKIMCPGPVTCLTASPNGLYVLAGVAESIHLWEVSTGNLLVILSRHYQDVSCLQFTGDSSHFISGGKDCLVLVWSLCSVLQADPSRIPAPRHVWSHHALPITDLHCGFGGPLARVATSSLDQTVKLWEVSSGELLLSVLFDVSIMAVTMDLAEHHMFCGGSEGSIFQVDLFTWPGQRERSFHPEQDAGKVFKGHRNQVTCLSVSTDGSVLLSGSHDETVRLWDVQSKQCIRTVALKGPVTNAAILLAPVSMLSSDFRPSLPLPHFNKHLLGAEHGDEPRHGGLTLRLGLHQQGSEPSYLDRTEQLQAVLCSTMEKSVLGGQDQLRVRVTELEDEVRNLRKINRDLFDFSTRFITRPAK

SEQ ID NO: 97264 - protein, 144 aa, Homo sapiens
  Payload ID: 19404
  Gene Name: WD repeat domain 18
  ENSP ID: ENSP00000484670
VCTDSAAPMWSCIVWELHSGANLLTYRGGQAGPRGLALLNGEYLLAAQLGKNYISAWELQRKDQLQQKIMCPGPVTCLTASPNGLYVLAGVAESIHLWEVSTGNLLVILSRHYQDVSCLQFTGDSSHFISGGKDCLVLVWSLCR

SEQ ID NO: 97265 - protein, 1342 aa, Homo sapiens
  Payload ID: 19405
  Gene Name: WD repeat domain 19
  Uniprot ID: Q8NEZ3
  ENSP ID: ENSP00000382717
MKRIFSLLEKTWLGAPIQFAWQKTSGNYLAVTGADYIVKIFDRHGQKRSEINLPGNCVAMDWDKDGDVLAVIAEKSSCIYLWDANTNKTSQLDNGMRDQMSFLLWSKVGSFLAVGTVKGNLLIYNHQTSRKIPVLGKHTKRITCGCWNAENLLALGGEDKMITVSNQEGDTIRQTQVRSEPSNMQFFLMKMDDRTSAAESMISVVLGKKTLFFLNLNEPDNPADLEFQQDFGNIVCYNWYGDGRIMIGFSCGHFVVISTHTGELGQEIFQARNHKDNLTSIAVSQTLNKVATCGDNCIKIQDLVDLKDMYVILNLDEENKGLGTLSWTDDGQLLALSTQRGSLHVFLTKLPILGDACSTRIAYLTSLLEVTVANPVEGELPITVSVDVEPNFVAVGLYHLAVGMNNRAWFYVLGENAVKKLKDMEYLGTVASICLHSDYAAALFEGKVQLHLIESEILDAQEERETRLFPAVDDKCRILCHALTSDFLIYGTDTGVVQYFYIEDWQFVNDYRHPVSVKKIFPDPNGTRLVFIDEKSDGFVYCPVNDATYEIPDFSPTIKGVLWENWPMDKGVFIAYDDDKVYTYVFHKDTIQGAKVILAGSTKVPFAHKPLLLYNGELTCQTQSGKVNNIYLSTHGFLSNLKDTGPDELRPMLAQNLMLKRFSDAWEMCRILNDEAAWNELARACLHHMEVEFAIRVYRRIGNVGIVMSLEQIKGIEDYNLLAGHLAMFTNDYNLAQDLYLASSCPIAALEMRRDLQHWDSALQLAKHLAPDQIPFISKEYAIQLEFAGDYVNALAHYEKGITGDNKEHDEACLAGVAQMSIRMGDIRRGVNQALKHPSRVLKRDCGAILENMKQFSEAAQLYEKGLYYDKAASVYIRSKNWAKVGDLLPHVSSPKIHLQYAKAKEADGRYKEAVVAYENAKQWQSVIRIYLDHLNNPEKAVNIVRETQSLDGAKMVARFFLQLGDYGSAIQFLVMSKCNNEAFTLAQQHNKMEIYADIIGSEDTTNEDYQSIALYFEGEKRYLQAGKFFLLCGQYSRALKHFLKCPSSEDNVAIEMAIETVGQAKDELLTNQLIDHLLGENDGMPKDAKYLFRLYMALKQYREAAQTAIIIAREEQSAGNYRNAHDVLFSMYAELKSQKIKIPSEMATNLMILHSYILVKIHVKNGDHMKGARMLIRVANNISKFPSHIVPILTSTVIECHRAGLKNSAFSFAAMLMRPEYRSKIDAKYKKKIEGMVRRPDISEIEEATTPCPFCKFLLPECELLCPGCKNSIPYCIATGRHMLKDDWTVCPHCDFPALYSELKIMLNTESTCPMCSERLNAAQLKKISDCTQYLRTEEEL

SEQ ID NO: 97266 - protein, 135 aa, Homo sapiens
  Payload ID: 19405
  Gene Name: WD repeat domain 19
  ENSP ID: ENSP00000421401
  MOD_RES (1)..(1): Any amino acid
XKPLLLYNGELTCQTQSGKVNNIYLSTHGFLSNLKDTGPDELRPMLAQNLMLKRFSDAWEMCRILNDEAAWNELARACLHHMEVEFAIRVYRRIGNVGIVMSLEQIKDTLPCLPTIITWLRTCTLHPAVLLLPWR

SEQ ID NO: 97267 - protein, 42 aa, Homo sapiens
  Payload ID: 19405
  Gene Name: WD repeat domain 19
  ENSP ID: ENSP00000421888
MITVSNQEGDTIRQTQVRSEPSNMQFFLMKMDDRTSAAESMV

SEQ ID NO: 97268 - protein, 481 aa, Homo sapiens
  Payload ID: 19405
  Gene Name: WD repeat domain 19
  ENSP ID: ENSP00000423491
MKRIFSLLEKTWLGAPIQFAWQKTSGNYLAVTGADYIVKIFDRHGQKRSEINLPGNCVAMDWDKDGDVLAVIAEKSSCIYLWDANTNKTSQLDNGMRDQMSFLLWSKVGSFLAVGTVKGNLLIYNHQTSRKIPVLGKHTKRITCGCWNAENLLALGGEDKMITVSNQEGDTIRQTQVRSEPSNMQFFLMKMDDRTSAAESMISVVLGKKTLFFLNLNEPDNPADLEFQQDFGNIVCYNWYGDGRIMIGFSCGHFVVISTHTGELGQEIFQARNHKDNLTSIAVSQTLNKVATCGDNCIKIQDLVDLKDMYVILNLDEENKGLGTLSWTDDGQLLALSTQRGSLHVFLTKLPILGDACSTRIAYLTSLLEVTVANPVEGELPITVSVDVEPNFVAVGLYHLAVGMNNRAWFYVLGENAVKKLKDMEYLGTVASICLHSDYAAALFEGKVQLHLKAKSWMLKKNVRLGFSQQWMISAVSYAMP

SEQ ID NO: 97269 - protein, 99 aa, Homo sapiens
  Payload ID: 19405
  Gene Name: WD repeat domain 19
  ENSP ID: ENSP00000423706
MKRIFSLLEKTWLGAPIQFAWQKTSGNYLAVTGADYIVKIFDRHGQKRSEINLPGNCVAMDWDKDGDVLAVIAEKSSCIYLWDANTNKTSQLDNGMRHK

SEQ ID NO: 97270 - protein, 100 aa, Homo sapiens
  Payload ID: 19405
  Gene Name: WD repeat domain 19
  ENSP ID: ENSP00000424319
MKRIFSLLEKTWLGAPIQFAWQKTSGNYLAVTGADYIVKIFDRHGQKRSEINLPGNCVAMDWDKDGDVLAVIAEKSSCIYLWDANTNKTSQLDNGMRKTY

SEQ ID NO: 97271 - protein, 78 aa, Homo sapiens
  Payload ID: 19405
  Gene Name: WD repeat domain 19
  ENSP ID: ENSP00000425949
MKRIFSLLEKTWLGAPIQFAWQKTSGNYLAVTGNCVAMDWDKDGDVLAVIAEKSSCIYLWDANTNKTSQLDNGMRKTY

SEQ ID NO: 97272 - protein, 142 aa, Homo sapiens
  Payload ID: 19405
  Gene Name: WD repeat domain 19
  ENSP ID: ENSP00000426918
MDWDKDGDVLAVIAEKSSCIYLWDANTNKTSQLDNGMRDQMSFLLWSKVGSFLAVGTVKGNLLIYNHQTSRKIPVLGKHTKRITCGCWNAENLLALGGEDKMITVSNQEGDTIRQTQVRSEPSNMQFFLMKMDDRTSAAESM

SEQ ID NO: 97273 - protein, 86 aa, Homo sapiens
  Payload ID: 19406
  Gene Name: WD repeat domain 20
  Uniprot ID: Q8TBZ3
  ENSP ID: ENSP00000299135
MATEGGGKEMNEIKTQFTTREGLYKLLPHSEYSRPNRVPFNSQGSNPVRVSFVNLNDQSGNGDRLCFNVGRELYFYIYKGVRKTIP

SEQ ID NO: 97274 - protein, 195 aa, Homo sapiens
  Payload ID: 19406
  Gene Name: WD repeat domain 20
  Uniprot ID: Q8TBZ3
  ENSP ID: ENSP00000314209
MATEGGGKEMNEIKTQFTTREGLYKLLPHSEYSRPNRVPFNSQGSNPVRVSFVNLNDQSGNGDRLCFNVGRELYFYIYKGVRKAADLSKPIDKRIYKGTQPTCHDFNHLTATAESVSLLVGFSAGQVQLIDPIKKETSKLFNEENSCQHLWKVDWNEERQNEGSKTSEEALVTVQPAEHFCRQEDRMQGVLQDQN

SEQ ID NO: 97275 - protein, 581 aa, Homo sapiens
  Payload ID: 19406
  Gene Name: WD repeat domain 20
  Uniprot ID: Q8TBZ3
  ENSP ID: ENSP00000335434
MATEGGGKEMNEIKTQFTTREGLYKLLPHSEYSRPNRVPFNSQGSNPVRVSFVNLNDQSGNGDRLCFNVGRELYFYIYKGVRKAADLSKPIDKRIYKGTQPTCHDFNHLTATAESVSLLVGFSAGQVQLIDPIKKETSKLFNEERLIDKSRVTCVKWVPGSESLFLVAHSSGNMYLYNVEHTCGTTAPHYQLLKQGESFAVHTCKSKSTRNPLLKWTVGEGALNEFAFSPDGKFLACVSQDGFLRVFNFDSVELHGTMKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVGSLSSPSQASSPGGTVV

SEQ ID NO: 97276 - protein, 569 aa, Homo sapiens
  Payload ID: 19406
  Gene Name: WD repeat domain 20
  Uniprot ID: Q8TBZ3
  ENSP ID: ENSP00000341037
MATEGGGKEMNEIKTQFTTREGLYKLLPHSEYSRPNRVPFNSQGSNPVRVSFVNLNDQSGNGDRLCFNVGRELYFYIYKGVRKAADLSKPIDKRIYKGTQPTCHDFNHLTATAESVSLLVGFSAGQVQLIDPIKKETSKLFNEERLIDKSRVTCVKWVPGSESLFLVAHSSGNMYLYNVEHTCGTTAPHYQLLKQGESFAVHTCKSKSTRNPLLKWTVGEGALNEFAFSPDGKFLACVSQDGFLRVFNFDSVELHGTMKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVVSFNP

SEQ ID NO: 97277 - protein, 612 aa, Homo sapiens
  Payload ID: 19406
  Gene Name: WD repeat domain 20
  ENSP ID: ENSP00000395793
MATEGGGKEMNEIKTQFTTREGLYKLLPHSEYSRPNRVPFNSQGSNPVRVSFVNLNDQSGNGDRLCFNVGRELYFYIYKGVRKAADLSKPIDKRIYKGTQPTCHDFNHLTATAESVSLLVGFSAGQVQLIDPIKKETSKLFNEENSCQHLWKVDWNEERQNEGSKTSEEALVTVQRLIDKSRVTCVKWVPGSESLFLVAHSSGNMYLYNVEHTCGTTAPHYQLLKQGESFAVHTCKSKSTRNPLLKWTVGEGALNEFAFSPDGKFLACVSQDGFLRVFNFDSVELHGTMKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVGSLSSPSQASSPGGTVV

SEQ ID NO: 97278 - protein, 600 aa, Homo sapiens
  Payload ID: 19406
  Gene Name: WD repeat domain 20
  Uniprot ID: Q8TBZ3
  ENSP ID: ENSP00000406084
MATEGGGKEMNEIKTQFTTREGLYKLLPHSEYSRPNRVPFNSQGSNPVRVSFVNLNDQSGNGDRLCFNVGRELYFYIYKGVRKAADLSKPIDKRIYKGTQPTCHDFNHLTATAESVSLLVGFSAGQVQLIDPIKKETSKLFNEENSCQHLWKVDWNEERQNEGSKTSEEALVTVQRLIDKSRVTCVKWVPGSESLFLVAHSSGNMYLYNVEHTCGTTAPHYQLLKQGESFAVHTCKSKSTRNPLLKWTVGEGALNEFAFSPDGKFLACVSQDGFLRVFNFDSVELHGTMKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVVSFNP

SEQ ID NO: 97279 - protein, 520 aa, Homo sapiens
  Payload ID: 19406
  Gene Name: WD repeat domain 20
  Uniprot ID: Q8TBZ3
  ENSP ID: ENSP00000450636
MATEGGGKEMNEIKTQFTTREGLYKLLPHSEYSRPNRVPFNSQGSNPVRVSFVNLNDQSGNGDRLCFNVGRELYFYIYKGVRKRLIDKSRVTCVKWVPGSESLFLVAHSSGNMYLYNVEHTCGTTAPHYQLLKQGESFAVHTCKSKSTRNPLLKWTVGEGALNEFAFSPDGKFLACVSQDGFLRVFNFDSVELHGTMKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVGSLSSPSQASSPGGTVV

SEQ ID NO: 97280 - protein, 508 aa, Homo sapiens
  Payload ID: 19406
  Gene Name: WD repeat domain 20
  Uniprot ID: Q8TBZ3
  ENSP ID: ENSP00000451633
MATEGGGKEMNEIKTQFTTREGLYKLLPHSEYSRPNRVPFNSQGSNPVRVSFVNLNDQSGNGDRLCFNVGRELYFYIYKGVRKRLIDKSRVTCVKWVPGSESLFLVAHSSGNMYLYNVEHTCGTTAPHYQLLKQGESFAVHTCKSKSTRNPLLKWTVGEGALNEFAFSPDGKFLACVSQDGFLRVFNFDSVELHGTMKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVVSFNP

SEQ ID NO: 97281 - protein, 86 aa, Homo sapiens; identical to SEQ ID NO: 97273
  Payload ID: 19406
  Gene Name: WD repeat domain 20
  Uniprot ID: Q8TBZ3
  ENSP ID: ENSP00000452470

SEQ ID NO: 97282 - protein, 23 aa, Homo sapiens
  Payload ID: 19406
  Gene Name: WD repeat domain 20
  ENSP ID: ENSP00000452539
MATEGGGKEMNEIKTQFTTREGC

SEQ ID NO: 97283 - protein, 72 aa, Homo sapiens
  Payload ID: 19406
  Gene Name: WD repeat domain 20
  ENSP ID: ENSP00000452638
  MOD_RES (1)..(1): Any amino acid
XLSKPIDKRIYKGTQPTCHDFNHLTATAESVSLLVGFSAGQVQLIDPIKKETSKLFNEEAFEGRYATFSPFV

SEQ ID NO: 97284 - protein, 176 aa, Homo sapiens
  Payload ID: 19406
  Gene Name: WD repeat domain 20
  ENSP ID: ENSP00000452774
MATEGGGKEMNEIKTQFTTREGLYKLLPHSEYSRPNRVPFNSQGSNPVRVSFVNLNDQSGNGDRLCFNVGRELYFYIYKGVRKAADLSKPIDKRIYKGTQPTCHDFNHLTATAESVSLLVGFSAGQVQLIDPIKKETSKLFNEERRDFTMLARLVWNSWLQVIHPPQLPKVLELQA

SEQ ID NO: 97285 - protein, 66 aa, Homo sapiens
  Payload ID: 19406
  Gene Name: WD repeat domain 20
  ENSP ID: ENSP00000454151
MYLYNVEHTCGTTAPHYQLLKQGESFAVHTCKSKSTRNPLLKWTVGEGALNEFAFSPDGKFLACVS

SEQ ID NO: 97286 - protein, 920 aa, Homo sapiens
  Payload ID: 19407
  Gene Name: WD repeat domain 24
  Uniprot ID: Q96S15
  ENSP ID: ENSP00000248142
MGKKRTTSGEGRERQRLPARRFRTTSPAALRADSVDGGSLLAPLLGLTDRAFSDCPDLADGAMEKMSRVTTALGGSVLTGRTMHCHLDAPANAISVCRDAAQVVVAGRSIFKIYAIEEEQFVEKLNLRVGRKPSLNLSCADVVWHQMDENLLATAATNGVVVTWNLGRPSRNKQDQLFTEHKRTVNKVCFHPTEAHVLLSGSQDGFMKCFDLRRKDSVSTFSGEATEAGPREWAMAGCVPILPVLSCRILRLHHSFAHGPMQDAESTANDARESWGCPLYPLGLCSGPQAGQSESVRDVQFSIRDYFTFASTFENGNVQLWDIRRPDRCERMFTAHNGPVFCCDWHPEDRGWLATGGRDKMVKVWDMTTHRAKEMHCVQTIASVARVKWRPECRHHLATCSMMVDHNIYVWDVRRPFVPAAMFEEHRDVTTGIAWRHPHDPSFLLSGSKDSSLCQHLFRDASQPVERANPEGLCYGLFGDLAFAAKESLVAAESGRKPYTGDRRHPIFFKRKLDPAEPFAGLASSALSVFETEPGGGGMRWFVDTAERYALAGRPLAELCDHNAKVARELGRNQVAQTWTMLRIIYCSPGLVPTANLNHSVGKGGSCGLPLMNSFNLKDMAPGLGSETRLDRSKGDARSDTVLLDSSATLITNEDNEETEGSDVPADYLLGDVEGEEDELYLLDPEHAHPEDPECVLPQEAFPLRHEIVDTPPGPEHLQDKADSPHVSGSEADVASLAPVDSSFSLLSVSHALYDSRLPPDFFGVLVRDMLHFYAEQGDVQMAVSVLIVLGERVRKDIDEQTQEHWYTSYIDLLQRFRLWNVSNEVVKLSTSRAVSCLNQASTTLHVNCSHCKRPMSSRGWVCDRCHRCASMCAVCHHVVKGLFVWCQGCSHGGHLQHIMKWLEGSSHCPAGCGHLCEYS

SEQ ID NO: 97287 - protein, 790 aa, Homo sapiens
  Payload ID: 19407
  Gene Name: WD repeat domain 24
  Uniprot ID: Q96S15
  ENSP ID: ENSP00000293883
MEKMSRVTTALGGSVLTGRTMHCHLDAPANAISVCRDAAQVVVAGRSIFKIYAIEEEQFVEKLNLRVGRKPSLNLSCADVVWHQMDENLLATAATNGVVVTWNLGRPSRNKQDQLFTEHKRTVNKVCFHPTEAHVLLSGSQDGFMKCFDLRRKDSVSTFSGQSESVRDVQFSIRDYFTFASTFENGNVQLWDIRRPDRCERMFTAHNGPVFCCDWHPEDRGWLATGGRDKMVKVWDMTTHRAKEMHCVQTIASVARVKWRPECRHHLATCSMMVDHNIYVWDVRRPFVPAAMFEEHRDVTTGIAWRHPHDPSFLLSGSKDSSLCQHLFRDASQPVERANPEGLCYGLFGDLAFAAKESLVAAESGRKPYTGDRRHPIFFKRKLDPAEPFAGLASSALSVFETEPGGGGMRWFVDTAERYALAGRPLAELCDHNAKVARELGRNQVAQTWTMLRIIYCSPGLVPTANLNHSVGKGGSCGLPLMNSFNLKDMAPGLGSETRLDRSKGDARSDTVLLDSSATLITNEDNEETEGSDVPADYLLGDVEGEEDELYLLDPEHAHPEDPECVLPQEAFPLRHEIVDTPPGPEHLQDKADSPHVSGSEADVASLAPVDSSFSLLSVSHALYDSRLPPDFFGVLVRDMLHFYAEQGDVQMAVSVLIVLGERVRKDIDEQTQEHWYTSYIDLLQRFRLWNVSNEVVKLSTSRAVSCLNQASTTLHVNCSHCKRPMSSRGWVCDRCHRCASMCAVCHHVVKGLFVWCQGCSHGGHLQHIMKWLEGSSHCPAGCGHLCEYS

SEQ ID NO: 97288 - protein, 544 aa, Homo sapiens
  Payload ID: 19408
  Gene Name: WD repeat domain 25
  Uniprot ID: Q64LD2
  ENSP ID: ENSP00000334148
MTARTLSLMASLVAYDDSDSEAETEHAGSFNATGQQKDTSGVARPPGQDFASGTLDVPKAGAQPTKHGSCEDPGGYRLPLAQLGRSDWGSCPSQRLQWPGKEPQVTFPIKEPSCSSLWTSHVPASHMPLAAARFKQVKLSRNFPKSSFHAQSESETVGKNGSSFQKKKCEDCVVPYTPRRLRQRQALSTETGKGKDVEPQGPPAGRAPAPLYVGPGVSEFIQPYLNSHYKETTVPRKVLFHLRGHRGPVNTIQWCPVLSKSHMLLSTSMDKTFKVWNAVDSGHCLQTYSLHTEAVRAARWAPCGRRILSGGFDFALHLTDLETGTQLFSGRSDFRITTLKFHPKDHNIFLCGGFSSEMKAWDIRTGKVMRSYKATIQQTLDILFLREGSEFLSSTDASTRDSADRTIIAWDFRTSAKISNQIFHERFTCPSLALHPREPVFLAQTNGNYLALFSTVWPYRMSRRRRYEGHKVEGYSVGCECSPGGDLLVTGSADGRVLMYSFRTASRACTLQGHTQACVGTTYHPVLPSVLATCSWGGDMKIWH

SEQ ID NO: 97289 - protein, 544 aa, Homo sapiens; identical to SEQ ID NO: 97288
  Payload ID: 19408
  Gene Name: WD repeat domain 25
  Uniprot ID: Q64LD2
  ENSP ID: ENSP00000385540

SEQ ID NO: 97290 - protein, 287 aa, Homo sapiens
  Payload ID: 19408
  Gene Name: WD repeat domain 25
  Uniprot ID: Q64LD2
  ENSP ID: ENSP00000441903
MPALCLVLCWFQGLLGEVWNAVDSGHCLQTYSLHTEAVRAARWAPCGRRILSGGFDFALHLTDLETGTQLFSGRSDFRITTLKFHPKDHNIFLCGGFSSEMKAWDIRTGKVMRSYKATIQQTLDILFLREGSEFLSSTDASTRDSADRTIIAWDFRTSAKISNQIFHERFTCPSLALHPREPVFLAQTNGNYLALFSTVWPYRMSRRRRYEGHKVEGYSVGCECSPGGDLLVTGSADGRVLMYSFRTASRACTLQGHTQACVGTTYHPVLPSVLATCSWGGDMKIWH

SEQ ID NO: 97291 - protein, 544 aa, Homo sapiens; identical to SEQ ID NO: 97288
  Payload ID: 19408
  Gene Name: WD repeat domain 25
  Uniprot ID: Q64LD2
  ENSP ID: ENSP00000450661

SEQ ID NO: 97292 - protein, 274 aa, Homo sapiens
  Payload ID: 19408
  Gene Name: WD repeat domain 25
  ENSP ID: ENSP00000450727
MTARTLSLMASLVAYDDSDSEAETEHAGSFNATGQQKDTSGVARPPGQDFASGTLDVPKAGAQPTKHGSCEDPGGYRLPLAQLGRSDWGSCPSQRLQWPGKEPQVTFPIKEPSCSSLWTSHVPASHMPLAAARFKQVKLSRNFPKSSFHAQSESETVGKNGSSFQKKKCEDCVVPYTPRRLRQRQALSTETGKGKDVEPQGPPAGRAPAPLYVGPGVSEFIQPYLNSHYKETTVPRKVLFHLRGHRGPVNTIQWCPVLSKSHMLLSTSMDKTFK

SEQ ID NO: 97293 - protein, 289 aa, Homo sapiens
  Payload ID: 19408
  Gene Name: WD repeat domain 25
  ENSP ID: ENSP00000451070
MTARTLSLMASLVAYDDSDSEAETEHAGSFNATGQQKDTSGVARPPGQDFASGTLDVPKAGAQPTKHGSCEDPGGYRLPLAQLGRSDWGSCPSQRLQWPGKEPQVTFPIKEPSCSSLWTSHVPASHMPLAAARFKQVKLSRNFPKSSFHAQSESETVGKNGSSFQKKKCEDCVVPYTPRRLRQRQALSTETGKGKDVEPQGPPAGRAPAPLYVGPGVSEFIQPYLNSHYKETTVPRKVLFHLRGHRGPVNTIQWCPVLSKSHMLLSTSMDKTFKEPSYLVVEVTLESLP

SEQ ID NO: 97294 - protein, 121 aa, Homo sapiens
  Payload ID: 19408
  Gene Name: WD repeat domain 25
  ENSP ID: ENSP00000452235
  MOD_RES (1)..(1): Any amino acid
XSTDASTRDSADRTIIAWDFRTSAKISNQIFHERFTCPSLALHPREPVFLAQTNGNYLALFSTVWPYRMSRRRRYEGHKVLLSLSPRRMLSPSPKPPGSPGHGPWGAWSLCLGGSCFLFPG

SEQ ID NO: 97295 - protein, 125 aa, Homo sapiens
  Payload ID: 19409
  Gene Name: WD repeat domain 26
  ENSP ID: ENSP00000403597
MQESGCRLEHPSATKFRNHVMEGDWDKAENDLNELKPLVHSPHAIVVRGALEISQTLLGIIVRMKFLLLQQKYLEYLEDGKVLEALQVLRCELTPLKYNTERIHVLSGYLMCSHAEDLRAKAEWE

SEQ ID NO: 97296 - protein, 661 aa, Homo sapiens
  Payload ID: 19409
  Gene Name: WD repeat domain 26
  Uniprot ID: Q9H7D7
  ENSP ID: ENSP00000408108
MQANGAGGGGGGGGGGGGGGGGGGGQGQTPELACLSAQNGESSPSSSSSAGDLAHANGLLPSAPSAASNNSNSLNVNNGVPGGAAAASSATVAAASATTAASSSLATPELGSSLKKKKRLSQSDEDVIRLIGQHLNGLGLNQTVDLLMQESGCRLEHPSATKFRNHVMEGDWDKAENDLNELKPLVHSPHAIVVRGALEISQTLLGIIVRMKFLLLQQKYLEYLEDGKVLEALQVLRCELTPLKYNTERIHVLSGYLMCSHAEDLRAKAEWEGKGTASRSKLLDKLQTYLPPSVMLPPRRLQTLLRQAVELQRDRCLYHNTKLDNNLDSVSLLIDHVCSRRQFPCYTQQILTEHCNEVWFCKFSNDGTKLATGSKDTTVIIWQVDPDTHLLKLLKTLEGHAYGVSYIAWSPDDNYLVACGPDDCSELWLWNVQTGELRTKMSQSHEDSLTSVAWNPDGKRFVTGGQRGQFYQCDLDGNLLDSWEGVRVQCLWCLSDGKTVLASDTHQRIRGYNFEDLTDRNIVQEDHPIMSFTISKNGRLALLNVATQGVHLWDLQDRVLVRKYQGVTQGFYTIHSCFGGHNEDFIASGSEDHKVYIWHKRSELPIAELTGHTRTVNCVSWNPQIPSMMASASDDGTVRIWGPAPFIDHQNIEEECSSMDS

SEQ ID NO: 97297 - protein, 208 aa, Homo sapiens
  Payload ID: 19409
  Gene Name: WD repeat domain 26
  ENSP ID: ENSP00000422758
GGGGGGGGGGGGGGGGGQGQTPELACLSAQNGESSPSSSSSAGDLAHANGLLPSAPSAASNNSNSLNVNNGVPGGAAAASSATVAAASATTAASSSLATPELGSSLKKKKRLSQSDEDVIRLIGQHLNGLGLNQTVDLLMQESGCRLEHPSATKFRNHVMEGDWDKAENDLNELKPLVHSPHAIVAQTFSETSINFFPLTAAFCHVRG

SEQ ID NO: 97298 - protein, 295 aa, Homo sapiens
  Payload ID: 19409
  Gene Name: WD repeat domain 26
  ENSP ID: ENSP00000424784
  MOD_RES (1)..(1): Any amino acid
XTKLATGSKDTTVIIWQVDPDTHLLKLLKTLEGHAYGVSYIAWSPDDNYLVACGPDDCSELWLWNVQTGELRTKMSQSHEDSLTSVAWNPDGKRFVTGGQRGQFYQCDLDGNLLDSWEGVRVQCLWCLSDGKTVLASDTHQRIRGYNFEDLTDRNIVQEDHPIMSFTISKNGRLALLNVATQGVHLWDLQDRVLVRKYQGVTQGFYTIHSCFGGHNEDFIASGSEDHKVYIWHKRSELPIAELTGHTRTVNCVSWNPQIPSMMASASDDGTVRIWGPAPFIDHQNIEEECSSMDS

SEQ ID NO: 97299 - protein, 730 aa, Homo sapiens
  Payload ID: 19410
  Gene Name: WD repeat domain 27
  Uniprot ID: A2RRH5
  ENSP ID: ENSP00000397869
MENPQDIFSSNGGCLSDIVIEKYLVESKESVSHVQLACSMQDCAFPLDGTELCIWNTKDPSHQLLILRGHHQPITAMAFGNKVNPLLICSASLDYVIMWNLDECREKVLQAYPLLSLFIDAESRQLVTGCADGQLWIFSLMDGHHYRRVARVDLRKKTETFSTRRVKSGLCSQPEESQLPSTSALGKGEQVEVTFPVLRLAPCDLSLIPNSACGCLSSENTRCVWIGSSVGLFVFNLANLEVEAALYYKDFQSLSILLAGSCALRNRTADQKVLCLLASLFGGKIAVLEINPAALVRAQQCPSMGQSLSVPASSCVLPTSPLYLGIAKEKSTKAASEQRRAARNVMKDQRLVFHSKVRSSGYASAPHVTMFSPKTNIKSEGKGSSRSRSSCAREAYPVECAVPTKPGPQVAAAPTCTRVCCIQYSGDGQWLACGLANHLLLVFDASLTGTPAVFSGHDGAVNAVCWSQDRRWLLSAARDGTLRMWSARGAELALLLGKDMFSKPIQSAQFYYIDAFILLSSGPEFQLLRYHIDTCKDEIKRYKQKSKSKLICRLSTTGAVDMTSLSAVNDFYSHIVLAAGRNRTVEVFDLNAGCSAAVIAEAHSRPVHQICQNKGSSFTTQQPQAYNLFLTTAIGDGMRLWDLRTLRCERHFEGHPTRGYPCGIAFSPCGRFAACGAEDRHAYVYEMGSSTFSHRLAGHTDTVTGVAFNPSAPQLATATLDGKLQLFLAE

SEQ ID NO: 97300 - protein, 195 aa, Homo sapiens
  Payload ID: 19410
  Gene Name: WD repeat domain 27
  ENSP ID: ENSP00000411915
  MOD_RES (1)..(1): Any amino acid
XEVEAALYYKDFQSLSILLAGSCALRNRTADQKVLCLLASLFGGKIAVLEINPAALVRAQQCPSMGQSLSVPASSCVLPTSPLYLGIAKEKSTKAASEQRRAARNVMKDQRLVFHSKVRSSGYASAPHVTMFSPKTNIKSEGKGSSRSRSSCAREAYPVECAVPTKPGPQVAAAPTCTRVCCIQYSGAPRPAGAG

SEQ ID NO: 97301 - protein, 895 aa, Homo sapiens
  Payload ID: 19410
  Gene Name: WD repeat domain 27
  Uniprot ID: A2RRH5
  ENSP ID: ENSP00000416289
MENPQDIFSSNGGCLSDIVIEKYLVESKESVSHVQLACSMQDCAFPLDGTELCIWNTKDPSHQLLILRGHHQPITAMAFGNKVNPLLICSASLDYVIMWNLDECREKVLQGLVPRGTVMGSLLGKVLCLQLSLDDHVVAVCAGNKIFMLDIEQRFSVTYIERPDVNNRHKVPPPTFLHTFSQTQAVRAELQGHLGPVTAVEFCPWRAGTLISASEDRGFKVWDHCTGSLIYSSSVLSAYPLLSLFIDAESRQLVTGCADGQLWIFSLMDGHHYRRVARVDLRKKTETFSTRRVKSGLCSQPEESQLPSTSALGKGEQVEVTFPVLRLAPCDLSLIPNSACGCLSSENTRCVWIGSSVGLFVFNLANLEVEAALYYKDFQSLSILLAGSCALRNRTADQKVLCLLASLFGGKIAVLEINPAALVRAQQCPSMGQSLSVPASSCVLPTSPLYLGIAKEKSTKAASEQRRAARNVMKDQRLVFHSKVRSSGYASAPHVTMFSPKTNIKSEGKGSSRSRSSCAREAYPVECAVPTKPGPQVAAAPTCTRVCCIQYSGDGQWLACGLANHLLLVFDASLTGTPAVFSGHDGAVNAVCWSQDRRWLLSAARDGTLRMWSARGAELALLLGKDMFSKPIQSAQFYYIDAFILLSSGPEFQLLRYHIDTCKDEIKRYKQKSKSKLICRLSTTGAVDMTSLSAVNDFYSHIVLAAGRNRTVEVFDLNAGCSAAVIAEAHSRPVHQICQNKGSSFTTQQPQAYNLFLTTAIGDGMRLWDLRTLRCERHFEGHPTRGYPCGIAFSPCGRFAACGAEDRHAYVYEMGSSTFSHRLAGHTDTVTGVAFNPSAPQMESRSVAHAGVQWHDLGSLQPPPSRFKQFFCLSLPSSWDYSLPQLPWMVNSSSF

SEQ ID NO: 97302 - protein, 88 aa, Homo sapiens
  Payload ID: 19410
  Gene Name: WD repeat domain 27
  ENSP ID: ENSP00000449696
MENPQDIFSSNGGCLSDIVIEKYLVESKESVSHVQLACSMQDCAFPLDGTELCIWNTKDPSHQLLILRGHHQPITAMAFGNKVNPLLI

SEQ ID NO: 97303 - protein, 943 aa, Homo sapiens
  Payload ID: 19411
  Gene Name: WD repeat domain 3
  Uniprot ID: Q9UNX4
  ENSP ID: ENSP00000308179
MGLTKQYLRYVASAVFGVIGSQKGNIVFVTLRGEKGRYVAVPACEHVFIWDLRKGEKILILQGLKQEVTCLCPSPDGLHLAVGYEDGSIRIFSLLSGEGNVTFNGHKAAITTLKYDQLGGRLASGSKDTDIIVWDVINESGLYRLKGHKDAITQALFLREKNLLVTSGKDTMVKWWDLDTQHCFKTMVGHRTEVWGLVLLSEEKRLITGASDSELRVWDIAYLQEIEDPEEPDPKKIKGSSPGIQDTLEAEDGAFETDEAPEDRILSCRKAGSIMREGRDRVVNLAVDKTGRILACHGTDSVLELFCILSKKEIQKKMDKKMKKARKKAKLHSSKGEEEDPEVNVEMSLQDEIQRVTNIKTSAKIKSFDLIHSPHGELKAVFLLQNNLVELYSLNPSLPTPQPVRTSRITIGGHRSDVRTLSFSSDNIAVLSAAADSIKIWNRSTLQCIRTMTCEYALCSFFVPGDRQVVIGTKTGKLQLYDLASGNLLETIDAHDGALWSMSLSPDQRGFVTGGADKSVKFWDFELVKDENSTQKRLSVKQTRTLQLDEDVLCVSYSPNQKLLAVSLLDCTVKIFYVDTLKFFLSLYGHKLPVICMDISHDGALIATGSADRNVKIWGLDFGDCHKSLFAHDDSVMYLQFVPKSHLFFTAGKDHKIKQWDADKFEHIQTLEGHHQEIWCLAVSPSGDYVVSSSHDKSLRLWERTREPLILEEEREMEREAEYEESVAKEDQPAVPGETQGDSYFTGKKTIETVKAAERIMEAIELYREETAKMKEHKAICKAAGKEVPLPSNPILMAYGSISPSAYVLEIFKGIKSSELEESLLVLPFSYVPDILKLFNEFIQLGSDVELICRCLFFLLRIHFGQITSNQMLVPVIEKLRETTISKVSQVRDVIGFNMAGLDYLKRECEAKSEVMFFADATSHLEEKKRKRKKREKLILTLT

SEQ ID NO: 97304 - protein, 40 aa, Homo sapiens
  Payload ID: 19411
  Gene Name: WD repeat domain 3
  ENSP ID: ENSP00000358449
MGLTKQYLRYVASAVFGVIGSQKGLASQASSSFVFFATEF

SEQ ID NO: 97305 - protein, 366 aa, Homo sapiens
  Payload ID: 19412
  Gene Name: WD repeat domain 31
  Uniprot ID: Q8NA23
  ENSP ID: ENSP00000345027
MLLLRCQLKQAPPQKVSFRFCVVMGKQQSKLKHSTYKYGPDEIIEERIQTKAFQEYSPAHMDTVSVVAALNSDLCVSGGKDKTVVAYNWKTGNVVKRFKGHEHEITKVACIPKSSQFFSASRDRMVMMWDLHGSSQPRQQLCGHAMVVTGLAVSPDSSQLCTGSRDNTLLLWDVVTGQSVERASVSRNVVTHLCWVPREPYILQTSEDKTLRLWDSRGLQVAHMFPAKQHIQTYCEVSVDGHKCISCSNGFGGEGCEATLWDLRQTRNRICEYKGHFQTVASCVFLPRALALMPLIATSSHDCKVKIWNQDTGACLFTLSLDGSGPLTSLAVGDAISLLCASFNRGIHLLRMDHSQGLELQEVAAF

SEQ ID NO: 97306 - protein, 367 aa, Homo sapiens
  Payload ID: 19412
  Gene Name: WD repeat domain 31
  Uniprot ID: Q8NA23
  ENSP ID: ENSP00000363308
MLLLRCQLKQAPPQKVSFRFCVVMGKQQSKLKHSTYKYGRPDEIIEERIQTKAFQEYSPAHMDTVSVVAALNSDLCVSGGKDKTVVAYNWKTGNVVKRFKGHEHEITKVACIPKSSQFFSASRDRMVMMWDLHGSSQPRQQLCGHAMVVTGLAVSPDSSQLCTGSRDNTLLLWDVVTGQSVERASVSRNVVTHLCWVPREPYILQTSEDKTLRLWDSRGLQVAHMFPAKQHIQTYCEVSVDGHKCISCSNGFGGEGCEATLWDLRQTRNRICEYKGHFQTVASCVFLPRALALMPLIATSSHDCKVKIWNQDTGACLFTLSLDGSGPLTSLAVGDAISLLCASFNRGIHLLRMDHSQGLELQEVAAF

SEQ ID NO: 97307 - protein, 366 aa, Homo sapiens; identical to SEQ ID NO: 97305
  Payload ID: 19412
  Gene Name: WD repeat domain 31
  Uniprot ID: Q8NA23
  ENSP ID: ENSP00000363310

SEQ ID NO: 97308 - protein, 141 aa, Homo sapiens
  Payload ID: 19412
  Gene Name: WD repeat domain 31
  ENSP ID: ENSP00000419246
MLLLRCQLKQAPPQKTVVAYNWKTGNVVKRFKGHEHEITKVACIPKSSQFFSASRDRMVMMWDLHGSSQPRQQLCGHAMVVTGLAVSPDSSQLCTGSRDNTLLLWDVVTGQSVERASVSRNVVTHLCWVPREPYILQTSED

SEQ ID NO: 97309 - protein, 51 aa, Homo sapiens
  Payload ID: 19412
  Gene Name: WD repeat domain 31
  ENSP ID: ENSP00000420074
MLLLRCQLKQAPPQKVSFRFCVVMGKQQSKLKHSTYKYGQLWPIIGKLEMW

SEQ ID NO: 97310 - protein, 1336 aa, Homo sapiens
  Payload ID: 19413
  Gene Name: WD repeat domain 33
  Uniprot ID: Q9C0J8
  ENSP ID: ENSP00000325377
MATEIGSPPRFFHMPRFQHQAPRQLFYKRPDFAQQQAMQQLTFDGKRMRKAVNRKTIDYNPSVIKYLENRIWQRDQRDMRAIQPDAGYYNDLVPPIGMLNNPMNAVTTKFVRTSTNKVKCPVFVVRWTPEGRRLVTGASSGEFTLWNGLTFNFETILQAHDSPVRAMTWSHNDMWMLTADHGGYVKYWQSNMNNVKMFQAHKEAIREASFSPTDNKFATCSDDGTVRIWDFLRCHEERILRGHGADVKCVDWHPTKGLVVSGSKDSQQPIKFWDPKTGQSLATLHAHKNTVMEVKLNLNGNWLLTASRDHLCKLFDIRNLKEELQVFRGHKKEATAVAWHPVHEGLFASGGSDGSLLFWHVGVEKEVGGMEMAHEGMIWSLAWHPLGHILCSGSNDHTSKFWTRNRPGDKMRDRYNLNLLPGMSEDGVEYDDLEPNSLAVIPGMGIPEQLKLAMEQEQMGKDESNEIEMTIPGLDWGMEEVMQKDQKKVPQKKVPYAKPIPAQFQQAWMQNKVPIPAPNEVLNDRKEDIKLEEKKKTQAEIEQEMATLQYTNPQLLEQLKIERLAQKQVEQIQPPPSSGTPLLGPQPFPGQGPMSQIPQGFQQPHPSQQMPMNMAQMGPPGPQGQFRPPGPQGQMGPQGPPLHQGGGGPQGFMGPQGPQGPPQGLPRPQDMHGPQGMQRHPGPHGPLGPQGPPGPQGSSGPQGHMGPQGPPGPQGHIGPQGPPGPQGHLGPQGPPGTQGMQGPPGPRGMQGPPHPHGIQGGPGSQGIQGPVSQGPLMGLNPRGMQGPPGPRENQGPAPQGMIMGHPPQEMRGPHPPGGLLGHGPQEMRGPQEIRGMQGPPPQGSMLGPPQELRGPPGSQSQQGPPQGSLGPPPQGGMQGPPGPQGQQNPARGPHPSQGPIPFQQQKTPLLGDGPRAPFNQEGQSTGPPPLIPGLGQQGAQGRIPPLNPGQGPGPNKGDSRGPPNHHMGPMSERRHEQSGGPEHGPERGPFRGGQDCRGPPDRRGPHPDFPDDFSRPDDFHPDKRFGHRLREFEGRGGPLPQEEKWRRGGPGPPFPPDHREFSEGDGRGAARGPPGAWEGRRPGDERFPRDPEDPRFRGRREESFRRGAPPRHEGRAPPRGRDGFPGPEDFGPEENFDASEEAARGRDLRGRGRGTPRGGRKGLLPTPDEFPRFEGGRKPDSWDGNREPGPGHEHFRDTPRPDHPPHDGHSPASRERSSSLQGMDMASLPPRKRPWHDGPGTSEHREMEAPGGPSEDRGGKGRGGPGPAQRVPKSGRSSSLDGEHHDGYHRDEPFGGPPGSGTPSRGGRSGSNWGRGSNMNSGPPRRGASRGGGRGR

SEQ ID NO: 97311 - protein, 257 aa, Homo sapiens
  Payload ID: 19413
  Gene Name: WD repeat domain 33
  Uniprot ID: Q9C0J8
  ENSP ID: ENSP00000376730
MATEIGSPPRFFHMPRFQHQAPRQLFYKRPDFAQQQAMQQLTFDGKRMRKAVNRKTIDYNPSVIKYLENRIWQRDQRDMRAIQPDAGYYNDLVPPIGMLNNPMNAVTTKFVRTSTNKVKCPVFVVRWTPEGRRLVTGASSGEFTLWNGLTFNFETILQAHDSPVRAMTWSHNDMWMLTADHGGYVKYWQSNMNNVKMFQAHKEAIREASFSPTDNKFATCSDDGTVRIWDFLRCHEERILRDTCFHHCRCYFLSVKR

SEQ ID NO: 97312 - protein, 118 aa, Homo sapiens
  Payload ID: 19413
  Gene Name: WD repeat domain 33
  ENSP ID: ENSP00000386861
MATEIGSPPRFFHMPRFQHQAPRQLFYKRPDFAQQQAMQQLTFDGKRMRKAVNRKTIDYNPSVIKYLENRIWQRDQRDMRAIQPDAGYYNDLVPPIGMLNNPMNAVTTKFVRTSTNKV

SEQ ID NO: 97313 - protein, 326 aa, Homo sapiens
  Payload ID: 19413
  Gene Name: WD repeat domain 33
  Uniprot ID: Q9C0J8
  ENSP ID: ENSP00000387186
MATEIGSPPRFFHMPRFQHQAPRQLFYKRPDFAQQQAMQQLTFDGKRMRKAVNRKTIDYNPSVIKYLENRIWQRDQRDMRAIQPDAGYYNDLVPPIGMLNNPMNAVTTKFVRTSTNKVKCPVFVVRWTPEGRRLVTGASSGEFTLWNGLTFNFETILQAHDSPVRAMTWSHNDMWMLTADHGGYVKYWQSNMNNVKMFQAHKEAIREARFIHNIPFSVVPIVMVKLFSKCILGAEMHGLCQFLGNFLHPINTIFFFVFTHSPFCWHLSEVVLSRYQPLQYVRDVLSAAFCTGFLFSFMINNVYTLFLFIIYCVRQEYFIPNKEFSL

SEQ ID NO: 97314 - protein, 205 aa, Homo sapiens
  Payload ID: 19413
  Gene Name: WD repeat domain 33
  ENSP ID: ENSP00000397547
MRAIQPDAGYYNDLVPPIGMLNNPMNAVTTKFVRTSTNKVKCPVFVVRWTPEGRRLVTGASSGEFTLWNGLTFNFETILQAHDSPVRAMTWSHNDMWMLTADHGGYVKYWQSNMNNVKMFQAHKEAIREASFSPTDNKFATCSDDGTVRIWDFLRCHEERILRGHGADVKCVDWHPTKGLVVSGSKDSQQPIKFWDPKTGQSLAT

SEQ ID NO: 97315 - protein, 536 aa, Homo sapiens
  Payload ID: 19414
  Gene Name: WD repeat domain 34
  Uniprot ID: Q96EX3
  ENSP ID: ENSP00000361800
MATRAQPGPLSQAGSAGVAALATVGVASGPGPGRPGPLQDETLGVASVPSQWRAVQGIRWETKSCQTASIATASASAQARNHVDAQVQTEAPVPVSVQPPSQYDIPRLAAFLRRVEAMVIRELNKNWQSHAFDGFEVNWTEQQQMVSCLYTLGYPPAQAQGLHVTSISWNSTGSVVACAYGRLDHGDWSTLKSFVCAWNLDRRDLRPQQPSAVVEVPSAVLCLAFHPTQPSHVAGGLYSGEVLVWDLSRLEDPLLWRTGLTDDTHTDPVSQVVWLPEPGHSHRFQVLSVATDGKVLLWQGIGVGQLQLTEGFALVMQQLPRSTKLKKHPRGETEVGATAVAFSSFDPRLFILGTEGGFPLKCSLAAGEAALTRMPSSVPLRAPAQFTFSPHGGPIYSVSCSPFHRNLFLSAGTDGHVHLYSMLQAPPLTSLQLSLKYLFAVRWSPVRPLVFAAASGKGDVQLFDLQKSSQKPTVLIKQTQDESPVYCLEFNSQQTQLLAAGDAQGTVKVWQLSTEFTEQGPREAEDLDCLAAEVAA

SEQ ID NO: 97316 - protein, 272 aa, Homo sapiens
  Payload ID: 19414
  Gene Name: WD repeat domain 34
  ENSP ID: ENSP00000411370
LSQAGSAGVAALATVGVASGPGPGRPGPLQDETLGVASVPSQWRAVQGIRWETKSCQTASIATASASAQARNHVDAQVQTEAPVPVSVQPPSQYDIPRLAAFLRRVEAMVIRELNKNWQSHAFDGFEVNWTEQQQMVSCLYTLGYPPAQAQGLHVTSISWNSTGSVVACAYGRLDHGDWSTLKSFVCAWNLDRRDLRPQQPSAVVEVPSAVLCLAFHPTQPSHVAGELPAVSASSPLRTQLPALQRAQGSFPWALWPGDRKAGPDPLSLEPR

SEQ ID NO: 97317 - protein, 139 aa, Homo sapiens
  Payload ID: 19414
  Gene Name: WD repeat domain 34
  ENSP ID: ENSP00000415421
AGVAALATVGVASGPGPGRPGPLQDETLGVASVPSQWRAVQGIRWETKSCQTASIATASASAQARNHVDAQVQTEAPVPVSVQPPSQYDIPRLAAFLRRVEAMVIRELNKNWQSHAFDGFEVNWTEQQQMAGPWGLEHA

SEQ ID NO: 97318 - protein, 1170 aa, Homo sapiens
  Payload ID: 19415
  Gene Name: WD repeat domain 35
  Uniprot ID: Q9P2L0
  ENSP ID: ENSP00000281405
MFFYLSKKISIPNNVKLQCVSWNKEQGFIACGGEDGLLKVLKLETQTDDAKLRGLAAPSNLSMNQTLEGHSGSVQVVTWNEQYQKLTTSDENGLIIVWMLYKGSWIEEMINNRNKSVVRSMSWNADGQKICIVYEDGAVIVGSVDGNRIWGKDLKGIQLSHVTWSADSKVLLFGMANGEIHIYDNQGNFMIKMKLSCLVNVTGAISIAGIHWYHGTEGYVEPDCPCLAVCFDNGRCQIMRHENDQNPVLIDTGMYVVGIQWNHMGSVLAVAGFQKAAMQDKDVNIVQFYTPFGEHLGTLKVPGKEISALSWEGGGLKIALAVDSFIYFANIRPNYKWGYCSNTVVYAYTRPDRPEYCVVFWDTKNNEKYVKYVKGLISITTCGDFCILATKADENHPQFVLVLCNSIGTPLDPKYIDIVPLFVAMTKTHVIAASKEAFYTWQYRVAKKLTALEINQITRSRKEGRERIYHVDDTPSGSMDGVLDYSKTIQGTRDPICAITASDKILIVGRESGTIQRYSLPNVGLIQKYSLNCRAYQLSLNCNSSRLAIIDISGVLTFFDLDARVTDSTGQQVVGELLKLERRDVWDMKWAKDNPDLFAMMEKTRMYVFRNLDPEEPIQTSGYICNFEDLEIKSVLLDEILKDPEHPNKDYLINFEIRSLRDSRALIEKVGIKDASQFIEDNPHPRLWRLLAEAALQKLDLYTAEQAFVRCKDYQGIKFVKRLGKLLSESMKQAEVVGYFGRFEEAERTYLEMDRRDLAIGLRLKLGDWFRVLQLLKTGSGDADDSLLEQANNAIGDYFADRQKWLNAVQYYVQGRNQERLAECYYMLEDYEGLENLAISLPENHKLLPEIAQMFVRVGMCEQAVTAFLKCSQPKAAVDTCVHLNQWNKAVELAKNHSMKEIGSLLARYASHLLEKNKTLDAIELYRKANYFFDAAKLMFKIADEEAKKGSKPLRVKKLYVLSALLIEQYHEQMKNAQRGKVKGKSSEATSALAGLLEEEVLSTTDRFTDNAWRGAEAYHFFILAQRQLYEGCVDTALKTALHLKDYEDIIPPVEIYSLLALCACASRAFGTCSKAFIKLKSLETLSSEQKQQYEDLALEIFTKHTSKDNRKPELDSLMEGGEGKLPTCVATGSPITEYQFWMCSVCKHGVLAQEISHYSFCPLCHSPVG

SEQ ID NO: 97319 - protein, 1181 aa, Homo sapiens
  Payload ID: 19415
  Gene Name: WD repeat domain 35
  Uniprot ID: Q9P2L0
  ENSP ID: ENSP00000314444
MFFYLSKKISIPNNVKLQCVSWNKEQGFIACGGEDGLLKVLKLETQTDDAKLRGLAAPSNLSMNQTLEGHSGSVQVVTWNEQYQKLTTSDENGLIIVWMLYKGSWIEEMINNRNKSVVRSMSWNADGQKICIVYEDGAVIVGSVDGNRIWGKDLKGIQLSHVTWSADSKVLLFGMANGEIHIYDNQGNFMIKMKLSCLVNVTGAISIAGIHWYHGTEGYVEPDCPCLAVCFDNGRCQIMRHENDQNPVLIDTGMYVVGIQWNHMGSVLAVAGFQKAAMQDKDVNIVQFYTPFGEHLGTLKVPGKEISALSWEGGGLKIALAVDSFIYFANIRPNYKWGYCSNTVVYAYTRPDRPEYCVVFWDTKNNEKYVKYVKGLISITTCGDFCILATKADENHPQEENEMETFGATFVLVLCNSIGTPLDPKYIDIVPLFVAMTKTHVIAASKEAFYTWQYRVAKKLTALEINQITRSRKEGRERIYHVDDTPSGSMDGVLDYSKTIQGTRDPICAITASDKILIVGRESGTIQRYSLPNVGLIQKYSLNCRAYQLSLNCNSSRLAIIDISGVLTFFDLDARVTDSTGQQVVGELLKLERRDVWDMKWAKDNPDLFAMMEKTRMYVFRNLDPEEPIQTSGYICNFEDLEIKSVLLDEILKDPEHPNKDYLINFEIRSLRDSRALIEKVGIKDASQFIEDNPHPRLWRLLAEAALQKLDLYTAEQAFVRCKDYQGIKFVKRLGKLLSESMKQAEVVGYFGRFEEAERTYLEMDRRDLAIGLRLKLGDWFRVLQLLKTGSGDADDSLLEQANNAIGDYFADRQKWLNAVQYYVQGRNQERLAECYYMLEDYEGLENLAISLPENHKLLPEIAQMFVRVGMCEQAVTAFLKCSQPKAAVDTCVHLNQWNKAVELAKNHSMKEIGSLLARYASHLLEKNKTLDAIELYRKANYFFDAAKLMFKIADEEAKKGSKPLRVKKLYVLSALLIEQYHEQMKNAQRGKVKGKSSEATSALAGLLEEEVLSTTDRFTDNAWRGAEAYHFFILAQRQLYEGCVDTALKTALHLKDYEDIIPPVEIYSLLALCACASRAFGTCSKAFIKLKSLETLSSEQKQQYEDLALEIFTKHTSKDNRKPELDSLMEGGEGKLPTCVATGSPITEYQFWMCSVCKHGVLAQEISHYSFCPLCHSPVG

SEQ ID NO: 97320 - protein, 250 aa, Homo sapiens
  Payload ID: 19415
  Gene Name: WD repeat domain 35
  ENSP ID: ENSP00000390105
  MOD_RES (1)..(1): Any amino acid
XGIQLSHVTWSADSKVLLFGMANGEIHIYDNQGNFMIKMKLSCLVNVTGAISIAGIHWYHGTEGYVEPDCPCLAVCFDNGRCQIMRHENDQNPVLIDTGMYVVGIQWNHMGSVLAVAGFQKAAMQDKDVNIVQFYTPFGEHLGTLKVPGKEISALSWEGGGLKIALAVDSFIYFANIRPNYKWGYCSNTVVYAYTRPDRPEYCVVFWDTKNNEKYVKYVKGLISITTCGDFCILATKADENHPQYHCLLQ

SEQ ID NO: 97321 - protein, 873 aa, Homo sapiens
  Payload ID: 19415
  Gene Name: WD repeat domain 35
  ENSP ID: ENSP00000390802
MFFYLSKKISIPNNVKLQCVSWNKEQGFIACGGEDGLLKVLKLETQTDDAKLRGLAAPSNLSMNQTLEGHSGSVQVVTWNEQYQKLTTSDENGLIIVWMLYKGSWIEEMINNRNKSVVRSMSWNADGQKICIVYEDGAVIVGSVDGNRIWGKDLKGIQLSHVTWSADSKVLLFGMANGEIHIYDNQGNFMIKMKLSCLVNVTGAISIAGIHWYHGTEGYVEPDCPCLAVCFDNGRCQIMRHENDQNPVLIDTGMYVVGIQWNHMGSVLAVAGFQKAAMQDKDVNIVQFYTPFGEHLGTLKVPGKEISALSWEGGGLKIALAVDSFIYFANIRPNYKWGYCSNTVVYAYTRPDRPEYCVVFWDTKNNEKYVKYVKGLISITTCGDFCILATKADENHPQEENEMETFGATFVLVLCNSIGTPLDPKYIDIVPLFVAMTKTHVIAASKEAFYTWQYRVAKKLTALEINQITRSRKEGRERIYHVDDTPSGSMDGVLDYSKTIQGTRDPICAITASDKILIVGRESGTIQRYSLPNVGLIQKYSLNCRAYQLSLNCNSSRLAIIDISGVLTFFDLDARVTDSTGQQVVGELLKLERRDVWDMKWAKDNPDLFAMMEKTRMYVFRNLDPEEPIQTSGYICNFEDLEIKSVLLDEILKDPEHPNKDYLINFEIRSLRDSRALIEKVGIKDASQFIEDNPHPRLWRLLAEAALQKLDLYTAEQAFVRCKDYQGIKFVKRLGKLLSESMKQAEVVGYFGRFEEAERTYLEMDRRDLAIGLRLKLGDWFRVLQLLKTGSGDADDSLLEQANNAIGDYFADRQKWLNAVQYYVQGRNQERLAECYYMLEDYEGLENLAISLPENHKLLPVGNSTNVCQSWNV

SEQ ID NO: 97322 - protein, 406 aa, Homo sapiens
  Payload ID: 19415
  Gene Name: WD repeat domain 35
  ENSP ID: ENSP00000404409
NQITRSRKEGRERIYHVDDTPSGSMDGVLDYSKTIQGTRDPICAITASDKILIVGRESGTIQRYSLPNVGLIQKYSLNCRAYQLSLNCNSSRLAIIDISGVLTFFDLDARVTDSTGQQVVGELLKLERRDVWDMKWAKDNPDLFAMMEKTRMYVFRNLDPEEPIQTSGYICNFEDLEIKSVLLDEILKDPEHPNKDYLINFEIRSLRDSRALIEKVGIKDASQFIEDNPHPRLWRLLAEAALQKLDLYTAEQAFVRCKDYQGIKFVKRLGKLLSESMKQAEVVGYFGRFEEAERTYLEMDRRDLAIGLRLKLGDWFRVLQLLKTGSGDADDSLLEQANNAIGDYFADRQKWLNAVQYYVQGRNQERLAECYYMLEDYEGLENLAISLPENHKLLPVGIANFSFWNC

SEQ ID NO: 97323 - protein, 951 aa, Homo sapiens
  Payload ID: 19416
  Gene Name: WD repeat domain 36
  Uniprot ID: Q8NI36
  ENSP ID: ENSP00000423067
MCCTEGSLRKRDSQRAPEAVLCLQLWQRTVPLDTLKGLGTCFPSGPELRGAGIAAAMERASERRTASALFAGFRALGLFSNDIPHVVRFSALKRRFYVTTCVGKSFHTYDVQKLSLVAVSNSVPQDICCMAADGRLVFAAYGNVFSAFARNKEIVHTFKGHKAEIHFLQPFGDHIISVDTDGILIIWHIYSEEEYLQLTFDKSVFKISAILHPSTYLNKILLGSEQGSLQLWNVKSNKLLYTFPGWKVGVTALQQAPAVDVVAIGLMSGQVIIHNIKFNETLMKFRQDWGPITSISFRTDGHPVMAAGSPCGHIGLWDLEDKKLINQMRNAHSTAIAGLTFLHREPLLVTNGADNALRIWIFDGPTGEGRLLRFRMGHSAPLTNIRYYGQNGQQILSASQDGTLQSFSTVHEKFNKSLGHGLINKKRVKRKGLQNTMSVRLPPITKFAAEEARESDWDGIIACHQGKLSCSTWNYQKSTIGAYFLKPKELKKDDITATAVDITSCGNFAVIGLSSGTVDVYNMQSGIHRGSFGKDQAHKGSVRGVAVDGLNQLTVTTGSEGLLKFWNFKNKILIHSVSLSSSPNIMLLHRDSGILGLALDDFSISVLDIETRKIVREFSGHQGQINDMAFSPDGRWLISAAMDCSIRTWDLPSGCLIDCFLLDSAPLNVSMSPTGDFLATSHVDHLGIYLWSNISLYSVVSLRPLPADYVPSIVMLPGTCQTQDVEVSEETVEPSDELIEYDSPEQLNEQLVTLSLLPESRWKNLLNLDVIKKKNKPKEPPKVPKSAPFFIPTIPGLVPRYAAPEQNNDPQQSKVVNLGVLAQKSDFCLKLEEGLVNNKYDTALNLLKESGPSGIETELRSLSPDCGGSIEVMQSFLKMIGMMLDRKRDFELAQAYLALFLKLHLKMLPSEPVLLEEITNLSSQVEENWTHLQSLFNQSMCILNYLKSALL

SEQ ID NO: 97324 - protein, 895 aa, Homo sapiens
  Payload ID: 19416
  Gene Name: WD repeat domain 36
  ENSP ID: ENSP00000424628
MERASERRTASALFAGFRALGLFSNDIPHVVRFSALKRRFYVTTCVGKSFHTYDVQKLSLVAVSNSVPQDICCMAADGRLVFAAYGNVFSAFARNKEIVHTFKGHKAEIHFLQPFGDHIISVDTDGILIIWHIYSEEEYLQLTFDKSVFKISAILHPSTYLNKILLGSEQGSLQLWNVKSNKLLYTFPGWKVGVTALQQAPAVDVVAIGLMSGQVIIHNIKFNETLMKFRQDWGPITSISFRTDGHPVMAAGSPCGHIGLWDLEDKKLINQMRNAHSTAIAGLTFLHREPLLVTNGADNALRIWIFDGPTGEGRLLRFRMGHSAPLTNIRYYGQNGQQILSASQDGTLQSFSTVHEKFNKSLGHGLINKKRVKRKGLQNTMSVRLPPITKFAAEEARESDWDGIIACHQGKLSCSTWNYQKSTIGAYFLKPKELKKDDITATAVDITSCGNFAVIGLSSGTVDVYNMQSGIHRGSFGKDQAHKGSVRGVAVDGLNQLTVTTGSEGLLKFWNFKNKILIHSVSLSSSPNIMLLHRDSGILGLALDDFSISVLDIETRKIVREFSGHQGQINDMAFSPDGRWLISAAMDCSIRTWDLPSGCLIDCFLLDSAPLNVSMSPTGDFLATSHVDHLGIYLWSNISLYSVVSLRPLPADYVPSIVMLPGTCQTQDVEVSEETVEPSDELIEYDSPEQLNEQLVTLSLLPESRWKNLLNLDVIKKKNKPKEPPKVPKSAPFFIPTIPGLVPRYAAPEQNNDPQQSKVVNLGVLAQKSDFCLKLEEGLVNNKYDTALNLLKESGPSGIETELRSLSPDCGGSIEVMQSFLKMIGMMLDRKRDFELAQAYLALFLKLHLKMLPSEPVLLEEITNLSSQVEENWTHLQSLFNQSMCILNYLKSALL

SEQ ID NO: 97325 - protein, 951 aa, Homo sapiens; identical to SEQ ID NO: 97323
  Payload ID: 19416
  Gene Name: WD repeat domain 36
  Uniprot ID: Q8NI36
  ENSP ID: ENSP00000479950

SEQ ID NO: 97326 - protein, 494 aa, Homo sapiens
  Payload ID: 19417
  Gene Name: WD repeat domain 37
  Uniprot ID: Q9Y2I8
  ENSP ID: ENSP00000263150
MPTESASCSTARQTKQKRKSHSLSIRRTNSSEQERTGLPRDMLEGQDSKLPSSVRSTLLELFGQIEREFENLYIENLELRREIDTLNERLAAEGQAIDGAELSKGQLKTKASHSTSQLSQKLKTTYKASTSKIVSSFKTTTSRAACQLVKEYIGHRDGIWDVSVAKTQPVVLGTASADHTALLWSIETGKCLVKYAGHVGSVNSIKFHPSEQLALTASGDQTAHIWRYAVQLPTPQPVADTSISGEDEVECSDKDEPDLDGDVSSDCPTIRVPLTSLKSHQGVVIASDWLVGGKQAVTASWDRTANLYDVETSELVHSLTGHDQELTHCCTHPTQRLVVTSSRDTTFRLWDFRDPSIHSVNVFQGHTDTVTSAVFTVGDNVVSGSDDRTVKVWDLKNMRSPIATIRTDSAINRINVCVGQKIIALPHDNRQVRLFDMSGVRLARLPRSSRQGHRRMVCCSAWSEDHPVCNLFTCGFDRQAIGWNINIPALLQEK

SEQ ID NO: 97327 - protein, 494 aa, Homo sapiens; identical to SEQ ID NO: 97326
  Payload ID: 19417
  Gene Name: WD repeat domain 37
  Uniprot ID: Q9Y2I8
  ENSP ID: ENSP00000350954

SEQ ID NO: 97328 - protein, 249 aa, Homo sapiens
  Payload ID: 19417
  Gene Name: WD repeat domain 37
  ENSP ID: ENSP00000370730
MPTESASCSTARQTKQKRKSHSLSIRRTNSSEQERTGLPRDMLEGQDSKLPSSVRSTLLELFGQIEREFENLYIENLELRREIDTLNERLAAEGQAIDGAELSKGQLKTKASHSTSQLSQKLKTTYKASTSKIVSSFKTTTSRAACQLVKEYIGHRDGIWDVSVAKTQPVVLGTASADHTALLWSIETGKCLVKYAGHVGSVNSIKFHPSEQLALTASGDQTAHIWRYAVQLPTPQPVADTSVSTFPYL

SEQ ID NO: 97329 - protein, 209 aa, Homo sapiens
  Payload ID: 19417
  Gene Name: WD repeat domain 37
  ENSP ID: ENSP00000404346
MSSDSEWDRSACSDSKLPSSVRSTLLELFGQIEREFENLYIENLELRREIDTLNERLAAEGQAIDGAELSKGQLKTKASHSTSQLSQKLKTTYKASTSKIVSSFKTTTSRAACQLVKEYIGHRDGIWDVSVAKTQPVVLGTASADHTALLWSIETGKCLVKYAGHVGSVNSIKFHPSEQLALTASGDQTAHIWRYAVQLPTPQPVADTS

SEQ ID NO: 97330 - protein, 263 aa, Homo sapiens
  Payload ID: 19417
  Gene Name: WD repeat domain 37
  ENSP ID: ENSP00000478057
MPTESASCSTARQTKQKRKSHSLSIRRTNSSEQERTGLPRDMLEGQDSKLPSSVRSTLLELFGQIEREFENLYIENLELRREIDTLNERLAAEGQAIDGAELSKGQLKTKASHSTSQLSQKLKTTYKASTSKIVSSFKTTTSRAACQLVKEYIGHRDGIWDVSVAKTQPVVLGTASADHTALLWSIETGKCLVKYAGHVGSVNSIKFHPSEQLALTASGDQTAHIWRYAVQLPTPQPVADTSVSTFPYLMCRMLMSANLRIHL

SEQ ID NO: 97331 - protein, 314 aa, Homo sapiens
  Payload ID: 19418
  Gene Name: WD repeat domain 38
  Uniprot ID: Q5JTN6
  ENSP ID: ENSP00000362677
MNSGVPATLAVRRVKFFGQHGGEVNSSAFSPDGQMLLTGSEDGCVYGWETRSGQLLWRLGGHTGPVKFCRFSPDGHLFASASCDCTVRLWDVARAKCLRVLKGHQRSVETVSFSPDSRQLASGGWDKRVMLWDVQSGQMLRLLVGHRDSIQSSDFSPTVNCLATGSWDSTVHIWDLRMVTPAVSHQALEGHSANISCLCYSASGLLASGSWDKTIHIWKPTTSSLLIQLKGHVTWVKSIAFSPDELWLASAGYSRMVKVWDCNTGKCLETLKGVLDVAHTCAFTPDGKILVSGAADQTRRQISRTSKSPRDPQT

SEQ ID NO: 97332 - protein, 315 aa, Homo sapiens
  Payload ID: 19418
  Gene Name: WD repeat domain 38
  ENSP ID: ENSP00000483312
MNSGVPATLAVRRVKFFGQHGGEVNSSAFSPDGQMLLTGSEDGCVYGWETRSGQLLWRLGGHTGPVKFCRFSPDGHLFASASCDCTVRLWDVARAKCLRVLKGHQRSVETVSFSPDSRQLASGGWDKRVMLWDVQSGQMLRLLVGHRDSIQSSDFSPTVNCLATGSWDSTVHIWDLRMVTPAVSHQALEGHSANISCLCYSASGLLASGSWDKTIHIWKPTTSSLLIQLKGHVTWVKSIAFSPDELWLASAGYSRMVKVWDCNTGKCLETLKQGVLDVAHTCAFTPDGKILVSGAADQTRRQISRTSKSPRDPQT

SEQ ID NO: 97333 - protein, 266 aa, Homo sapiens
  Payload ID: 19418
  Gene Name: WD repeat domain 38
  ENSP ID: ENSP00000483432
MARCCSQAQKMAACMAGRPGVGSCCGGWVATQMVLCPVSRHLSTFPDPGLVPAGHQRSVETVSFSPDSRQLASGGWDKRVMLWDVQSGQMLRLLVGHRDSIQSSDFSPTVNCLATGSWDSTVHIWDLRMVTPAVSHQALEGHSANISCLCYSASGLLASGSWDKTIHIWKPTTSSLLIQLKGHVTWVKSIAFSPDELWLASAGYSRMVKVWDCNTGKCLETLKQGVLDVAHTCAFTPDGKILVSGAADQTRRQISRTSKSPRDPQT

SEQ ID NO: 97334 - protein, 412 aa, Homo sapiens
  Payload ID: 19419
  Gene Name: WD repeat domain 4
  Uniprot ID: P57081
  ENSP ID: ENSP00000328671
MAGSVGLALCGQTLVVRGGSRFLATSIASSDDDSLFIYDCSAAEKKSQENKGEDAPLDQGSGAILASTFSKSGSYFALTDDSKRLILFRTKPWQCLSVRTVARRCTALTFIASEEKVLVADKSGDVYSFSVLEPHGCGRLELGHLSMLLDVAVSPDDRFILTADRDEKIRVSWAAAPHSIESFCLGHTEFVSRISVVPTQPGLLLSSSGDGTLRLWEYRSGRQLHCCHLASLQELVDPQAPQKFAASRIAFWCQENCVALLCDGTPVVYIFQLDARRQQLVYRQQLAFQHQVWDVAFEETQGLWVLQDCQEAPLVLYRPVGDQWQSVPESTVLKKVSGVLRGNWAMLEGSAGADASFSSLYKATFDNVTSYLKKKEERLQQQLEKKQRRRSPPPGPDGHAKKMRPGEATLSC

SEQ ID NO: 97335 - protein, 412 aa, Homo sapiens; identical to SEQ ID NO: 97334
  Payload ID: 19419
  Gene Name: WD repeat domain 4
  Uniprot ID: P57081
  ENSP ID: ENSP00000381266

SEQ ID NO: 97336 - protein, 459 aa, Homo sapiens
  Payload ID: 19420
  Gene Name: WD repeat domain 41
  Uniprot ID: Q9HAD4
  ENSP ID: ENSP00000296679
MLRWLIGGGREPQGLAEKSPLQTIGEEQTQNPYTELLVLKAHHDIVRFLVQLDDYRFASAGDDGIVVVWNAQTGEKLLELNGHTQKITAIITFPSLESCEEKNQLILTASADRTVIVWDGDTTRQVQRISCFQSTVKCLTVLQRLDVWLSGGNDLCVWNRKLDLLCKTSHLSDTGISALVEIPKNCVVAAVGKELIIFRLVAPTEGSLEWDILEVKRLLDHQDNILSLINVNDLSFVTGSHVGELIIWDALDWTMQAYERNFWDPSPQLDTQQEIKLCQKSNDISIHHFTCDEENVFAAVGRGLYVYSLQMKRVIACQKTAHDSNVLHVARLPNRQLISCSEDGSVRIWELREKQQLAAEPVPTGFFNMWGFGRVSKQASQPVKKQQENATSCSLELIGDLIGHSSSVEMFLYFEDHGLVTCSADHLIILWKNGERESGLRSLRLFQKLEENGDLYLAV

SEQ ID NO: 97337 - protein, 194 aa, Homo sapiens
  Payload ID: 19420
  Gene Name: WD repeat domain 41
  ENSP ID: ENSP00000392931
MLRWLIGGGREPQGLAEKSPLQTIGEEQTQNPYTELLVLKAHHDIVRFLVQLDDYRFASAGDDGIVVVWNAQTGEKLLELNGHTQKITAIITFPSLESCEEKNQLILTASADRTVIVWDGDTTRQVQRISCFQSTVKCLTVLQRLDVWLSGGNDLCVWNRKLDLLCKTSHLSDTGISALVEIPKNCVWQQLAKN

SEQ ID NO: 97338 - protein, 27 aa, Homo sapiens
  Payload ID: 19420
  Gene Name: WD repeat domain 41
  ENSP ID: ENSP00000421166
MLRWLIGGGREPQGLAEVNPGNLLYRQ

SEQ ID NO: 97339 - protein, 179 aa, Homo sapiens
  Payload ID: 19420
  Gene Name: WD repeat domain 41
  ENSP ID: ENSP00000422510
MLRWLIGGGREPQGLAETIGEEQTQNPYTELLVLKAHHDIVRFLVQLDDYRFASAGDDGIVVVWNAQTGEKLLELNGHTQKITAIITFPSLESCEEKNQLILTASADRTVIVWDGDTTRQVQRISCFQSTVKCLTVLQRLDVWLSGGNDLCVWNRKLDLLCKTSHLSDTGISALVEIPK

SEQ ID NO: 97340 - protein, 150 aa, Homo sapiens
  Payload ID: 19420
  Gene Name: WD repeat domain 41
  ENSP ID: ENSP00000422922
MHEANCSSPGETGEKSPLQTIGEEQTQNPYTELLVLKAHHDIVRFLVQLDDYRFASAGDDGIVVVWNAQTGEKLLELNGHTQKITAIITFPSLESCEEKNQLILTASADRTVIVWDGDTTRQVQRISCFQSTVKCLTVLQRLDVWLSGGN

SEQ ID NO: 97341 - protein, 61 aa, Homo sapiens
  Payload ID: 19420
  Gene Name: WD repeat domain 41
  ENSP ID: ENSP00000423462
MLRWLIGGGREPQGLAEKSPLQTIGEEQTQNPYTELLVLKAHHDIVRFLVQLDDYRQGKNF

SEQ ID NO: 97342 - protein, 120 aa, Homo sapiens
  Payload ID: 19420
  Gene Name: WD repeat domain 41
  ENSP ID: ENSP00000423540
MLRWLIGGGREPQGLAEKSPLQTIDLSFVTGSHVGELIIWDALDWTMQAYERNFWDPSPQLDTQQEIKLCQKSNDISIHHFTCDEENVFAAVGRGLYVYSLQMKRVIACQKTAHDSNVLH

SEQ ID NO: 97343 - protein, 404 aa, Homo sapiens
  Payload ID: 19420
  Gene Name: WD repeat domain 41
  Uniprot ID: Q9HAD4
  ENSP ID: ENSP00000424287
MLRWLIGGGREPQGLAETGEKLLELNGHTQKITAIITFPSLESCEEKNQLILTASADRTVIVWDGDTTRQVQRISCFQSTVKCLTVLQRLDVWLSGGNDLCVWNRKLDLLCKTSHLSDTGISALVEIPKNCVVAAVGKELIIFRLVAPTEGSLEWDILEVKRLLDHQDNILSLINVNDLSFVTGSHVGELIIWDALDWTMQAYERNFWDPSPQLDTQQEIKLCQKSNDISIHHFTCDEENVFAAVGRGLYVYSLQMKRVIACQKTAHDSNVLHVARLPNRQLISCSEDGSVRIWELREKQQLAAEPVPTGFFNMWGFGRVSKQASQPVKKQQENATSCSLELIGDLIGHSSSVEMFLYFEDHGLVTCSADHLIILWKNGERESGLRSLRLFQKLEENGDLYLAV

SEQ ID NO: 97344 - protein, 151 aa, Homo sapiens
  Payload ID: 19420
  Gene Name: WD repeat domain 41
  ENSP ID: ENSP00000424327
MLRWLIGGGREPQGLAEKSPLQTIGEEQTQNPYTELLVLKAHHDIVRFLVQLDDYRFASAGDDGIVVVWNAQTGEKLLELNGHTQKITAIITFPSLESCEEKNQLILTASADRTVIVWDGDTTRQVQRISCFQSTVKVGSTHRRITRMGYS

SEQ ID NO: 97345 - protein, 157 aa, Homo sapiens
  Payload ID: 19420
  Gene Name: WD repeat domain 41
  ENSP ID: ENSP00000425249
MLRWLIGGGREPQGLAEKSPLQTIGEEQTQNPYTELLVLKAHHDIVRFLVQLDDYRFASAGDDGIVVVWNAQTGEKLLELNGHTQKITAIITFPSLESCEEKNQLILTASADRTVIVWDGDTTRQVQRISCFQSTVKVLVLWLKYLRTVLWQQLAKN

SEQ ID NO: 97346 - protein, 163 aa, Homo sapiens
  Payload ID: 19420
  Gene Name: WD repeat domain 41
  ENSP ID: ENSP00000425563
  MOD_RES (1)..(1): Any amino acid
XISALVEIPKNCVVAAVGKELIIFRLVAPTEGSLEWDILEVKRLLDHQDNILSLINVNDLSFVTGSHVGELIIWDALDWTMQAYERNFWDPSPQLDTQQEIKLCQKSNDISIHHFTCDEENVFAAVGRGLYVYSLQMKRVIACQKTAHDSNVLHVARLPNRFF

SEQ ID NO: 97347 - protein, 66 aa, Homo sapiens
  Payload ID: 19420
  Gene Name: WD repeat domain 41
  ENSP ID: ENSP00000425813
MLRWLIGGGREPQGLAEKSPLQTIGEEQTQNPYTELLVLKAHHDIVRFLVQLDDYSLSSTCCFLTF

SEQ ID NO: 97348 - protein, 150 aa, Homo sapiens
  Payload ID: 19420
  Gene Name: WD repeat domain 41
  ENSP ID: ENSP00000426141
MSQEKDFYKKSPLQTIGEEQTQNPYTELLVLKAHHDIVRFLVQLDDYRFASAGDDGIVVVWNAQTGEKLLELNGHTQKITAIITFPSLESCEEKNQLILTASADRTVIVWDGDTTRQVQRISCFQSTVKCLTVLQRLDVWLSGGNDLCVW

SEQ ID NO: 97349 - protein, 394 aa, Homo sapiens
  Payload ID: 19420
  Gene Name: WD repeat domain 41
  ENSP ID: ENSP00000426499
GGREPQGLAEKSPLQTIGEEQTQNPYTELLVLKAHHDIVRFLVQLDDYRFASAGDDGIVVVWNAQTGEKLLELNGHTQKITAIITFPSLESCEEKNQLILTASADRTVIVWDGDTTRQVQRISCFQSTVKCLTVLQRLDVWLSGGNDLCVWNRKLDLLCKTSHLSDTDLSFVTGSHVGELIIWDALDWTMQAYERNFWDPSPQLDTQQEIKLCQKSNDISIHHFTCDEENVFAAVGRGLYVYSLQMKRVIACQKTAHDSNVLHVARLPNRQLISCSEDGSVRIWELREKQQLAAEPVPTGFFNMWGFGRVSKQASQPVKKQQENATSCSLELIGDLIGHSSSVEMFLYFEDHGLVTCSADHLIILWKNGERESGLRSLRLFQKLEENGDLYLAV

SEQ ID NO: 97350 - protein, 189 aa, Homo sapiens
  Payload ID: 19420
  Gene Name: WD repeat domain 41
  ENSP ID: ENSP00000426937
MLRWLIGGGREPQGLAEKSPLQTIGEEQTQNPYTELLVLKAHHDIVRFLVQLDDYRFASAGDDGIVVVWNAQTGEKLLELNGHTQKITAIITFPSLESCEEKNQLILTASADRTVIVWDGDTTRQVQRISCFQSTVKRLDVWLSGGNDLCVWNRKLDLLCKTSHLSDTGISALVEIPKNCVVAAVGKEL

SEQ ID NO: 97351 - protein, 60 aa, Homo sapiens
  Payload ID: 19420
  Gene Name: WD repeat domain 41
  ENSP ID: ENSP00000427219
  MOD_RES (1)..(1): Any amino acid
XRWLIGGGREPQGLAEKSPLQTIGEEQTQNPYTELLVLKAHHDIVRFLVQLDDYRQGKNF

SEQ ID NO: 97352 - protein, 140 aa, Homo sapiens
  Payload ID: 19420
  Gene Name: WD repeat domain 41
  ENSP ID: ENSP00000427291
MTTDLSFVTGSHVGELIIWDALDWTMQAYERNFWDPSPQLDTQQEIKLCQKSNDISIHHFTCDEENVFAAVGRGLYVYSLQMKRVIACQKTAHDSNVLHVARLPNRQLISCSEDGSVRIWELREKQQLAAEPVPTGFFNM

SEQ ID NO: 97353 - protein, 176 aa, Homo sapiens
  Payload ID: 19420
  Gene Name: WD repeat domain 41
  ENSP ID: ENSP00000427652
MLRWLIGGGREPQGLAEKSPLQTIGEEQTQNPYTELLVLKAHHDIVRFLVQLDDYRFASAGDDGIVVVWNAQTGEKLLELNGHTQKITAIITFPSLESCEEKNQLILTASADRTVIVWDGDTTRQVQRISCFQSTVKCLTVLQRLDVWLSGGNDLCVWNRKLDLLCKTSHLSDTGW

SEQ ID NO: 97354 - protein, 187 aa, Homo sapiens
  Payload ID: 19421
  Gene Name: WD repeat domain 43
  ENSP ID: ENSP00000296126
MLLSAGRTIKLWVLETKEVYRHFTGHATPVSSLMFTTIRPPNESQPFDGITGLYFLSGAVHDRLLNVWQVRSENKEKSAVMSFTVTDEPVYIDLTLSENKEEPVKLAVVCRDGQVHLFEHILNGYCKKPLTSNCTIQIATPGKGKKSTPKPIPILAAGFCSDKMSLLLVYGSWFQPTIERVALNSRE

SEQ ID NO: 97355 - protein, 677 aa, Homo sapiens
  Payload ID: 19421
  Gene Name: WD repeat domain 43
  Uniprot ID: Q15061
  ENSP ID: ENSP00000384302
MAAGGGGSCDPLAPAGVPCAFSPHSQAYFALASTDGHLRVWETANNRLHQEYVPSAHLSGTCTCLAWAPARLQAKESPQRKKRKSEAVGMSNQTDLLALGTAVGSILLYSTVKGELHSKLISGGHDNRVNCIQWHQDSGCLYSCSDDKHIVEWNVQTCKVKCKWKGDNSSVSSLCISPDGKMLLSAGRTIKLWVLETKEVYRHFTGHATPVSSLMFTTIRPPNESQPFDGITGLYFLSGAVHDRLLNVWQVRSENKEKSAVMSFTVTDEPVYIDLTLSENKEEPVKLAVVCRDGQVHLFEHILNGYCKKPLTSNCTIQIATPGKGKKSTPKPIPILAAGFCSDKMSLLLVYGSWFQPTIERVALNSREPHMCLVRDISNCWAPKVETAITKVRTPVMNSEAKVLVPGIPGHHAAIKPAPPQTEQVESKRKSGGNEVSIEERLGAMDIDTHKKGKEDLQTNSFPVLLTQGLESNDFEMLNKVLQTRNVNLIKKTVLRMPLHTIIPLLQELTKRLQGHPNSAVLMVQWLKCVLTVHASYLSTLPDLVPQLGTLYQLMESRVKTFQKLSHLHGKLILLITQVTASEKTKGATSPGQKAKLVYEEESSEEESDDEIADKDSEDNWDEDEEESESEKDEDVEEEDEDAEGKDEENGEDRDTASEKELNGDSDLDPENESEEE

SEQ ID NO: 97356 - protein, 25 aa, Homo sapiens
  Payload ID: 19421
  Gene Name: WD repeat domain 43
  ENSP ID: ENSP00000390363
MSNQTDLLALGTAVGSILLYSTVKG

SEQ ID NO: 97357 - protein, 147 aa, Homo sapiens
  Payload ID: 19421
  Gene Name: WD repeat domain 43
  ENSP ID: ENSP00000415355
MSNQTDLLALGTAVGSILLYSTVKGELHSKLISGGHDNRVNCIQWHQDSGCLYSCSDDKHIVEWNVQTCKVKCKWKGDNSSVSSLCISPDGKMLLSAGRTIKLWVLETKEVYRHFTGHATPVSSLMFTTIRPPNESQPFDGITGLYF

SEQ ID NO: 97358 - protein, 913 aa, Homo sapiens
  Payload ID: 19422
  Gene Name: WD repeat domain 44
  Uniprot ID: Q5JSH3
  ENSP ID: ENSP00000254029
MASESDTEEFYDAPEDVHLGGGYPVGSPGKVGLSTFKETENTAYKVGNESPVQELKQDVSKKIIESIIEESQKVLQLEDDSLDSKGKELSDQATASPIVARTDLSNIPGLLAIDQVLPEESQKAESQNTFEETELELKKCFPSDETCEKPVDETTKLTQTSSTEQLNVLETETEVLNKEAVEVKGGGDVLEPVSSDSLSTKDFAAVEEVAPAKPPRHLTPEPDIVASTKKPVPARPPPPTNFPPPRPPPPSRPAPPPRKRKSELEFETLKTPDIDVPKENITSDSLLTASMASESTVKDSQPSLDLASATSGDKIVTAQENGKAPDGQTVAGEVMGPQRPRSNSGRELTDEEILASVMIKNLDTGEEIPLSLAEEKLPTGINPLTLHIMRRTKEYVSNDAAQSDDEEKLQSQPTDTDGGRLKQKTTQLKKFLGKSVKRAKHLAEEYGERAINKVKSVRDEVFHTDQDDPSSSDDEGMPYTRPVKFKAAHGFKGPYDFDQIKVVQDLSGEHMGAVWTMKFSHCGRLLASAGQDNVVRIWALKNAFDYFNNMRMKYNTEGRVSPSPSQESLSSSKSDTDTGVCSGTDEDPDDKNAPFRQRPFCKYKGHTADLLDLSWSKNYFLLSSSMDKTVRLWHISRRECLCCFQHIDFVTAIAFHPRDDRYFLSGSLDGKLRLWNIPDKKVALWNEVDGQTKLITAANFCQNGKYAVIGTYDGRCIFYDTEHLKYHTQIHVRSTRGRNKVGRKITGIEPLPGENKILVTSNDSRIRLYDLRDLSLSMKYKGYVNSSSQIKASFSHDFTYLVSGSEDKYVYIWSTYHDLSKFTSVRRDRNDFWEGIKAHNAVVTSAIFAPNPSLMLSLDVQSEKSEGNEKSEDAEVLDATPSGIMKTDNTEVLLSADFTGAIKVFVNKRKNVS

SEQ ID NO: 97359 - protein, 824 aa, Homo sapiens
  Payload ID: 19422
  Gene Name: WD repeat domain 44
  Uniprot ID: Q5JSH3
  ENSP ID: ENSP00000360887
MASESDTEEFYDAPEDVHLGGGYPVGSPGKVGLSTFKIIESIIEESQKVLQLEDDSLDSKGKELSDQATASPIVARTDLSNIPGLLAIDQVLPEESQKAESQNTFEETELELKKCFPSDETCEKPVDETTKLTQTSSTEQLNVLETETEVLNKEAVEVKGGGDVLEPVSSDSLSTKDFAAVEEVAPAKPPRHLTPEPDIVASTKKPVPARPPPPTNFPPPRPPPPSRPAPPPRKRKSELEFETLKTPDIDVPKENITSDSLLTASMASESTVKDSQPSLDLASATSGDKIVTAQENGKAPDGQTVAGEVMGPQRPRSNSGRELTDEEILASVMIKNLDTGEEIPLSLAEEKLPTGINPLTLHIMRRTKEYVSNDAAQSDDEEKLQSQPTDTDGGRLKQKTTQLKKFLGKSVKRAKHLAEEYGERAINKVKSVRDEVFHTDQDDPSSSDDEGMPYTRPVKFKAAHGFKGPYDFDQIKVVQDLSGEHMGAVWTMKFSHCGRLLASAGQDNVVRIWALKNAFDYFNNMRMKYNTEGRVSPSPSQESLSSSKSDTDTGVCSGTDEDPDDKNAPFRQRPFCKYKGHTADLLDLSWSKNYFLLSSSMDKTVRLWHISRRECLCCFQHIDFVTAIAFHPRHLKYHTQIHVRSTRGRNKVGRKITGIEPLPGENKILVTSNDSRIRLYDLRDLSLSMKYKGYVNSSSQIKASFSHDFTYLVSGSEDKYVYIWSTYHDLSKFTSVRRDRNDFWEGIKAHNAVVTSAIFAPNPSLMLSLDVQSEKSEGNEKSEDAEVLDATPSGIMKTDNTEVLLSADFTGAIKVFVNKRKNVS

SEQ ID NO: 97360 - protein, 905 aa, Homo sapiens
  Payload ID: 19422
  Gene Name: WD repeat domain 44
  Uniprot ID: Q5JSH3
  ENSP ID: ENSP00000360890
MASESDTEEFYDAPEDVHLGGGYPVGSPGKVGLSTFKETENTAYKVGNESPVQELKQDVSKKIIESIIEESQKVLQLEDDSLDSKGKELSDQATASPIVARTDLSNIPGLLAIDQVLPEESQKAESQNTFEETELELKKCFPSDETCEKPVDETTKLTQTSSTEQLNVLETETEVLNKEAVEVKGGGDVLEPVSSDSLSTKDFAAVEEVAPAKPPRHLTPEPDIVASTKKPVPARPPPPTNFPPPRPPPPSRPAPPPRKRKSELEFETLKTPDIDVPKENITSDSLLTASMASESTVKDSQPSLDLASATSGDKIVTAQENGKAPDGQTVAGEVMGPQRPRSNSGRELTDEEILASVMIKNLDTGEEIPLSLAEEKLPTGINPLTLHIMRRTKEYVSNDAAQSDDEEKLQSQPTDTDGGRLKQKTTQLKKFLGKSVKRAKHLAEEYGERAINKVKSVRDEVFHTDQDDPSSSDDEGMPYTRPVKFKAAHGFKGPYDFDQIKVVQDLSGEHMGAVWTMKFSHCGRLLASAGQDNVVRIWALKNAFDYFNNMRMKYNTEGRVSPSPSQESLSSSKSDTDTGVCSGTDEDPDDKNAPFRQRPFCKYKGHTADLLDLSWSKNYFLLSSSMDKTVRLWHISRRECLCCFQHIDFVTAIAFHPRDDRYFLSGSLDGKLRLWNIPDKKVALWNEVDGQTKLITAANFCQNGKYAVIGTYDGRCIFYDTEHLKYHTQIHVRSTRGRNKVGRKITGIEPLPGENKILVTSNDSRIRLYDLRDLSLSMKYKGYVNSSSQIKASFSGSEDKYVYIWSTYHDLSKFTSVRRDRNDFWEGIKAHNAVVTSAIFAPNPSLMLSLDVQSEKSEGNEKSEDAEVLDATPSGIMKTDNTEVLLSADFTGAIKVFVNKRKNVS

SEQ ID NO: 97361 - protein, 806 aa, Homo sapiens
  Payload ID: 19422
  Gene Name: WD repeat domain 44
  ENSP ID: ENSP00000360914
  MOD_RES (1)..(1): Any amino acid
XTDLSNIPGLLAIDQVLPEESQKAESQNTFEETELELKKCFPSDETCEKPVDETTKLTQTSSTEQLNVLETETEVLNKEAVEVKGGGDVLEPVSSDSLSTKDFAAVEEVAPAKPPRHLTPEPDIVASTKKPVPARPPPPTNFPPPRPPPPSRPAPPPRKRKSELEFETLKTPDIDVPKENITSDSLLTASMASESTVKDSQPSLDLASATSGDKIVTAQENGKAPDGQTVAGEVMGPQRPRSNSGRELTDEEILASVMIKNLDTGEEIPLSLAEEKLPTGINPLTLHIMRRTKEYVSNDAAQSDDEEKLQSQPTDTDGGRLKQKTTQLKKFLGKSVKRAKHLAEEYGERAINKVKSVRDEVFHTDQDDPSSSDDEGMPYTRPVKFKAAHGFKGPYDFDQIKVVQDLSGEHMGAVWTMKFSHCGRLLASAGQDNVVRIWALKNAFDYFNNMRMKYNTEGRVSPSPSQESLSSSKSDTDTGVCSGTDEDPDDKNAPFRQRPFCKYKGHTADLLDLSWSKNYFLLSSSMDKTVRLWHISRRECLCCFQHIDFVTAIAFHPRDDRYFLSGSLDGKLRLWNIPDKKVALWNEVDGQTKLITAANFCQNGKYAVIGTYDGRCIFYDTEHLKYHTQIHVRSTRGRNKVGRKITGIEPLPGENKILVTSNDSRIRLYDLRDLSLSMKYKGYVNSSSQIKASFSHDFTYLVSGSEDKYVYIWSTYHDLSKFTSVRRDRNDFWEGIKAHNAVVTSAIFAPNPSLMLSLDVQSEKSEGNEKSEDAEVLDATPSAMSSRYVAQAGLELLASKRYYEDR

SEQ ID NO: 97362 - protein, 361 aa, Homo sapiens
  Payload ID: 19423
  Gene Name: WD repeat domain 45
  Uniprot ID: Q9Y484
  ENSP ID: ENSP00000348848
MTQQPLRGVTSLRFNQDQSCFCCAMETGVRIYNVEPLMEKGHLDHEQVGSMGLVEMLHRSNLLALVGGGSSPKFSEISAVLIWDDAREGKDSKEKLVLEFTFTKPVLSVRMRHDKIVIVLKNRIYVYSFPDNPRKLFEFDTRDNPKGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSALARVGKVGPMIGQYVDSQWSLASFTVPAESACICAFGRNTSKNVNSVIAICVDGTFHKYVFTPDGNCNREAFDVYLDICDDDDF

SEQ ID NO: 97363 - protein, 287 aa, Homo sapiens
  Payload ID: 19423
  Gene Name: WD repeat domain 45
  ENSP ID: ENSP00000356345
  MOD_RES (1)..(1): Any amino acid
XHEQVGSMGLVEMLHRSNLLALVGGGSSPKFSEISVLIWDDAREGKDSKEKLVLEFTFTKPVLSVRMRHDKIVIVLKNRIYVYSFPDNPRKLFEFDTRDNPKGLCDLCPSLEKQLLVFPGHKCGSLQLVPGTVVASASQKGTLIRLFDTQSKEKLVELRRGTDPATLYCINFSHDSSFLCASSDKGTVHIFALKDTRLNRRSALARVGKVGPMIGQYVDSQWSLASFTVPAESACICAFGRNTSKNVNSVIAICVDGTFHKYVFTPDGNCNREAFDVYLDICDDDDF

SEQ ID NO: 97364 - protein, 292 aa, Homo sapiens
  Payload ID: 19423
  Gene Name: WD repeat domain 45
  ENSP ID: ENSP00000365536
MTQQPLRGVTSLRFNQDQSCFCCAMETGVRIYNVEPLMEKGHLGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSAYVRPLHTLLSALVVAVALGVLVWAAETRAAVRRCRRSHPAACLAAVLAVGLLVLWVAGGACTFLFSIAGPVLLILVHASLRLRNLKNKIENKIESIGLKRTPMGLLLEALGQEQEAGS

SEQ ID NO: 97365 - protein, 371 aa, Homo sapiens
  Payload ID: 19423
  Gene Name: WD repeat domain 45
  Uniprot ID: Q9Y484
  ENSP ID: ENSP00000365543
MTQQPLRGVTSLRFNQDQSCFCCAMETGVRIYNVEPLMEKGHLDHEQVGSMGLVEMLHRSNLLALVGGGSSPKFSEISVLIWDDAREGKDSKEKLVLEFTFTKPVLSVRMRHDKIVIVLKNRIYVYSFPDNPRKLFEFDTRDNPKAAHPTPHLHTLGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSALARVGKVGPMIGQYVDSQWSLASFTVPAESACICAFGRNTSKNVNSVIAICVDGTFHKYVFTPDGNCNREAFDVYLDICDDDDF

SEQ ID NO: 97366 - protein, 361 aa, Homo sapiens; identical to SEQ ID NO: 97362
  Payload ID: 19423
  Gene Name: WD repeat domain 45
  Uniprot ID: Q9Y484
  ENSP ID: ENSP00000365546

SEQ ID NO: 97367 - protein, 360 aa, Homo sapiens
  Payload ID: 19423
  Gene Name: WD repeat domain 45
  Uniprot ID: Q9Y484
  ENSP ID: ENSP00000365551
MTQQPLRGVTSLRFNQDQSCFCCAMETGVRIYNVEPLMEKGHLDHEQVGSMGLVEMLHRSNLLALVGGGSSPKFSEISVLIWDDAREGKDSKEKLVLEFTFTKPVLSVRMRHDKIVIVLKNRIYVYSFPDNPRKLFEFDTRDNPKGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSALARVGKVGPMIGQYVDSQWSLASFTVPAESACICAFGRNTSKNVNSVIAICVDGTFHKYVFTPDGNCNREAFDVYLDICDDDDF

SEQ ID NO: 97368 - protein, 321 aa, Homo sapiens
  Payload ID: 19423
  Gene Name: WD repeat domain 45
  ENSP ID: ENSP00000379913
MTQQPLRGVTSLRFNQDQSCFCCAMETGVRIYNVEPLMEKGHLVLIWDDAREGKDSKEKLVLEFTFTKPVLSVRMRHDKIVIVLKNRIYVYSFPDNPRKLFEFDTRDNPKGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCHDSSFLCASSDKGTVHIFALKDTRLNRRSALARVGKVGPMIGQYVDSQWSLASFTVPAESACICAFGRNTSKNVNSVIAICVDGTFHKYVFTPDGNCNREAFDVYLDICDDDDF

SEQ ID NO: 97369 - protein, 208 aa, Homo sapiens
  Payload ID: 19423
  Gene Name: WD repeat domain 45
  ENSP ID: ENSP00000393640
MTQQPLRGVTSLRFNQDQSCFCCAMETGVRIYNVEPLMEKGHLDHEQVGSMGLVEMLHRSNLLALVGGGSSPKFSEISVLIWDDAREGKDSKEKLVLEFTFTKPVLSVRMRHDKIVIVLKNRIYVYSFPDNPRKLFEFDTRDNPKGERAQIHRWLCDLCPSLEKQLLVFPGHKCGSLQLVDLASTKPGTSSAPFTINAHQSDIACVSL

SEQ ID NO: 97370 - protein, 194 aa, Homo sapiens
  Payload ID: 19423
  Gene Name: WD repeat domain 45
  ENSP ID: ENSP00000397657
MTQQPLRGVTSLRFNQDQSCFCCAMETGVRIYNVEPLMEKGHLDHEQVGSMGLVEMLHRSNLLALVGGGSSPKFSEISGLPLTLNLGPDNPPTCPAVLIWDDAREGKDSKEKLVLEFTFTKPVLSVRMRHDKIVIVLKNRIYVYSFPDNPRKLFEFDTRDNPKGLCDLCPSLEKQLLVFPGHKCGSLQLVDLAS

SEQ ID NO: 97371 - protein, 256 aa, Homo sapiens
  Payload ID: 19423
  Gene Name: WD repeat domain 45
  ENSP ID: ENSP00000417211
MTQQPLRGVTSLRFNQDQSCFCCAMETGVRIYNVEPLMEKGHLDHEQVGSMGLVEMLHRSNLLALVGGGSSPKFSEISVLIWDDAREGKDSKEKLVLEFTFTKPVLSVRMRHDKIVIVLKNRIYVYSFPDNPRKLFEFDTRDNPKGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCHLRRWDLPQICLHS

SEQ ID NO: 97372 - protein, 122 aa, Homo sapiens
  Payload ID: 19423
  Gene Name: WD repeat domain 45
  ENSP ID: ENSP00000417754
LQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSAHLRRWDLPQICLHS

SEQ ID NO: 97373 - protein, 175 aa, Homo sapiens
  Payload ID: 19423
  Gene Name: WD repeat domain 45
  ENSP ID: ENSP00000418466
MTQQPLRGVTSLRFNQDQSCFCCAMETGVRIYNVEPLMEKGHLDHEQVGSMGLVEMLHRSNLLALVGGGSSPKFSEISVLIWDDAREGKDSKEKLVLEFTFTKPVLSVRMRHDKIVIVLKNRIYVYSFPDNPRKLFEFDTRDNPKGLCDLCPSLEKQLLVFPGHKCGSLQLVDLA

SEQ ID NO: 97374 - protein, 241 aa, Homo sapiens
  Payload ID: 19423
  Gene Name: WD repeat domain 45
  ENSP ID: ENSP00000418919
MTQQPLRGVTSLRFNQDQSCFCCAMETGVRIYNVEPLMEKGHLAVLIWDDAREGKDSKEKLVLEFTFTKPVLSVRMRHDKIVIVLKNRIYVYSFPDNPRKLFEFDTRDNPKGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRS

SEQ ID NO: 97375 - protein, 138 aa, Homo sapiens
  Payload ID: 19423
  Gene Name: WD repeat domain 45
  ENSP ID: ENSP00000419324
MTQQPLRGVTSLRFNQDQSCFCCAMETGVRIYNVEPLMEKGHLVLIWDDAREGKDSKEKLVLEFTFTKPVLSVRMRHDKIVIVLKNRIYVYSFPDNPRKLFEFDTRDNPKAAHPTPHLHTLGLCDLCPSLEKQLLVFP

SEQ ID NO: 97376 - protein, 86 aa, Homo sapiens
  Payload ID: 19423
  Gene Name: WD repeat domain 45
  ENSP ID: ENSP00000419453
  MOD_RES (1)..(1): Any amino acid
XNRRSALARVGKVGPMIGQYVDSQWSLASFTVPAESACICAFGRNTSKNVNSVIDGTFHKYVFTPDGNCNREAFDVYLDICDDDDF

SEQ ID NO: 97377 - protein, 325 aa, Homo sapiens
  Payload ID: 19423
  Gene Name: WD repeat domain 45
  ENSP ID: ENSP00000419897
MTQQPLRGVTSLRFNQDQSCFCCAMETGVRIYNVEPLMEKGHLVLIWDDAREGKDSKEKLVLEFTFTKPVLSVRMRHDKIVIVLKNRIYVYSFPDNPRKLFEFDTRDNPKGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSALARVGKVGPMIGQYVDSQWSLASFTVPAESACICAFGRNTSKNVNSVIAICVDGTFHKYVFTPDGNCNREAFDVYLDICDDDDF

SEQ ID NO: 97378 - protein, 158 aa, Homo sapiens
  Payload ID: 19423
  Gene Name: WD repeat domain 45
  ENSP ID: ENSP00000420534
MTQQPLRGVTSLRFNQDQSCFCCAMETGVRIYNVEPLMEKGHLDHEQVGSMGLVEMLHRSNLLALVGGGSSPKFSEISVLIWDDAREGKDSKEKLVLEFTFTKPVLSVRMRHDKIVIVLKNRIYVYSFPDNPRKLFEFDTRDNPKAAHPTPHLHTLGL

SEQ ID NO: 97379 - protein, 213 aa, Homo sapiens
  Payload ID: 19423
  Gene Name: WD repeat domain 45
  ENSP ID: ENSP00000420728
MTQQPLRGVTSLRFNQDQSCFCCAMETGVRIYNVEPLMEKGHLDHEQVGSMGLVEMLHRSNLLALVGGGSSPKFSEISGVDPVSPGLPLTLNLGPDNPPTCPAVLIWDDAREGKDSKEKLVLEFTFTKPVLSVRMRHDKIVIVLKNRIYVYSFPDNPRKLFEFDTRDNPKGLCDLCPSLEKQLLVFPGHKCGSLQLVDLASTKPGTSSAPFTI

SEQ ID NO: 97380 - protein, 360 aa, Homo sapiens; identical to SEQ ID NO: 97367
  Payload ID: 19423
  Gene Name: WD repeat domain 45
  ENSP ID: ENSP00000488972

SEQ ID NO: 97381 - protein, 289 aa, Homo sapiens
  Payload ID: 19423
  Gene Name: WD repeat domain 45
  ENSP ID: ENSP00000488986
MTQQPLRGVTSLRFNQDQSCFCCAMETGVRIYNVEPLMEKGHLDHEQVGSMGLVEMLHRSNLLALVGGGSSPKFSEISGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCHDSSFLCASSDKGTVHIFALKDTRLNRRSALARVGKVGPMIGQYVDSQWSLASFTVPAESACICAFGRNTSKNVNSVIAICVDGTFHKYVFTPDGNCNREAFDVYLDICDDDDF

SEQ ID NO: 97382 - protein, 59 aa, Homo sapiens
  Payload ID: 19423
  Gene Name: WD repeat domain 45
  ENSP ID: ENSP00000489040
MTQQPLRGVTSLRFNQDQSCFCCAMETDHEQVGSMGLVEMLHRSNLLALVGGGSSPKFS

SEQ ID NO: 97383 - protein, 293 aa, Homo sapiens
  Payload ID: 19423
  Gene Name: WD repeat domain 45
  ENSP ID: ENSP00000489080
MTQQPLRGVTSLRFNQDQSCFCCAMETGVRIYNVEPLMEKGHLDHEQVGSMGLVEMLHRSNLLALVGGGSSPKFSEISGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSALARVGKVGPMIGQYVDSQWSLASFTVPAESACICAFGRNTSKNVNSVIAICVDGTFHKYVFTPDGNCNREAFDVYLDICDDDDF

SEQ ID NO: 97384 - protein, 276 aa, Homo sapiens
  Payload ID: 19423
  Gene Name: WD repeat domain 45
  ENSP ID: ENSP00000489128
METGVRIYNVEPLMEKGHLDHEQVGSMGLVEMLHRSNLLALVGGGSSPKFSEISVLIWDDAREGKDSKEKLVLEFTFTKPVLSVRMRHDKIVIVLKNRIYVYSFPDNPRKLFEFDTRDNPKGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSAAACRLARVGKVGPMIGQYVDSQWS

SEQ ID NO: 97385 - protein, 162 aa, Homo sapiens
  Payload ID: 19423
  Gene Name: WD repeat domain 45
  ENSP ID: ENSP00000489150
MGQDGCVDTSYLIHIIEEQSCTMTQQPLRGVTSLRFNQDQSCFCCAMETGVRIYNVEPLMEKGHLDHEQVGSMGLVEMLHRSNLLALVGGGSSPKFSEISAVLIWDDAREGKDSKEKLVLEFTFTKPVLSVRMRHDKIVIVLKNRIYVYSFPDNPRKLFEFD

SEQ ID NO: 97386 - protein, 346 aa, Homo sapiens
  Payload ID: 19423
  Gene Name: WD repeat domain 45
  ENSP ID: ENSP00000489268
MTQQPLRGVTSLRFNQDQSCFCCAMETGVRIYNVEPLMEKGHLDHEQVGSMGLVEMLHRSNLLALVGGGSSPKFSEISVLIWDDAREGKDSKEKLVLEFTFTKPVLSVRMRHDKIVIVLKNRIYVYSFPDNPRKLFEFDTRDNPKGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCDKGTVHIFALKDTRLNRRSALARVGKVGPMIGQYVDSQWSLASFTVPAESACICAFGRNTSKNVNSVIAICVDGTFHKYVFTPDGNCNREAFDVYLDICDDDDF

SEQ ID NO: 97387 - protein, 80 aa, Homo sapiens
  Payload ID: 19423
  Gene Name: WD repeat domain 45
  ENSP ID: ENSP00000489330
MTQQPLRGVTSLRFNQDQSCFCCAMETGVRIYNVEPLMEKGHLDHEQVGSMGLVEMLHRSNLLALVGGGSSPKFSEISGS

SEQ ID NO: 97388 - protein, 45 aa, Homo sapiens
  Payload ID: 19423
  Gene Name: WD repeat domain 45
  ENSP ID: ENSP00000489553
MTQQPLRGVTSLRFNQDQSCFCCAMETGVRIYNVEPLMEKGHLGS

SEQ ID NO: 97389 - protein, 196 aa, Homo sapiens
  Payload ID: 19423
  Gene Name: WD repeat domain 45
  ENSP ID: ENSP00000489561
MTQQPLRGVTSLRFNQDQSCFCCAMETGVRIYNVEPLMEKGHLGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSALARVGKVGPMIGQYVDSQWSLA

SEQ ID NO: 97390 - protein, 344 aa, Homo sapiens
  Payload ID: 19424
  Gene Name: WD repeat domain 45B
  Uniprot ID: Q5MNZ6
  ENSP ID: ENSP00000376139
MNLLPCNPHGNGLLYAGFNQDHGCFACGMENGFRVYNTDPLKEKEKQEFLEGGVGHVEMLFRCNYLALVGGGKKPKYPPNKVMIWDDLKKKTVIEIEFSTEVKAVKLRRDRIVVVLDSMIKVFTFTHNPHQLHVFETCYNPKGLCVLCPNSNNSLLAFPGTHTGHVQLVDLASTEKPPVDIPAHEGVLSCIALNLQGTRIATASEKGTLIRIFDTSSGHLIQELRRGSQAANIYCINFNQDASLICVSSDHGTVHIFAAEDPKRNKQSSLASASFLPKYFSSKWSFSKFQVPSGSPCICAFGTEPNAVIAICADGSYYKFLFNPKGECIRDVYAQFLEMTDDKL

SEQ ID NO: 97391 - protein, 174 aa, Homo sapiens
  Payload ID: 19424
  Gene Name: WD repeat domain 45B
  ENSP ID: ENSP00000458738
MNLLPCNPHGNGLLYAGFNQDHGCFACGMENGFRVYNTDPLKEKEKQVMIWDDLKKKTVIEIEFSTEVKAVKLRRDRIVVVLDSMIKVFTFTHNPHQLHVFETCYNPKGLCVLCPNSNNSLLAFPGTHTGHVQLVDLASTEKPPVDIPAHEGVLSCIALNLQGTRIATASEKGI

SEQ ID NO: 97392 - protein, 124 aa, Homo sapiens
  Payload ID: 19424
  Gene Name: WD repeat domain 45B
  ENSP ID: ENSP00000460297
  MOD_RES (1)..(1): Any amino acid
XQELRRGSQAANIYCINFNQDASLICVSSDHGTVHIFAAEDPKRNKQSSLASASFLPKYFSSKWSFSKFQVPSGSPCICAFGTEPNAVIAICADGSYYKFLFNPKGECIRDVYAQFLEMTDDKL

SEQ ID NO: 97393 - protein, 85 aa, Homo sapiens
  Payload ID: 19424
  Gene Name: WD repeat domain 45B
  ENSP ID: ENSP00000461355
MNLLPCNPHGNGLLYAGFNQDHGCFACGMENGFRVYNTDPLKEKEKQEFLEGGVGHVEMLFRCNYLALVGGGKKPKYPPNKGTEK

SEQ ID NO: 97394 - protein, 201 aa, Homo sapiens
  Payload ID: 19424
  Gene Name: WD repeat domain 45B
  ENSP ID: ENSP00000461488
  MOD_RES (1)..(1): Any amino acid
XHGNGLLYAGFNQDHGCFACGMENGFRVYNTDPLKEKEKQEFLEGGVGHVEMLFRCNYLALVGGGKKPKYPPNKVMIWDDLKKKTVIEIEFSTEVKAVKLRRDRIVVVLDSMIKVFTFTHNPHQLHVFETCYNPKGLCVLCPNSNNSLLAFPGTHTGHVQLVDLASTEKPPVDIPAHEGVLSCIALNLQGTRIATASEKGI

SEQ ID NO: 97395 - protein, 610 aa, Homo sapiens
  Payload ID: 19425
  Gene Name: WD repeat domain 46
  Uniprot ID: O15213
  ENSP ID: ENSP00000363746
METAPKPGKDVPPKKDKLQTKRKKPRRYWEEETVPTTAGASPGPPRNKKNRELRPQRPKNAYILKKSRISKKPQVPKKPREWKNPESQRGLSGTQDPFPGPAPVPVEVVQKFCRIDKSRKLPHSKAKTRSRLEVAEAEEEETSIKAARSELLLAEEPGFLEGEDGEDTAKICQADIVEAVDIASAAKHFDLNLRQFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPLSTRTLPHGAGHLAFSQRGLLVAGMGDVVNIWAGQGKASPPSLEQPYLTHRLSGPVHGLQFCPFEDVLGVGHTGGITSMLVPGAGEPNFDGLESNPYRSRKQRQEWEVKALLEKVPAELICLDPRALAEVDVISLEQGKKEQIERLGYDPQAKAPFQPKPKQKGRSSTASLVKRKRKVMDEEHRDKVRQSLQQQHHKEAKAKPTGARPSALDRFVR

SEQ ID NO: 97396 - protein, 610 aa, Homo sapiens [sequence omitted]

SEQ ID NO: 97397 - protein, 610 aa, Homo sapiens
  Payload ID: 19425
  Gene Name: WD repeat domain 46
  Uniprot ID: O15213
  ENSP ID: ENSP00000399454
METAPKPGKDVPPKKDKLQTKRKKPRRYWEEETVPTTAGASPGPPRNKKNRELRPQRPKNAYILKKSRISKKPQVPKKPREWKNPESQRGLSGAQDPFPGPAPVPVEVVQKFCRIDKSRKLPHSKAKTRSRLEVAEAEEEETSIKAARSELLLAEEPGFLEGEDGEDTAKICQADIVEAVDIASAAKHFDLNLRQFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPLSTRTLPHGAGHLAFSQRGLLVAGMGDVVNIWAGQGKASPPSLEQPYLTHRLSGPVHGLQFCPFEDVLGVGHTGGITSMLVPGAGEPNFDGLESNPYRSRKQRQEWEVKALLEKVPAELICLDPRALAEVDVISLEQGKKEQIERLGYDPQAKAPFQPKPKQKGRSSTASLVKRKRKVMDEEHRDKVRQSLQQQHHKEAKAKPTGARPSALDRFVR

SEQ ID NO: 97398 - protein, 610 aa, Homo sapiens; identical to SEQ ID NO: 97397
  Payload ID: 19425
  Gene Name: WD repeat domain 46
  Uniprot ID: O15213
  ENSP ID: ENSP00000402869

SEQ ID NO: 97399 - protein, 322 aa, Homo sapiens
  Payload ID: 19425
  Gene Name: WD repeat domain 46
  ENSP ID: ENSP00000405568
KSRISKKPQVPKKPREWKNPESQRGLSGTQDPFPGPAPVPVEVVQKFCRIDKSRKLPHSKAKTRSRLEVAEAEEEETSIKAARSELLLAEEPGFLEGEDGEDTAKICQADIVEAVDIASAAKFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPL

SEQ ID NO: 97400 - protein, 610 aa, Homo sapiens; identical to SEQ ID NO: 97397
  Payload ID: 19425
  Gene Name: WD repeat domain 46
  Uniprot ID: O15213
  ENSP ID: ENSP00000405614

SEQ ID NO: 97401 - protein, 322 aa, Homo sapiens
  Payload ID: 19425
  Gene Name: WD repeat domain 46
  ENSP ID: ENSP00000406835
KSRISKKPQVPKKPREWKNPESQRGLSGAQDPFPGPAPVPVEVVQKFCRIDKSRKLPHSKAKTRSRLEVAEAEEEETSIKAARSELLLAEEPGFLEGEDGEDTAKICQADIVEAVDIASAAKFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTASLWSPAMKEPLAKILCHRGGVRAVAVDSTGTYMATSGLDHQLKIFDLRGTYQPL

SEQ ID NO: 97402 - protein, 322 aa, Homo sapiens
  Payload ID: 19425
  Gene Name: WD repeat domain 46
  ENSP ID: ENSP00000407066
KSRISKKPQVPKKPREWKNPESQRGLSGAQDPFPGPAPVPVEVVQKFCRIDKSRKLPHSKAKTRSRLEVAEAEEEETSIKAARSELLLAEEPGFLEGEDGEDTAKICQADIVEAVDIASAAKFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPL

SEQ ID NO: 97403 - protein, 322 aa, Homo sapiens; identical to SEQ ID NO: 97402
  Payload ID: 19425
  Gene Name: WD repeat domain 46
  ENSP ID: ENSP00000408651

SEQ ID NO: 97404 - protein, 322 aa, Homo sapiens; identical to SEQ ID NO: 97402
  Payload ID: 19425
  Gene Name: WD repeat domain 46
  ENSP ID: ENSP00000412069

SEQ ID NO: 97405 - protein, 893 aa, Homo sapiens
  Payload ID: 19426
  Gene Name: WD repeat domain 47
  ENSP ID: ENSP00000350301
MTAEETVNVKEVEIIKLILDFLNSKKLHISMLALEKESGVINGLFSDDMLFLRFRYIILKQKFLEALCVNNAMSAEDEPQHLEFTMQEAVQCLHALEEYCPSKDDYSKLCLLLTLPRLTNHAEFKDWNPSTARVHCFEEACVMVAEFIPADRKLSEAGFKASNNRLFQLVMKGLLYECCVEFCQSKATGEEITESEVLLGIDLLCGNGCDDLDLSLLSWLQNLPSSVFSCAFEQKMLNIHVDKLLKPTKAAYADLLTPLISKLSPYPSSPMRRPQSADAYMTRSLNPALDGLTCGLTSHDKRISDLGNKTSPMSHSFANFHYPGVQNLSRSLMLENTECHSIYEESPERDTPVDAQRPIGSEILGQSSVSEKEPANGAQNPGPAKQEKNELRDSTEQFQEYYRQRLRYQQHLEQKEQQRQIYQQMLLEGGVNQEDGPDQQQNLTEQFLNRSIQKLGELNIGMDGLGNEVSALNQQCNGSKGNGSNGSSVTSFTTPPQDSSQRLTHDASNIHTSTPRNPGSTNHIPFLEESPCGSQISSEHSVIKPPLGDSPGSLSRSKGEEDDKSKKQFVCINILEDTQAVRAVAFHPAGGLYAVGSNSKTLRVCAYPDVIDPSAHETPKQPVVRFKRNKHHKGSIYCVAWSPCGQLLATGSNDKYVKVLPFNAETCNATVSGPDLEFSMHDGTIRDLAFMEGPESGGAILISAGAGDCNIYTTDCQRGQGLHALSGHTGHILALYTWSGWMIASGSQDKTVRFWDLRVPSCVRVVGTTFHGTGSAVASVAVDPSGRLLATGQEDSSCMLYDIRGGRMVQSYHPHSSDVRSVRFSPGAHYLLTGSYDMKIKVTDLQGDLTKQLPIMVVGEHKDKVIQCRWHTQDLSFLSSSADRTVTLWTYNG

SEQ ID NO: 97406 - protein, 891 aa, Homo sapiens
  Payload ID: 19426
  Gene Name: WD repeat domain 47
  Uniprot ID: O94967
  ENSP ID: ENSP00000354339
MTAEETVNVKEVEIIKLILDFLNSKKLHISMLALEKESGVINGLFSDDMLFLRFRYIILKQKFLEALCVNNAMSAEDEPQHLEFTMQEAVQCLHALEEYCPSKDDYSKLCLLLTLPRLTNHAEFKDWNPSTARVHCFEEACVMVAEFIPADRKLSEAGFKASNNRLFQLVMKGLLYECCVEFCQSKATGEEITESEVLLGIDLLCGNGCDDLDLSLLSWLQNLPSSVFSCAFEQKMLNIHVDKLLKPTKAAYADLLTPLISKLSPYPSSPMRRPQSADAYMTRSLNPALDGLTCGLTSHDKRISDLGNKTSPMSHSFANFHYPGVQNLSRSLMLENTECHSIYEESPERDTPVDAQRPIGSEILGQSSVSEKEPANGAQNPGPAKQEKNELRDSTEQFQEYYRQRLRYQQHLEQKEQQRQIYQQMLLEGGVNQEDGPDQQQNLTEQFLNRSIQKLGELNIGMDGLGNEVSALNQQCNGSKGNGSNGSSVTSFTTPPQDSSQRLTHDASNIHTSTPRNPGSTNHIPFLEESPCGSQISSEHSVIKPPLGDSPGSLSRSKGEEDDKSKKQFVCINILEDTQAVRAVAFHPAGGLYAVGSNSKTLRVCAYPDVIDPSAHETPKQPVVRFKRNKHHKGSIYCVAWSPCGQLLATGSNDKYVKVLPFNAETCNATGPDLEFSMHDGTIRDLAFMEGPESGGAILISAGAGDCNIYTTDCQRGQGLHALSGHTGHILALYTWSGWMIASGSQDKTVRFWDLRVPSCVRVVGTTFHGTGSAVASVAVDPSGRLLATGQEDSSCMLYDIRGGRMVQSYHPHSSDVRSVRFSPGAHYLLTGSYDMKIKVTDLQGDLTKQLPIMVVGEHKDKVIQCRWHTQDLSFLSSSADRTVTLWTYNG

SEQ ID NO: 97407 - protein, 919 aa, Homo sapiens
  Payload ID: 19426
  Gene Name: WD repeat domain 47
  Uniprot ID: O94967
  ENSP ID: ENSP00000358979
MTAEETVNVKEVEIIKLILDFLNSKKLHISMLALEKESGVINGLFSDDMLFLRQLILDGQWDEVLQFIQPLECMEKFDKKRFRYIILKQKFLEALCVNNAMSAEDEPQHLEFTMQEAVQCLHALEEYCPSKDDYSKLCLLLTLPRLTNHAEFKDWNPSTARVHCFEEACVMVAEFIPADRKLSEAGFKASNNRLFQLVMKGLLYECCVEFCQSKATGEEITESEVLLGIDLLCGNGCDDLDLSLLSWLQNLPSSVFSCAFEQKMLNIHVDKLLKPTKAAYADLLTPLISKLSPYPSSPMRRPQSADAYMTRSLNPALDGLTCGLTSHDKRISDLGNKTSPMSHSFANFHYPGVQNLSRSLMLENTECHSIYEESPERDTPVDAQRPIGSEILGQSSVSEKEPANGAQNPGPAKQEKNELRDSTEQFQEYYRQRLRYQQHLEQKEQQRQIYQQMLLEGGVNQEDGPDQQQNLTEQFLNRSIQKLGELNIGMDGLGNEVSALNQQCNGSKGNGSNGSSVTSFTTPPQDSSQRLTHDASNIHTSTPRNPGSTNHIPFLEESPCGSQISSEHSVIKPPLGDSPGSLSRSKGEEDDKSKKQFVCINILEDTQAVRAVAFHPAGGLYAVGSNSKTLRVCAYPDVIDPSAHETPKQPVVRFKRNKHHKGSIYCVAWSPCGQLLATGSNDKYVKVLPFNAETCNATGPDLEFSMHDGTIRDLAFMEGPESGGAILISAGAGDCNIYTTDCQRGQGLHALSGHTGHILALYTWSGWMIASGSQDKTVRFWDLRVPSCVRVVGTTFHGTGSAVASVAVDPSGRLLATGQEDSSCMLYDIRGGRMVQSYHPHSSDVRSVRFSPGAHYLLTGSYDMKIKVTDLQGDLTKQLPIMVVGEHKDKVIQCRWHTQDLSFLSSSADRTVTLWTYNG

SEQ ID NO: 97408 - protein, 920 aa, Homo sapiens
  Payload ID: 19426
  Gene Name: WD repeat domain 47
  Uniprot ID: O94967
  ENSP ID: ENSP00000358982
MTAEETVNVKEVEIIKLILDFLNSKKLHISMLALEKESGVINGLFSDDMLFLRQLILDGQWDEVLQFIQPLECMEKFDKKRFRYIILKQKFLEALCVNNAMSAEDEPQHLEFTMQEAVQCLHALEEYCPSKDDYSKLCLLLTLPRLTNHAEFKDWNPSTARVHCFEEACVMVAEFIPADRKLSEAGFKASNNRLFQLVMKGLLYECCVEFCQSKATGEEITESEVLLGIDLLCGNGCDDLDLSLLSWLQNLPSSVFSCAFEQKMLNIHVDKLLKPTKAAYADLLTPLISKLSPYPSSPMRRPQSADAYMTRSLNPALDGLTCGLTSHDKRISDLGNKTSPMSHSFANFHYPGVQNLSRSLMLENTECHSIYEESPERSDTPVDAQRPIGSEILGQSSVSEKEPANGAQNPGPAKQEKNELRDSTEQFQEYYRQRLRYQQHLEQKEQQRQIYQQMLLEGGVNQEDGPDQQQNLTEQFLNRSIQKLGELNIGMDGLGNEVSALNQQCNGSKGNGSNGSSVTSFTTPPQDSSQRLTHDASNIHTSTPRNPGSTNHIPFLEESPCGSQISSEHSVIKPPLGDSPGSLSRSKGEEDDKSKKQFVCINILEDTQAVRAVAFHPAGGLYAVGSNSKTLRVCAYPDVIDPSAHETPKQPVVRFKRNKHHKGSIYCVAWSPCGQLLATGSNDKYVKVLPFNAETCNATGPDLEFSMHDGTIRDLAFMEGPESGGAILISAGAGDCNIYTTDCQRGQGLHALSGHTGHILALYTWSGWMIASGSQDKTVRFWDLRVPSCVRVVGTTFHGTGSAVASVAVDPSGRLLATGQEDSSCMLYDIRGGRMVQSYHPHSSDVRSVRFSPGAHYLLTGSYDMKIKVTDLQGDLTKQLPIMVVGEHKDKVIQCRWHTQDLSFLSSSADRTVTLWTYNG

SEQ ID NO: 97409 - protein, 927 aa, Homo sapiens
  Payload ID: 19426
  Gene Name: WD repeat domain 47
  Uniprot ID: O94967
  ENSP ID: ENSP00000383599
MTAEETVNVKEVEIIKLILDFLNSKKLHISMLALEKESGVINGLFSDDMLFLRQLILDGQWDEVLQFIQPLECMEKFDKKRFRYIILKQKFLEALCVNNAMSAEDEPQHVRFLFLKLEFTMQEAVQCLHALEEYCPSKDDYSKLCLLLTLPRLTNHAEFKDWNPSTARVHCFEEACVMVAEFIPADRKLSEAGFKASNNRLFQLVMKGLLYECCVEFCQSKATGEEITESEVLLGIDLLCGNGCDDLDLSLLSWLQNLPSSVFSCAFEQKMLNIHVDKLLKPTKAAYADLLTPLISKLSPYPSSPMRRPQSADAYMTRSLNPALDGLTCGLTSHDKRISDLGNKTSPMSHSFANFHYPGVQNLSRSLMLENTECHSIYEESPERSDTPVDAQRPIGSEILGQSSVSEKEPANGAQNPGPAKQEKNELRDSTEQFQEYYRQRLRYQQHLEQKEQQRQIYQQMLLEGGVNQEDGPDQQQNLTEQFLNRSIQKLGELNIGMDGLGNEVSALNQQCNGSKGNGSNGSSVTSFTTPPQDSSQRLTHDASNIHTSTPRNPGSTNHIPFLEESPCGSQISSEHSVIKPPLGDSPGSLSRSKGEEDDKSKKQFVCINILEDTQAVRAVAFHPAGGLYAVGSNSKTLRVCAYPDVIDPSAHETPKQPVVRFKRNKHHKGSIYCVAWSPCGQLLATGSNDKYVKVLPFNAETCNATGPDLEFSMHDGTIRDLAFMEGPESGGAILISAGAGDCNIYTTDCQRGQGLHALSGHTGHILALYTWSGWMIASGSQDKTVRFWDLRVPSCVRVVGTTFHGTGSAVASVAVDPSGRLLATGQEDSSCMLYDIRGGRMVQSYHPHSSDVRSVRFSPGAHYLLTGSYDMKIKVTDLQGDLTKQLPIMVVGEHKDKVIQCRWHTQDLSFLSSSADRTVTLWTYNG

SEQ ID NO: 97410 - protein, 106 aa, Homo sapiens
  Payload ID: 19426
  Gene Name: WD repeat domain 47
  ENSP ID: ENSP00000433452
MTAEETVNVKEVEIIKLILDFLNSKKLHISMLALEKESGVINGLFSDDMLFLRQLILDGQWDEVLQFIQPLECMEKFDKKRFRYIILKQKFLEALCVNNAMSAEDE

SEQ ID NO: 97411 - protein, 173 aa, Homo sapiens
  Payload ID: 19426
  Gene Name: WD repeat domain 47
  ENSP ID: ENSP00000434289
MTAEETVNVKEVEIIKLILDFLNSKKLHISMLALEKESGVINGLFSDDMLFLRQLILDGQWDEVLQFIQPLECMEKFDKKRFRYIILKQKFLEALCVNNAMSAEDEPQHLEFTMQEAVQCLHALEEYCPSKDDYSKLCLLLTLPRLTNHAEFKDWNPSTARVHCFEEACVMVA

SEQ ID NO: 97412 - protein, 56 aa, Homo sapiens
  Payload ID: 19426
  Gene Name: WD repeat domain 47
  ENSP ID: ENSP00000434868
MSAEDEPQHLEFTMQEAVQCLHALEEYCPSKDDYSKLCLLLTLPRLTNHAEFKDWN

SEQ ID NO: 97413 - protein, 93 aa, Homo sapiens
  Payload ID: 19426
  Gene Name: WD repeat domain 47
  ENSP ID: ENSP00000437171
MEKFDKKRFRYIILKQKFLEALCVNNAMSAEDEPQHLEFTMQEAVQCLHALEEYCPSKDDYSKLCLLLTLPRLTNHAEFKDWNPSTARVHCFE

SEQ ID NO: 97414 - protein, 677 aa, Homo sapiens
  Payload ID: 19427
  Gene Name: WD repeat domain 48
  Uniprot ID: Q8TAF3
  ENSP ID: ENSP00000307491
MAAHHRQNTAGRRKVQVSYVIRDEVEKYNRNGVNALQLDPALNRLFTAGRDSIIRIWSVNQHKQDPYIASMEHHTDWVNDIVLCCNGKTLISASSDTTVKVWNAHKGFCMSTLRTHKDYVKALAYAKDKELVASAGLDRQIFLWDVNTLTALTASNNTVTTSSLSGNKDSIYSLAMNQLGTIIVSGSTEKVLRVWDPRTCAKLMKLKGHTDNVKALLLNRDGTQCLSGSSDGTIRLWSLGQQRCIATYRVHDEGVWALQVNDAFTHVYSGGRDRKIYCTDLRNPDIRVLICEEKAPVLKMELDRSADPPPAIWVATTKSTVNKWTLKGIHNFRASGDYDNDCTNPITPLCTQPDQVIKGGASIIQCHILNDKRHILTKDTNNNVAYWDVLKACKVEDLGKVDFEDEIKKRFKMVYVPNWFSVDLKTGMLTITLDESDCFAAWVSAKDAGFSSPDGSDPKLNLGGLLLQALLEYWPRTHVNPMDEEENEVNHVNGEQENRVQKGNGYFQVPPHTPVIFGEAGGRTLFRLLCRDSGGETESMLLNETVPQWVIDITVDKNMPKFNKIPFYLQPHASSGAKTLKKDRLSASDMLQVRKVMEHVYEKIINLDNESQTTSSSNNEKPGEQEKEEDIAVLAEEKIELLCQDQVLDPNMDLRTVKHFIWKSGGDLTLHYRQKST

SEQ ID NO: 97415 - protein, 63 aa, Homo sapiens
  Payload ID: 19427
  Gene Name: WD repeat domain 48
  ENSP ID: ENSP00000388720
MAAHHRQNTAGRRKVQVSYVIRDEVEKYNRNGVNALQLDPALNRLFTAGRDSIIRIWSVNQHK

SEQ ID NO: 97416 - protein, 134 aa, Homo sapiens
  Payload ID: 19427
  Gene Name: WD repeat domain 48
  ENSP ID: ENSP00000401421
MAAHHRQNTAGRRKVQVSYVIRDEVEKYNRNGVNALQLDPALNRLFTAGRDSIIRIWSVNQHKQDPYIASMEHHTDWVNDIVLCCNGKTLISASSDTTVKVWNAHKGFCMSTLRTHKYVCSITGLRKGLSICQG

SEQ ID NO: 97417 - protein, 74 aa, Homo sapiens
  Payload ID: 19427
  Gene Name: WD repeat domain 48
  ENSP ID: ENSP00000406025
MAAHHRQNTAGRRKVQVSYVIRDEVEKYNRNGVNALQLDPALNRLFTAGRDSIIRIWSVNQHKDFSFNFSKIHI

SEQ ID NO: 97418 - protein, 120 aa, Homo sapiens
  Payload ID: 19427
  Gene Name: WD repeat domain 48
  ENSP ID: ENSP00000415963
MAAHHRQNTAGRRKVQVSYVIRDEVEKYNRNGVNALQLDPALNRLFTAGRDSIIRIWSVNQHKQDPYIASMEHHTDWVNDIVLCCNGKTLISASSDTTVKVWNAHKGFCMSTLRTHKLLL

SEQ ID NO: 97419 - protein, 162 aa, Homo sapiens
  Payload ID: 19427
  Gene Name: WD repeat domain 48
  ENSP ID: ENSP00000416900
MEHHTDWVNDIVLCCNGKTLISASSDTTVKVWNAHKGFCMSTLRTHKDYVKALAYAKDKELVASAGLDRQIFLWDVNTLTALTASNNTVTTSSLSGNKDSIYSLAMNQLGTIIVSGSTEKVLRVWDPRTCAKLMKLKGHTDNVKALLLNRDGTQCLSGSSDG

SEQ ID NO: 97420 - protein, 697 aa, Homo sapiens
  Payload ID: 19428
  Gene Name: WD repeat domain 49
  Uniprot ID: Q8IV35
  ENSP ID: ENSP00000311343
MAWREKSKKRLNMTSFNIAQGIHAFDYHSRLNLIATAGINNKVCLWNPYVVSKPVGVLWGHSASVIAVQFFVERKQLFSFSKDKVLRLWDIQHQLSIQRIACSFPKSQDFRCLFHFDEAHGRLFISFNNQLALLAMKSEASKRVKSHEKAVTCVLYNSILKQVISSDTGSTVSFWMIDTGQKIKQFTGCHGNAEISTMALDANETRLLTGSTDGTVKIWDFNGYCHHTLNVGQDGAVDISQILILKKKILVTGWERAITVFRPQNFNQFFIQPEEWKGGIQHHDDILCAAFLPPQTLVTGSYDGEIVLWNNSTENAHHVLHPDYQRLLKSKLDTKPQKLLSAGRSQPSHPMADHSTTGVRNFEIDTEGKNAVMRLCFLKARKNTAVTGGANLVSCGGSGYVRFWDIYKKQLLAEFLAHSGVGSIIMSTDKMNRYLTTGDLDGWLKIWNIEEYCLNSSKNKITKAPTLIRSFQPHEDRISSLEMCEPGGQLLIISSSADCSICVTGVCNAPVWIFGQAKHWHIENCLFLPKRDTNLVESEIQKEISLFSKEESCLDPTEHSLLNKKNKDDSTYNVRPSEDINLDIKYKERSTCMKETQKPYYGEVIKKSFSTFRSLNIGALEELPEVNKPAFLLDPEKYFRKEPEEERPQILEAPSLFKTLKAVFDEKNLFPKEILHHERKAKQLCQEKSCEVKKNKK

SEQ ID NO: 97421 - protein, 61 aa, Homo sapiens
  Payload ID: 19428
  Gene Name: WD repeat domain 49
  ENSP ID: ENSP00000417090
MSCQKAVLELNIGSQLGPKSPERTEGVTAFEDYGTGLLENQLSVGDFVKIQKAFELLTMHL

SEQ ID NO: 97422 - protein, 139 aa, Homo sapiens
  Payload ID: 19428
  Gene Name: WD repeat domain 49
  ENSP ID: ENSP00000418539
  MOD_RES (1)..(1): Any amino acid
XIDTEGKNAVMRLCFLKARKNTAVTGGANLVSCGGSGYVRFWDIYKKQLLAEFLAHSGVGSIIMSTDKMNRYLTTGDLDGWLKIWNIEAKHWHIENCLFLPKRDTNLVESEIQKEISLFSKEESCLDPTEHSLLNKKNK

SEQ ID NO: 97423 - protein, 118 aa, Homo sapiens
  Payload ID: 19428
  Gene Name: WD repeat domain 49
  ENSP ID: ENSP00000418718
MSCQKAVLELNIGSQLGPKSPERTEGVTAFEDYGTGLLENQLSVGDFVKIQKAFEVISSDTGSTVSFWMIDTGQKIKQFTGCHGNAEISTMALDANETRLLTGSTDGTVKIWDFNGYC

SEQ ID NO: 97424 - protein, 674 aa, Homo sapiens
  Payload ID: 19428
  Gene Name: WD repeat domain 49
  ENSP ID: ENSP00000419130
  MOD_RES (1)..(1): Any amino acid
XPASACEDGEATMTINWAELLSGCHKCCHILEHKLHQGDWVRQVTYNASLDAIISSTTSNTNSVVMAWREKSKKRLNMTSFNIAQGIHAFDYHSRLNLIATAGINNKVCLWNPYVVSKPVGVLWGHSASVIAVQFFVERKQLFSFSKDKVLRLWDIQHQLSIQRIACSFPKSQDFRCLFHFDEAHGRLFISFNNQLALLAMKSEASKRVKSHEKAVTCVLYNSILKQVISSDTGSTVSFWMIDTGQKIKQFTGCHGNAEISTMALDANETRLLTGSTDGTVKIWDFNGYCHHTLNVGQDGAVDISQILILKKKILVTGWERYDYASWKTIGRAITVFRPQNFNQFFIQPEEWKGGIQHHDDILCAAFLPPQTLVTGSYDGEIVLWNNSTENAHHVLHPDYQRLLKSKLDTKPQKLLSAGRSQPSHPMADHSTTGVRNFEIDTEGKNAVMRLCFLKARKNTAVTGGANLVSCGGSGYVRFWDIYKKQLLAEFLAHSGVGSIIMSTDKMNRYLTTGDLDGWLKIWNIEEESCLDPTEHSLLNKKNKDDSTYNVRPSEDINLDIKYKERSTCMKETQKPYYGEVIKKSFSTFRSLNIGALEELPEVNKPAFLLDPEKYFRKEPEEERPQILEAPSLFKTLKAVFDEKNLFPKEILHHERKAKQLCQEKSCEVKKNKK

SEQ ID NO: 97425 - protein, 518 aa, Homo sapiens
  Payload ID: 19428
  Gene Name: WD repeat domain 49
  ENSP ID: ENSP00000419749
MSCQKAVLELNIGSQLGPKSPERTEGVTAFEDYGTGLLENQLSVGDFVKIQKAFESPQPRKIICMSREDFTQKMTEIVGWGTKEEYGELFDKVDVAQDGFINWDKLTSFILLELYEQDERAKATVVPQWKDLEFLPVKHKDTIQKVIFLKNSSHYLTISKEGLLAIWGEHLKLQETFPITSDATKLKHLWVTSLVSLENVNKIAVAFTSKEVCFYDLLSKEEFACQYKLQGLKGTPICMDYWYDPLDANESILSFGDITGKVQAIAFTAALISLFERPASACEDGEATMTINWAELLSGCHKCCHILEHKLHQGDWVRQVTYNASLDAIISSTTSNTNSVVMAWREKSKKRLNMTSFNIAQGIHAFDYHSRLNLIATAGINNKVCLWNPYVVSKPVGVLWGHSASVIAVQFFVERKQLFSFSKDKVLRLWDIQHQLSIQRIACSFPKSQDFRCLFHFDEAHGRLFISFNNQLALLAMKSEASKRVKSHEKAVTCVLYNSILKQPSQCEDDTNEDPYDN

SEQ ID NO: 97426 - protein, 113 aa, Homo sapiens
  Payload ID: 19428
  Gene Name: WD repeat domain 49
  ENSP ID: ENSP00000419917
MSCQKAVLELNIGSQLGPKSPERTEGVTAFEDYGTGLLENQLSVGDFVKIQKAFEIAVAFTSKEVCFYDLLSKEEFACQYKLQGLKGTPICMDYWYDPLDANESILSFGDITG

SEQ ID NO: 97427 - protein, 334 aa, Homo sapiens
  Payload ID: 19429
  Gene Name: WD repeat domain 5
  Uniprot ID: P61964
  ENSP ID: ENSP00000351446
MATEEKKPETEAARAQPTPSSSATQSKPTPVKPNYALKFTLAGHTKAVSSVKFSPNGEWLASSSADKLIKIWGAYDGKFEKTISGHKLGISDVAWSSDSNLLVSASDDKTLKIWDVSSGKCLKTLKGHSNYVFCCNFNPQSNLIVSGSFDESVRIWDVKTGKCLKTLPAHSDPVSAVHFNRDGSLIVSSSYDGLCRIWDTASGQCLKTLIDDDNPPVSFVKFSPNGKYILAATLDNTLKLWDYSKGKCLKTYTGHKNEKYCIFANFSVTGGKWIVSGSEDNLVYIWNLQTKEIVQKLQGHTDVVISTACHPTENIIASAALENDKTIKLWKSDC

SEQ ID NO: 97428 - protein, 56 aa, Homo sapiens
  Payload ID: 19429
  Gene Name: WD repeat domain 5
  ENSP ID: ENSP00000477000
MATEEKKPETEAARAQPTPSSSATQSKPTPVKPNYALKFTLAGHTKAVSSVKFSPN

SEQ ID NO: 97429 - protein, 96 aa, Homo sapiens
  Payload ID: 19429
  Gene Name: WD repeat domain 5
  ENSP ID: ENSP00000477449
MATEEKKPETEAARAQPTPSSSATQSKPTPVKPNYALKFTLAGHTKAVSSVKFSPNGEWLASSSADKLIKIWGAYDGKFEKTISGHKLGISDVAWS

SEQ ID NO: 97430 - protein, 358 aa, Homo sapiens
  Payload ID: 19430
  Gene Name: WD repeat domain 53
  Uniprot ID: Q7Z5U6
  ENSP ID: ENSP00000328079
MAVKWTGGHSSPVLCLNASKEGLLASGAEGGDLTAWGEDGTPLGHTRFQGADDVTSVLFSPSCPTKLYASHGETISVLDVRSLKDSLDHFHVNEEEINCLSLNQTENLLASADDSGAIKILDLENKKVIRSLKRHSNICSSVAFRPQRPQSLVSCGLDMQVMLWSLQKARPLWITNLQEDETEEMEGPQSPGQLLNPALAHSISVASCGNIFSCGAEDGKVRIFRVMGVKCEQELGFKGHTSGVSQVCFLPESYLLLTGGNDGKITLWDANSEVEKKQKSPTKRTHRKKPKRGTCTKQGGNTNASVTDEEEHGNILPKLNIEHGEKVNWLLGTKIKGHQNILVADQTSCISVYPLNEF

SEQ ID NO: 97431 - protein, 154 aa, Homo sapiens
  Payload ID: 19430
  Gene Name: WD repeat domain 53
  ENSP ID: ENSP00000396248
MAVKWTGGHSSPVLCLNASKEGLLASGAEGGDLTAWGEDGTPLGHTRFQGADDVTSVLFSPSCPTKLYASHGETISVLDVRSLKDSLDHFHVNEEEINCLSLNQTENLLASADDSGAIKILDLENKKVIRSLKRHSNICSSVAFRPQRPQSLVS

SEQ ID NO: 97432 - protein, 197 aa, Homo sapiens
  Payload ID: 19430
  Gene Name: WD repeat domain 53
  ENSP ID: ENSP00000396668
MLWSLQKARPLWITNLQEDETEEMEGPQSPGQLLNPALAHSISVASCGNIFSCGAEDGKVRIFRVMGVKCEQELGFKGHTSGVSQVCFLPESYLLLTGGNDGKITLWDANSEVEKKQKSPTKRTHRKKPKRGTCTKQGGNTNASVTDEEEHGNILPKLNIEHGEKVNWLLGTKIKGHQNILVADQTSCISVYPLNEF

SEQ ID NO: 97433 - protein, 160 aa, Homo sapiens
  Payload ID: 19430
  Gene Name: WD repeat domain 53
  ENSP ID: ENSP00000408087
MAVKWTGGHSSPVLCLNASKEGLLASGAEGGDLTAWGEDGTPLGHTRFQGADDVTSVLFSPSCPTKLYASHGETISVLDVRSLKDSLDHFHVNEEEINCLSLNQTENLLASADDSGAIKILDLENKKVIRSLKRHSNICSSVAFRPQRPQSLVSCGLDMQ

SEQ ID NO: 97434 - protein, 199 aa, Homo sapiens
  Payload ID: 19430
  Gene Name: WD repeat domain 53
  ENSP ID: ENSP00000410677
MVMLWSLQKARPLWITNLQEDETEEMEGPQSPGQLLNPALAHSISVASCGNIFSCGAEDGKVRIFRVMGVKCEQELGFKGHTSGVSQVCFLPESYLLLTGGNDGKITLWDANSEVEKKQKSPTKRTHRKKPKRGTCTKQGGNTNASVTDEEEHGNILPKLNIEHGEKVNWLLGTKIKGHQNILVADQTSCISVYPLNEF

SEQ ID NO: 97435 - protein, 334 aa, Homo sapiens
  Payload ID: 19431
  Gene Name: WD repeat domain 54
  Uniprot ID: Q9H977
  ENSP ID: ENSP00000006526
MFRWERSIPLRGSAAALCNNLSVLQLPARNLTYFGVVHGPSAQLLSAAPEGVPLAQRQLHAKEGAGVSPPLITQVHWCVLPFRVLLVLTSHRGIQMYESNGYTMVYWHALDSGDASPVQAVFARGIAASGHFICVGTWSGRVLVFDIPAKGPNIVLSEELAGHQMPITDIATEPAQGQDCVADMVTADDSGLLCVWRSGPEFTLLTRIPGFGVPCPSVQLWQGIIAAGYGNGQVHLYEATTGNLHVQINAHARAICALDLASEVGKLLSAGEDTFVHIWKLSRNPESGYIEVEHCHGECVADTQLCGARFCDSSGNSFAVTGYDLAEIRRFSSV

SEQ ID NO: 97436 - protein, 244 aa, Homo sapiens
  Payload ID: 19431
  Gene Name: WD repeat domain 54
  ENSP ID: ENSP00000387236
MVAADLEGPYEPGVRRADLGLQVHWCVLPFRVLLVLTSHRGIQMYESNGYTMVYWHALDSGDASPVQAVFARGIAASGHFICVGTWSGRVLVFDIPAKGPNIVLSEELAGHQMPITDIATEPAQGQDCVADMVTADDSGLLCVWRSGPEFTLLTRIPGFGVPCPSVQLWQGIIAAGYGNGQVHLYEATTGNLHVQINAHARAICALDLASEVGKLLSAGEDTFVHIWKLSRNPESGYIEATPLL

SEQ ID NO: 97437 - protein, 162 aa, Homo sapiens
  Payload ID: 19431
  Gene Name: WD repeat domain 54
  ENSP ID: ENSP00000406606
MFRWERSIPLRGSAAALCNNLSVLQLPARNLTYFGVVHGPSAQLLSAAPEGVPLAQRQLHAKEGAGVSPPLITQVHWCVLPFRVLLVLTSHRGIQMYESNGYTMVYWHALDSGDASPGTWSGRVLVFDIPAKGPNIVLSEELAGHQMPITDIATEPAQGQVS

SEQ ID NO: 97438 - protein, 383 aa, Homo sapiens
  Payload ID: 19432
  Gene Name: WD repeat domain 55
  Uniprot ID: Q9H6Y2
  ENSP ID: ENSP00000351100
MDRTCEERPAEDGSDEEDPDSMEAPTRIRDTPEDIVLEAPASGLAFHPARDLLAAGDVDGDVFVFSYSCQEGETKELWSSGHHLKACRAVAFSEDGQKLITVSKDKAIHVLDVEQGQLERRVSKAHGAPINSLLLVDENVLATGDDTGGICLWDQRKEGPLMDMRQHEEYIADMALDPAKKLLLTASGDGCLGIFNIKRRRFELLSEPQSGDLTSVTLMKWGKKVACGSSEGTIYLFNWNGFGATSDRFALRAESIDCMVPVTESLLCTGSTDGVIRAVNILPNRVVGSVGQHTGEPVEELALSHCGRFLASSGHDQRLKFWDMAQLRAVVVDDYRRRKKKGGPLRALSSKTWSTDDFFAGLREEGEDSMAQEEKEETGDDSD

SEQ ID NO: 97439 - protein, 137 aa, Homo sapiens
  Payload ID: 19432
  Gene Name: WD repeat domain 55
  ENSP ID: ENSP00000426304
MDRTCEERPAEDGSDEEDPDSMEAPTRIRDTPEDIVLEAPASGLAFHPARDLLAAGDVDGDVFVFSYSCQEGETKELWSSGHHLKACRAVAFSEDGQSEYWGRQPAMWWKGAVSSTMTWAPFPQSSLLSPRTKPSMF

SEQ ID NO: 97440 - protein, 222 aa, Homo sapiens
  Payload ID: 19432
  Gene Name: WD repeat domain 55
  ENSP ID: ENSP00000439719
MDMRQHEEYIADMALDPAKKLLLTASGDGCLGIFNIKRRRFELLSEPQSGDLTSVTLMKWGKKVACGSSEGTIYLFNWNGFGATSDRFALRAESIDCMVPVTESLLCTGSTDGVIRAVNILPNRVVGSVGQHTGEPVEELALSHCGRFLASSGHDQRLKFWDMAQLRAVVVDDYRRRKKKGGPLRALSSKTWSTDDFFAGLREEGEDSMAQEEKEETGDDSD

SEQ ID NO: 97441 - protein, 974 aa, Homo sapiens
  Payload ID: 19433
  Gene Name: WD repeat domain 59
  Uniprot ID: Q6PJI9
  ENSP ID: ENSP00000262144
MAARWSSENVVVEFRDSQATAMSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTVALSAVAGASQVKWNKKNANCLATSHDGDVRIWDKRKPSTAVEYLAAHLSKIHGLDWHPDSEHILATSSQDNSVKFWDYRQPRKYLNILPCQVPVWKARYTPFSNGLVTVMVPQLRRENSLLLWNVFDLNTPVHTFVGHDDVVLEFQWRKQKEGSKDYQLVTWSRDQTLRMWRVDSQMQRLCANDILDGVDEFIESISLLPEPEKTLHTEDTDHQHTASHGEEEALKEDPPRNLLEERKSDQLGLPQTLQQEFSLINVQIRNVNVEMDAADRSCTVSVHCSNHRVKMLVKFPAQYPNNAAPSFQFINPTTITSTMKAKLLKILKDTALQKVKRGQSCLEPCLRQLVSCLESFVNQEDSASSNPFALPNSVTPPLPTFARVTTAYGSYQDANIPFPRTSGARFCGAGYLVYFTRPMTMHRAVSPTEPTPRSLSALSAYHTGLIAPMKIRTEAPGNLRLYSGSPTRSEKEQVSISSFYYKERKSRRWKSKREGSDSGNRQIKAAGKVIIQDIACLLPVHKSLGELYILNVNDIQETCQKNAASALLVGRKDLVQVWSLATVATDLCLGPKSDPDLETPWARHPFGRQLLESLLAHYCRLRDVQTLAMLCSVFEAQSRPQGLPNPFGPFPNRSSNLVVSHSRYPSFTSSGSCSSMSDPGLNTGGWNIAGREAEHLSSPWGESSPEELRFGSLTYSDPRERERDQHDKNKRLLDPANTQQFDDFKKCYGEILYRWGLREKRAEVLKFVSCPPDPHKGIEFGVYCSHCRSEVRGTQCAICKGFTFQCAICHVAVRGSSNFCLTCGHGGHTSHMMEWFRTQEVCPTGCGCHCLLESTF

SEQ ID NO: 97442 - protein, 300 aa, Homo sapiens
  Payload ID: 19433
  Gene Name: WD repeat domain 59
  ENSP ID: ENSP00000454382
  MOD_RES (1)..(1): Any amino acid
XTITSTMKAKLLKILKDTALQKVKRGQSCLEPCLRQLVSCLESFVNQEDSASSNPFALPNSVTPPLPTFARVTTAYGSYQDANIPFPRTSGARFCGAGYLVYFTRPMTMHRAVSPTEPTPRSLSALSAYHTGLIAPMKIRTEAPGNLRLYSGSPTRSEKEQVSISSFYYKERMSPRSARRRWSIQAINDFPKSRRWKSKREGSDSGNRQIKAAGKVIIQDIACLLPVHKSLGELYILNVNDIQETCQKNAASALLVGRKDLVQVWSLATVATDLCLGPKSDPDLETPWARHPFGRQLLES

SEQ ID NO: 97443 - protein, 217 aa, Homo sapiens
  Payload ID: 19433
  Gene Name: WD repeat domain 59
  ENSP ID: ENSP00000455060
  MOD_RES (1)..(1): Any amino acid
XLYSGSPTRSEKEQVSISSFYYKERKSRRWKSKREGSDSGNRQIKAAGKVIIQDIACLLPVHKSLGELYILNVNDIQETCQKNAASALLVGRKDLVQPSFTSSGSCSSMSDPGLNTGGWNIAGREAEHLSSPWGESSPEELRFGSLTYSDPRERERDQHDKNKRLLDPANTQQFDDFKKCYGEILYRWGLREKRAEVLKFVSCPPDPHKGIEFGVYC

SEQ ID NO: 97444 - protein, 156 aa, Homo sapiens
  Payload ID: 19433
  Gene Name: WD repeat domain 59
  ENSP ID: ENSP00000456139
MSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTVALSAVAGASQVKWNKKNANCLATSHDGDVRIWDK

SEQ ID NO: 97445 - protein, 35 aa, Homo sapiens
  Payload ID: 19433
  Gene Name: WD repeat domain 59
  ENSP ID: ENSP00000457605
MAARWSSENVVVEFRDSQATAMSVDCLGQHAVLSG

SEQ ID NO: 97446 - protein, 47 aa, Homo sapiens
  Payload ID: 19433
  Gene Name: WD repeat domain 59
  ENSP ID: ENSP00000457978
TPPLPTFARVTTAYGSYQDANIPFPRTSGARFCGADLSQPCLLITLA

SEQ ID NO: 97447 - protein, 458 aa, Homo sapiens
  Payload ID: 19433
  Gene Name: WD repeat domain 59
  ENSP ID: ENSP00000481730
MSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTVALSAVAGASQVKWNKKNANCLATSHDGDVRIWDKRKPSTAVEYLAAHLSKIHGLDWHPDSEHILATSSQDNSVKFWDYRQPRKYLNILPCQVPVWKARYTPFSNGLVTVMVPQLRRENSLLLWNVFDLNTPVHTFVGHDDVVLEFQWRKQKEGSKDYQLVTWSRDQTLRMWRVDSQMQRLCANDILDGVDEFIESISLLPEPEKTLHTEDTDHQHTASHGEEEALKEDPPRNLLEERKSDQLGLPQTLQQEFSLINVQIRNVNVEMDAADRSCTVSVHCSNHRVKMLVKFPAQYPNNAAPSFQFINPTTITSTMKAKLLKVGVWVPKFSLLFCIIV

SEQ ID NO: 97448 - protein, 571 aa, Homo sapiens
  Payload ID: 19433
  Gene Name: WD repeat domain 59
  Uniprot ID: Q6PJI9
  ENSP ID: ENSP00000482446
MAARWSSENVVVEFRDSQATAMSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTVALSAVAGASQVKWNKKNANCLATSHDGDVRIWDKRKPSTAVEYLAAHLSKIHGLDWHPDSEHILATSSQDNSVKFWDYRQPRKYLNILPCQVPVWKARYTPFSNGLVTVMVPQLRRENSLLLWNVFDLNTPVHTFVGHDDVVLEFQWRKQKEGSKDYQLVTWSRDQTLRMWRVDSQMQRLCANDILDGVDEFIESISLLPEPEKTLHTEDTDHQHTASHGEEEALKEDPPRNLLEERKSDQLGLPQTLQQEFSLINVQIRNVNVEMDAADRSCTVSVHCSNHRVKMLVKFPAQYPNNAAPSFQFINPTTITSTMKAKLLKILKDTALQKVKRGQSCLEPCLRQLVSCLESFVNQEDSASSNPFALPNSVTPPLPTFARVTTAYGSYQDANIPFPRTSGARFCGAGYLVYFTRPMTMHRAVSPTEPTPR

SEQ ID NO: 97449 - protein, 330 aa, Homo sapiens
  Payload ID: 19434
  Gene Name: WD repeat domain 5B
  Uniprot ID: Q86VZ2
  ENSP ID: ENSP00000330381
MATKESRDAKAQLALSSSANQSKEVPENPNYALKCTLVGHTEAVSSVKFSPNGEWLASSSADRLIIIWGAYDGKYEKTLYGHNLEISDVAWSSDSSRLVSASDDKTLKLWDVRSGKCLKTLKGHSNYVFCCNFNPPSNLIISGSFDETVKIWEVKTGKCLKTLSAHSDPVSAVHFNCSGSLIVSGSYDGLCRIWDAASGQCLKTLVDDDNPPVSFVKFSPNGKYILTATLDNTLKLWDYSRGRCLKTYTGHKNEKYCIFANFSVTGGKWIVSGSEDNLVYIWNLQTKEIVQKLQGHTDVVISAACHPTENLIASAALENDKTIKLWMSNH

SEQ ID NO: 97450 - protein, 1151 aa, Homo sapiens
  Payload ID: 19435
  Gene Name: WD repeat domain 6
  ENSP ID: ENSP00000378857
MGSAARWEGSFSREFSSLLSRGCLSTSRIDMDALEDYVWPRATSELILLPVTGLECVGDRLLAGEGPDVLVYSLDFGGHLRMIKRVQNLLGHYLIHGFRVRPEPNGDLDLEAMVAVFGSKGLRVVKISWGQGHFWELWRSGLWNMSDWIWDARWLEGNIALALGHNSVVLYDPVVGCILQEVPCTDRCTLSSACLIGDAWKELTIVAGAVSNQLLVWYPATALADNKPVAPDRRISGHVGIIFSMSYLESKGLLATASEDRSVRIWKVGDLRVPGGRVQNIGHCFGHSARVWQVKLLENYLISAGEDCVCLVWSHEGEILQAFRGHQGRGIRAIAAHERQAWVITGGDDSGIRLWHLVGRGYRGLGVSALCFKSRSRPGTLKAVTLAGSWRLLAVTDTGALYLYDVEVKCWEQLLEDKHFQSYCLLEAAPGPEGFGLCAMANGEGRVKVVPINTPTAAVDQTLFPGKVHSLSWALRGYEELLLLASGPGGVVACLEISAAPSGKAIFVKERCRYLLPPSKQRWHTCSAFLPPGDFLVCGDRRGSVLLFPSRPGLLKDPGVGGKARAGAGAPVVGSGSSGGGNAFTGLGPVSTLPSLHGKQGVTSVTCHGGYVYTTGRDGAYYQLFVRDGQLQPVLRQKSCRGMNWLAGLRIVPDGSMVILGFHANEFVVWNPRSHEKLHIVNCGGGHRSWAFSDTEAAMAFAYLKDGDVMLYRALGGCTRPHVILREGLHGREITCVKRVGTITLGPEYGVPSFMQPDDLEPGSEGPDLTDIVITCSEDTTVCVLALPTTTGSAHALTAVCNHISSVRAVAVWGIGTPGGPQDPQPGLTAHVVSAGGRAEMHCFSIMVTPDPSTPSRLACHVMHLSSHRLDEYWDRQRNRHRMVKVDPETRYMSLAVCELDQPGLGPLVAAACSDGAVRLFLLQDSGRILQLLAETFHHKRCVLKVHSFTHEAPNQRRRLLLCSAATDGSLAFWDLTTMLDHDSTVLEPPVDPGLPYRLGTPSLTLQAHSCGINSLHTLPTREGHHLVASGSEDGSLHVFVLAVEMLQLEEAVGEAGLVPQLRVLEEYSVPCAHAAHVTGLKILSPSIMVSASIDQRLTFWRLGHGEPTFMNSTVFHVPDVADMDCWPVSPEFGHRCALGGQGLEVYNWYD

SEQ ID NO: 97451 - protein, 271 aa, Homo sapiens
  Payload ID: 19435
  Gene Name: WD repeat domain 6
  ENSP ID: ENSP00000387692
MDALEDYVWPRATSELILLPVTGLECVGDRLLAESGFGFPKCPDYRREPPHPAETKDFLRFKLQDCEGPDVLVYSLDFGGHLRMIKRVQNLLGHYLIHGFRVRPEPNGDLDLEAMVAVFGSKGLRVVKISWGQGHFWELWRSGLWNMSDWIWDARWLEGNIALALGHNSVVLYDPVVGCILQEVPCTDRCTLSSACLIGDAWKELTIVAGAVSNQLLVWYPATALADNKPVAPDRRISGHVGIIFSMSYLESKGLLATASEDRSVRIWKVG

SEQ ID NO: 97452 - protein, 99 aa, Homo sapiens
  Payload ID: 19435
  Gene Name: WD repeat domain 6
  ENSP ID: ENSP00000390740
MALCLYLGEGPDVLVYSLDFGGHLRMIKRVQNLLGHYLIHGFRVRPEPNGDLDLEAMVAVFGSKGLRVVKISWGQGHFWELWRSGLWNMSDWIWDARWL

SEQ ID NO: 97453 - protein, 61 aa, Homo sapiens
  Payload ID: 19435
  Gene Name: WD repeat domain 6
  ENSP ID: ENSP00000395993
MDALEDYVWPRATSELILLPVTGLECVGDRLLAGWSAVARSRLPATSASQVQVILLPQPPE

SEQ ID NO: 97454 - protein, 569 aa, Homo sapiens
  Payload ID: 19435
  Gene Name: WD repeat domain 6
  ENSP ID: ENSP00000412195
MDALEDYVWPRATSELILLPVTGLECVGDRLLAGRDGAYYQLFVRDGQLQPVLRQKSCRGMNWLAGLRIVPDGSMVILGFHANEFVVWNPRSHEKLHIVNCGGGHRSWAFSDTEAAMAFAYLKDGDVMLYRALGGCTRPHVILREGLHGREITCVKRVGTITLGPEYGVPSFMQPDDLEPGSEGPDLTDIVITCSEDTTVCVLALPTTTGSAHALTAVCNHISSVRAVAVWGIGTPGGPQDPQPGLTAHVVSAGGRAEMHCFSIMVTPDPSTPSRLACHVMHLSSHRLDEYWDRQRNRHRMVKVDPETRYMSLAVCELDQPGLGPLVAAACSDGAVRLFLLQDSGRILQLLAETFHHKRCVLKVHSFTHEAPNQRRRLLLCSAATDGSLAFWDLTTMLDHDSTVLEPPVDPGLPYRLGTPSLTLQAHSCGINSLHTLPTREGHHLVASGSEDGSLHVFVLAVEMLQLEEAVGEAGLVPQLRVLEEYSVPCAHAAHVTGLKILSPSIMVSASIDQRLTFWRLGHGEPTFMNSTVFHVPDVADMDCWPVSPEFGHRCALGGQGLEVYNWYD

SEQ ID NO: 97455 - protein, 1070 aa, Homo sapiens
  Payload ID: 19435
  Gene Name: WD repeat domain 6
  ENSP ID: ENSP00000413432
MIKRVQNLLGHYLIHGFRVRPEPNGDLDLEAMVAVFGSKGLRVVKISWGQGHFWELWRSGLWNMSDWIWDARWLEGNIALALGHNSVVLYDPVVGCILQEVPCTDRCTLSSACLIGDAWKELTIVAGAVSNQLLVWYPATALADNKPVAPDRRISGHVGIIFSMSYLESKGLLATASEDRSVRIWKVGDLRVPGGRVQNIGHCFGHSARVWQVKLLENYLISAGEDCVCLVWSHEGEILQAFRGHQGRGIRAIAAHERQAWVITGGDDSGIRLWHLVGRGYRGLGVSALCFKSRSRPGTLKAVTLAGSWRLLAVTDTGALYLYDVEVKCWEQLLEDKHFQSYCLLEAAPGPEGFGLCAMANGEGRVKVVPINTPTAAVDQTLFPGKVHSLSWALRGYEELLLLASGPGGVVACLEISAAPSGKAIFVKERCRYLLPPSKQRWHTCSAFLPPGDFLVCGDRRGSVLLFPSRPGLLKDPGVGGKARAGAGAPVVGSGSSGGGNAFTGLGPVSTLPSLHGKQGVTSVTCHGGYVYTTGRDGAYYQLFVRDGQLQPVLRQKSCRGMNWLAGLRIVPDGSMVILGFHANEFVVWNPRSHEKLHIVNCGGGHRSWAFSDTEAAMAFAYLKDGDVMLYRALGGCTRPHVILREGLHGREITCVKRVGTITLGPEYGVPSFMQPDDLEPGSEGPDLTDIVITCSEDTTVCVLALPTTTGSAHALTAVCNHISSVRAVAVWGIGTPGGPQDPQPGLTAHVVSAGGRAEMHCFSIMVTPDPSTPSRLACHVMHLSSHRLDEYWDRQRNRHRMVKVDPETRYMSLAVCELDQPGLGPLVAAACSDGAVRLFLLQDSGRILQLLAETFHHKRCVLKVHSFTHEAPNQRRRLLLCSAATDGSLAFWDLTTMLDHDSTVLEPPVDPGLPYRLGTPSLTLQAHSCGINSLHTLPTREGHHLVASGSEDGSLHVFVLAVEMLQLEEAVGEAGLVPQLRVLEEYSVPCAHAAHVTGLKILSPSIMVSASIDQRLTFWRLGHGEPTFMNSTVFHVPDVADMDCWPVSPEFGHRCALGGQGLEVYNWYD

SEQ ID NO: 97456 - protein, 68 aa, Homo sapiens
  Payload ID: 19435
  Gene Name: WD repeat domain 6
  ENSP ID: ENSP00000414157
MDALEDYVWPRATSELILLPVTGLECVGDRLLAESGFGFPKCPDYRREPPHPAETKDFLRFKLQDCVS

SEQ ID NO: 97457 - protein, 125 aa, Homo sapiens
  Payload ID: 19435
  Gene Name: WD repeat domain 6
  ENSP ID: ENSP00000477087
MIKRVQNLLGHYLIHGFRVRPEPNGDLDLEAMVAVFGSKGLRVVKISWGQGHFWELWRSGLWNMSDWIWDARWLEGNIALALGHNSVVLYDPVVGCILQEVPCTDRCTLSSACLIGDAWKELTIV

SEQ ID NO: 97458 - protein, 1121 aa, Homo sapiens
  Payload ID: 19435
  Gene Name: WD repeat domain 6
  Uniprot ID: Q9NNW5
  ENSP ID: ENSP00000477389
MDALEDYVWPRATSELILLPVTGLECVGDRLLAGEGPDVLVYSLDFGGHLRMIKRVQNLLGHYLIHGFRVRPEPNGDLDLEAMVAVFGSKGLRVVKISWGQGHFWELWRSGLWNMSDWIWDARWLEGNIALALGHNSVVLYDPVVGCILQEVPCTDRCTLSSACLIGDAWKELTIVAGAVSNQLLVWYPATALADNKPVAPDRRISGHVGIIFSMSYLESKGLLATASEDRSVRIWKVGDLRVPGGRVQNIGHCFGHSARVWQVKLLENYLISAGEDCVCLVWSHEGEILQAFRGHQGRGIRAIAAHERQAWVITGGDDSGIRLWHLVGRGYRGLGVSALCFKSRSRPGTLKAVTLAGSWRLLAVTDTGALYLYDVEVKCWEQLLEDKHFQSYCLLEAAPGPEGFGLCAMANGEGRVKVVPINTPTAAVDQTLFPGKVHSLSWALRGYEELLLLASGPGGVVACLEISAAPSGKAIFVKERCRYLLPPSKQRWHTCSAFLPPGDFLVCGDRRGSVLLFPSRPGLLKDPGVGGKARAGAGAPVVGSGSSGGGNAFTGLGPVSTLPSLHGKQGVTSVTCHGGYVYTTGRDGAYYQLFVRDGQLQPVLRQKSCRGMNWLAGLRIVPDGSMVILGFHANEFVVWNPRSHEKLHIVNCGGGHRSWAFSDTEAAMAFAYLKDGDVMLYRALGGCTRPHVILREGLHGREITCVKRVGTITLGPEYGVPSFMQPDDLEPGSEGPDLTDIVITCSEDTTVCVLALPTTTGSAHALTAVCNHISSVRAVAVWGIGTPGGPQDPQPGLTAHVVSAGGRAEMHCFSIMVTPDPSTPSRLACHVMHLSSHRLDEYWDRQRNRHRMVKVDPETRYMSLAVCELDQPGLGPLVAAACSDGAVRLFLLQDSGRILQLLAETFHHKRCVLKVHSFTHEAPNQRRRLLLCSAATDGSLAFWDLTTMLDHDSTVLEPPVDPGLPYRLGTPSLTLQAHSCGINSLHTLPTREGHHLVASGSEDGSLHVFVLAVEMLQLEEAVGEAGLVPQLRVLEEYSVPCAHAAHVTGLKILSPSIMVSASIDQRLTFWRLGHGEPTFMNSTVFHVPDVADMDCWPVSPEFGHRCALGGQGLEVYNWYD

SEQ ID NO: 97459 - protein, 31 aa, Homo sapiens
  Payload ID: 19435
  Gene Name: WD repeat domain 6
  ENSP ID: ENSP00000477418
MALCLYLGEGPDVLVYSLDFGGHLRMIKRVQ

SEQ ID NO: 97460 - protein, 35 aa, Homo sapiens
  Payload ID: 19435
  Gene Name: WD repeat domain 6
  ENSP ID: ENSP00000477463
MIKRVQNLLGHYLIHGFRVRPEPNGDLDLEAMVAV

SEQ ID NO: 97461 - protein, 289 aa, Homo sapiens
  Payload ID: 19435
  Gene Name: WD repeat domain 6
  ENSP ID: ENSP00000482289
MHLSSHRLDEYWDRQRNRHRMVKVDPETRYMSLAVCELDQPGLGPLVAAACSDGAVRLFLLQDSGRILQLLAETFHHKRCVLKVHSFTHEAPNQRRRLLLCSAATDGSLAFWDLTTMLDHDSTVLEPPVDPGLPYRLGTPSLTLQAHSCGINSLHTLPTREGHHLVASGSEDGSLHVFVLAVEMLQLEEAVGEAGLVPQLRVLEEYSVPCAHAAHVTGLKILSPSIMVSASIDQRLTFWRLGHGEPTFMNSTVFHVPDVADMDCWPVSPEFGHRCALGGQGLEVYNWYD

SEQ ID NO: 97462 - protein, 1151 aa, Homo sapiens; identical to SEQ ID NO: 97450
  Payload ID: 19435
  Gene Name: WD repeat domain 6
  ENSP ID: ENSP00000484799

SEQ ID NO: 97463 - protein, 68 aa, Homo sapiens; identical to SEQ ID NO: 97456
  Payload ID: 19435
  Gene Name: WD repeat domain 6
  ENSP ID: ENSP00000487056

SEQ ID NO: 97464 - protein, 96 aa, Homo sapiens
  Payload ID: 19436
  Gene Name: WD repeat domain 60
  ENSP ID: ENSP00000380330
MDLPEHKEPRCRDPDQDARSRDRVAEVHTAKESPRGERDRDRQRERRRDAKDREKEKLKEKHREAEKSHSRGKDREKEKDRRARKEELRQTVAHHN

SEQ ID NO: 97465 - protein, 1066 aa, Homo sapiens
  Payload ID: 19436
  Gene Name: WD repeat domain 60
  Uniprot ID: Q8WVS4
  ENSP ID: ENSP00000384290
MEPGKRRTKDDTWKADDLRKHLWAIQSGGSKEERKHREKKLRKESEMDLPEHKEPRCRDPDQDARSRDRVAEVHTAKESPRGERDRDRQRERRRDAKDREKEKLKEKHREAEKSHSRGKDREKEKDRRARKEELRQTVAHHNLLGQETRDRQLLERAERKGRSVSKVRSEEKDEDSERGDEDRERRYRERKLQYGDSKDNPLKYWLYKEEGERRHRKPREPDRDNKHREKSSTREKREKYSKEKSNSFSDKGEERHKEKRHKEGFHFDDERHQSNVDRKEKSAKDEPRKRESQNGEHRNRGASSKRDGTSSQHAENLVRNHGKDKDSRRKHGHEEGSSVWWKLDQRPGGEETVEIEKEETDLENARADAYTASCEDDFEDYEDDFEVCDGDDDESSNEPESREKLEELPLAQKKEIQEIQRAINAENERIGELSLKLFQKRGRTEFEKEPRTDTNSSPSRASVCGIFVDFASASHRQKSRTQALKQKMRSTKLLRLIDLDFSFTFSLLDLPPVNEYDMYIRNFGKKNTKQAYVQCNEDNVERDIQTEEIETREVWTQHPGESTVVSGGSEQRDTSDAVVMPKIDTPRLCSFLRAACQVMAVLLEEDRLAAEPSWNLRAQDRALYFSDSSSQLNTSLPFLQNRKVSSLHTSRVQRQMVVSVHDLPEKSFVPLLDSKYVLCVWDIWQPSGPQKVLICESQVTCCCLSPLKAFLLFAGTAHGSVVVWDLREDSRLHYSVTLSDGFWTFRTATFSTDGILTSVNHRSPLQAVEPISTSVHKKQSFVLSPFSTQEEMSGLSFHIASLDESGVLNVWVVVELPKADIAGSISDLGLMPGGRVKLVHSALIQLGDSLSHKGNEFWGTTQTLNVKFLPSDPNHFIIGTDMGLISHGTRQDLRVAPKLFKPQQHGIRPVKVNVIDFSPFGEPIFLAGCSDGSIRLHQLSSAFPLLQWDSSTDSHAVTGLQWSPTRPAVFLVQDDTSNIYIWDLLQSDLGPVAKQQVSPNRLVAMAAVGEPEKAGGSFLALVLARASGSIDIQHLKRRWAAPEVDECNRLRLLLQEALWPEGKLHK

SEQ ID NO: 97466 - protein, 522 aa, Homo sapiens
  Payload ID: 19436
  Gene Name: WD repeat domain 60
  ENSP ID: ENSP00000392608
DNKHREKSSTREKREKYSKEKSNSFSDKGEERHKEKRHKEGFHFDDERHQSNVDRKEKSAKDEPRKRESQNGEHRNRGASSKRDGTSSQHAENLVRNHGKDKDSRRKHGHEEGSSVWWKLDQRPGGEETVEIEKEETDLENARADAYTASCEDDFEDYEDDFEVCDGDDDESSNEPESREKLEELPLAQKKEIQEIQRAINAENERIGELSLKLFQKRGRTEFEKEPRTDTNSSPSRASVCGIFVDFASASHRQKSRTQALKQKMRSTKLLRLIDLDFSFTFSLLDLPPVNEYDMYIRNFGKKNTKQAYVQCNEDNVERDIQTEEIETREVWTQHPGESTVVSGGSEQRDTSDAVVMPKIDTPRLCSFLRAACQVMAVLLEEDRLAAEPSWNLRAQDRALYFSDSSSQLNTSLPFLQSHVLLLEPFESIFTVCRNSARLSCRLGFERRLKAALLCDAERWLLDVPDRHVFHRWNPYLSKPPKPSSSSRTYLNVRPQKAELCAFTLFYSRRNVRFVLPHRFLG

SEQ ID NO: 97467 - protein, 196 aa, Homo sapiens
  Payload ID: 19436
  Gene Name: WD repeat domain 60
  ENSP ID: ENSP00000399971
SDPNHFIIGTDMGLISHGTRQDLRVAPKLFKPQQHGIRPVKVNVIDFSPFGEPIFLAGCSDGSIRLHQLSSAFPLLQWDSSTDSHAVTGLQWSPTRPAVFLVQDDTSNIYIWDLLQSDLGPVAKQQVSPNRLVAMAAVGEPEKAGGSFLALVLARASGSIDIQHLKRRWAAPEVDECNRLRLLLQEALWPEGKLHK

SEQ ID NO: 97468 - protein, 305 aa, Homo sapiens
  Payload ID: 19437
  Gene Name: WD repeat domain 61
  Uniprot ID: Q9GZS3
  ENSP ID: ENSP00000267973
MTNQYGILFKQEQAHDDAIWSVAWGTNKKENSETVVTGSLDDLVKVWKWRDERLDLQWSLEGHQLGVVSVDISHTLPIAASSSLDAHIRLWDLENGKQIKSIDAGPVDAWTLAFSPDSQYLATGTHVGKVNIFGVESGKKEYSLDTRGKFILSIAYSPDGKYLASGAIDGIINIFDIATGKLLHTLEGHAMPIRSLTFSPDSQLLVTASDDGYIKIYDVQHANLAGTLSGHASWVLNVAFCPDDTHFVSSSSDKSVKVWDVGTRTCVHTFFDHQDQVWGVKYNGNGSKIVSVGDDQEIHIYDCPI

SEQ ID NO: 97469 - protein, 212 aa, Homo sapiens
  Payload ID: 19437
  Gene Name: WD repeat domain 61
  ENSP ID: ENSP00000453024
MTNQYGILFKQEQVDAWTLAFSPDSQYLATGTHVGKVNIFGVESGKKEYSLDTRGKFILSIAYSPDGKYLASGAIDGIINIFDIATGKLLHTLEGHAMPIRSLTFSPDSQLLVTASDDGYIKIYDVQHANLAGTLSGHASWVLNVAFCPDDTHFVSSSSDKSVKVWDVGTRTCVHTFFDHQDQVWGVKYNGNGSKIVSVGDDQEIHIYDCPI

SEQ ID NO: 97470 - protein, 72 aa, Homo sapiens
  Payload ID: 19437
  Gene Name: WD repeat domain 61
  ENSP ID: ENSP00000453118
LLHTLEGHAMPIRSLTFSPDSQLLVTASDDGYIKIYDVCRFLLLSSPTPHASASSLLGAGKLTKHGKLQQCS

SEQ ID NO: 97471 - protein, 48 aa, Homo sapiens
  Payload ID: 19437
  Gene Name: WD repeat domain 61
  ENSP ID: ENSP00000453493
MTNQYGILFKQEQAHDDAIWSVAWGTNKKENSETVVTGSLDDLVKVWK

SEQ ID NO: 97472 - protein, 189 aa, Homo sapiens
  Payload ID: 19437
  Gene Name: WD repeat domain 61
  ENSP ID: ENSP00000453589
MTNQYGILFKQEQAHDDAIWSVAWGTNKKENSETVVTGSLDDLVKVWKWRDERLDLQWSLEGHQLGVVSVDISHTLPIAASSSLDAHIRLWDLENGKQIKSIDAGPVDAWTLAFSPDSQYLATGTHVGKVNIFGVESGKKEYSLDTRGKFILSIAYSPDGKYLASGAIDGIINIFDIATGKLLHTLEGG

SEQ ID NO: 97473 - protein, 305 aa, Homo sapiens; identical to SEQ ID NO: 97468
  Payload ID: 19437
  Gene Name: WD repeat domain 61
  Uniprot ID: Q9GZS3
  ENSP ID: ENSP00000453801

SEQ ID NO: 97474 - protein, 294 aa, Homo sapiens
  Payload ID: 19437
  Gene Name: WD repeat domain 61
  ENSP ID: ENSP00000453902
MTNQYGILFKQEQAHDDAIWSVAWGTNKKENSETVVTGSLDDLVKVWKWRDERLDLQWSLEGHQLGVVSVDISHTLPIAASSSLDAHIRLWDLENGKQIKSIDAGPVDAWTLAFSPDSQYLATGTHVGKVNIFGVESGKKEYSLDTRGKFILSIAYSPDGKYLASGAIDGIINIFDIATGKLLHTLEGHAMPIRSLTFSPDSQLLVTASDDGYIKIYDVQHANLAGTLSGHASWVLNVAFCPDDTHFVSSSSDKSVKVWDVGTRTCVHTFFDHQDQVWGVKYNGNGSKIVSVGD

SEQ ID NO: 97475 - protein, 163 aa, Homo sapiens
  Payload ID: 19437
  Gene Name: WD repeat domain 61
  ENSP ID: ENSP00000455689
  MOD_RES (1)..(1): Any amino acid
XNIFGVESGKKEYSLDTRGKFILSIAYSPDGKYLASGAIDGIINIFDIATGKLLHTLEGHAMPIRSLTFSPDSQLLVTASDDGYIKIYDVQHANLAGTLSGHASWVLNVAFCPDDTHFVSSSSDKSVKVWDVGTRTCVHTFFDHQDQVSLLAALKPYSPCFCF

SEQ ID NO: 97476 - protein, 1518 aa, Homo sapiens
  Payload ID: 19438
  Gene Name: WD repeat domain 62
  Uniprot ID: O43379
  ENSP ID: ENSP00000270301
MAAVGSGGYARNDAGEKLPSVMAGVPARRGQSSPPPAPPICLRRRTRLSTASEETVQNRVSLEKVLGITAQNSSGLTCDPGTGHVAYLAGCVVVILDPKENKQQHIFNTARKSLSALAFSPDGKYIVTGENGHRPAVRIWDVEEKNQVAEMLGHKYGVACVAFSPNMKHIVSMGYQHDMVLNVWDWKKDIVVASNKVSCRVIALSFSEDSSYFVTVGNRHVRFWFLEVSTETKVTSTVPLVGRSGILGELHNNIFCGVACGRGRMAGSTFCVSYSGLLCQFNEKRVLEKWINLKVSLSSCLCVSQELIFCGCTDGIVRIFQAHSLHYLANLPKPHYLGVDVAQGLEPSFLFHRKAEAVYPDTVALTFDPIHQWLSCVYKDHSIYIWDVKDINRVGKVWSELFHSSYVWNVEVYPEFEDQRACLPSGSFLTCSSDNTIRFWNLDSSPDSHWQKNIFSNTLLKVVYVENDIQHLQDMSHFPDRGSENGTPMDVKAGVRVMQVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSIYFRSAQQGSDGLHFVRTHHVAEKTTLYDMDIDITQKYVAVACQDRNVRVYNTVNGKQKKCYKGSQGDEGSLLKVHVDPSGTFLATSCSDKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGLAFHAKRSYQPHGRWAERAGQEPLKTILDAQDLDCYFTPMKPESLENSILDSLEPQSLASLLSESESPQEAGRGHPSFLPQQKESSEASELILYSLEAEVTVTGTDSQYCRKEVEAGPGDQQGDSYLRVSSDSPKDQSPPEDSGESEADLECSFAAIHSPAPPPDPAPRFATSLPHFPGCAGPTEDELSLPEGPSVPSSSLPQTPEQEKFLRHHFETLTESPCRALGDVEASEAEDHFFNPRLSISTQFLSSLQKASRFTHTFPPRATQCLVKSPEVKLMDRGGSQPRAGTGYASPDRTHVLAAGKAEETLEAWRPPPPCLTSLASCVPASSVLPTDRNLPTPTSAPTPGLAQGVHAPSTCSYMEATASSRARISRSISLGDSEGPIVATLAQPLRRPSSVGELASLGQELQAITTATTPSLDSEGQEPALRSWGNHEARANLRLTLSSACDGLLQPPVDTQPGVTVPAVSFPAPSPVEESALRLHGSAFRPSLPAPESPGLPAHPSNPQLPEARPGIPGGTASLLEPTSGALGLLQGSPARWSEPWVPVEALPPSPLELSRVGNILHRLQTTFQEALDLYRVLVSSGQVDTGQQQARTELVSTFLWIHSQLEAECLVGTSVAPAQALPSPGPPSPPTLYPLASPDLQALLEHYSELLVQAVRRKARGH

SEQ ID NO: 97477 - protein, 1523 aa, Homo sapiens
  Payload ID: 19438
  Gene Name: WD repeat domain 62
  Uniprot ID: O43379
  ENSP ID: ENSP00000384792
MAAVGSGGYARNDAGEKLPSVMAGVPARRGQSSPPPAPPICLRRRTRLSTASEETVQNRVSLEKVLGITAQNSSGLTCDPGTGHVAYLAGCVVVILDPKENKQQHIFNTARKSLSALAFSPDGKYIVTGENGHRPAVRIWDVEEKNQVAEMLGHKYGVACVAFSPNMKHIVSMGYQHDMVLNVWDWKKDIVVASNKVSCRVIALSFSEDSSYFVTVGNRHVRFWFLEVSTETKVTSTVPLVGRSGILGELHNNIFCGVACGRGRMAGSTFCVSYSGLLCQFNEKRVLEKWINLKVSLSSCLCVSQELIFCGCTDGIVRIFQAHSLHYLANLPKPHYLGVDVAQGLEPSFLFHRKAEAVYPDTVALTFDPIHQWLSCVYKDHSIYIWDVKDINRVGKVWSELFHSSYVWNVEVYPEFEDQRACLPSGSFLTCSSDNTIRFWNLDSSPDSHWQKNIFSNTLLKVVYVENDIQHLQDMSHFPDRGSENGTPMDVKAGVRVMQVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSIYFRSAQQGSDGLHFVRTHHVAEKTTLYDMDIDITQKYVAVACQDRNVRVYNTVNGKQKKCYKGSQGDEGSLLKVHVDPSGTFLATSCSDKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGLAFHAKRSYQPHGRWAERAGQEPLKTILDAQDLDCYFTPMKPESLENSILDSLEPQSLASLLSESESPQEAGRGHPSFLPQQKESSEASELILYSLEAEVTVTGTDSQYCRKEVEAGPGDQQGDSYLRVSSDSPKDQSPPEDSGESEADLECSFAAIHSPAPPPDPAPRFATSLPHFPGCAGPTEDELSLPEGPSVPSSSLPQTPEQEKFLRHHFETLTESPCRELFPAALGDVEASEAEDHFFNPRLSISTQFLSSLQKASRFTHTFPPRATQCLVKSPEVKLMDRGGSQPRAGTGYASPDRTHVLAAGKAEETLEAWRPPPPCLTSLASCVPASSVLPTDRNLPTPTSAPTPGLAQGVHAPSTCSYMEATASSRARISRSISLGDSEGPIVATLAQPLRRPSSVGELASLGQELQAITTATTPSLDSEGQEPALRSWGNHEARANLRLTLSSACDGLLQPPVDTQPGVTVPAVSFPAPSPVEESALRLHGSAFRPSLPAPESPGLPAHPSNPQLPEARPGIPGGTASLLEPTSGALGLLQGSPARWSEPWVPVEALPPSPLELSRVGNILHRLQTTFQEALDLYRVLVSSGQVDTGQQQARTELVSTFLWIHSQLEAECLVGTSVAPAQALPSPGPPSPPTLYPLASPDLQALLEHYSELLVQAVRRKARGH

SEQ ID NO: 97478 - protein, 318 aa, Homo sapiens
  Payload ID: 19438
  Gene Name: WD repeat domain 62
  ENSP ID: ENSP00000413475
GGYARNDAGEKLPSVMAGVPARRGQSSPPPAPPICLRRRTRLSTASEETVQNRVSLEKVLGITAQNSSGLTCDPGTGHVAYLAGMWRMGPASESCGEDSIAPSLSRTVPGMYCVVVILDPKENKQQHIFNTARKSLSALAFSPDGKYIVTGENGHRPAVRIWDVEEKNQVAEMLGHKYGVACVAFSPNMKHIVSMGYQHDMVLNVWDWKKDIVVASNKVSCRVIALSFSEDSSYFVTVGNRHVRFWFLEVSTETKVTSTVPLVGRSGILGELHNNIFCGVACGRGRMAGSTFCVSYSGLLCQFNEKRVLEKWINLKVS

SEQ ID NO: 97479 - protein, 483 aa, Homo sapiens
  Payload ID: 19438
  Gene Name: WD repeat domain 62
  Uniprot ID: O43379
  ENSP ID: ENSP00000465525
MAAVGSGGYARNDAGEKLPSVMAGVPARRGQSSPPPAPPICLRRRTRLSTASEETVQNRVSLEKVLGITAQNSSGLTCDPGTGHVAYLAGCVVVILDPKENKQQHIFNTARKSLSALAFSPDGKYIVTGENGHRPAVRIWDVEEKNQVAEMLGHKYGVACVAFSPNMKHIVSMGYQHDMVLNVWDWKKDIVVASNKVSCRVIALSFSEDSSYFVTVGNRHVRFWFLEVSTETKVTSTVPLVGRSGILGELHNNIFCGVACGRGRMAGSTFCVSYSGLLCQFNEKRVLEKWINLKVSLSSCLCVSQELIFCGCTDGIVRIFQAHSLHYLANLPKPHYLGVDVAQGLEPSFLFHRKAEAVYPDTVALTFDPIHQWLSCVYKDHSIYIWDVKDINRVGKVWSELFHSSYVWNVEVYPEFEDQRACLPSGSFLTCSSDNTIRFWNLDSSPDSHWQKNIFSNLAPALQMCGRGHSRQPNTPSPGEIAS

SEQ ID NO: 97480 - protein, 891 aa, Homo sapiens
  Payload ID: 19439
  Gene Name: WD repeat domain 63
  Uniprot ID: Q8IWG1
  ENSP ID: ENSP00000294664
MAPKQKKKTSRGKKRLKPVLAASEDMEPVNMESMGHPEIYPLVLTTKTQEIFNCRIDEDVTDEQPYKLINKEDIFEDLRNRAAVSDFHPVKKIVQEYPGNELLLVYDKDFKYGLNFYLIATEEGKENYLNPPEVPEEQEEYKEHIPEDVYIYKPPVSKPWVSLGSEKEIEEESVTESTKQITYMISRKRSEFGAPIKFSDQNASSVKDAYIECTAYPDKNFTLKQLEKDVGMQVIPQIKDISTQTKWTYPKNATTQYYPREFSEEEKETLKQSKPLVDFLNNASISVEIALQQNEIMNTFIDDWKYLAEEEGTFGDKTDTHLKEYQSFTDLHSPTEKMITCVSWHPTIYGLIAVSVAVRLSFEDRVHFSGKLLLQPSLILFWSFSDPIHPQLMLESPDDIFCFKFCPSDPNIIAGGCINGQIVMWDITAHADRIENIKAGGSRSKRATLKPMFLLEPESNKEAMYIRHCAVSSIENGHKKVITDIHWLSDTFEINRMGSVFENRSGICCQLVTCSADCTICFWDIRPQKPLTPQTTEKKKEESIEIPFDVPSTFLHLDLSWKPLTKVRLSKGETSLDHCPTKISLNEDHLLCKTQDKMLAQSKTEKAEEMNPYHNLESGMANLLKPIDDFCTKFFVGTEEGEVIYTDWKMEKDPETGRLMSKKPVSHHTIHDGTVHTIQRSPFYNDIILTVGGWNVAIWKEGVMTGPLLQSCCAPKRYTSGHWSLTRPGVFYIGREDGYIDIWDLLEKTHEPAQSQNICITMITYIKPWIFSSKQQFIATADYYGTLHILEIPWTLSRPSTNEMASVNHYFEREVKHLEYVEQRKKIREQEKKEMELEMAKKKVKTYQKSKEQMQAELKMDYESYLELEKTVLINLGLIKVTEKGSYMEVM

SEQ ID NO: 97481 - protein, 852 aa, Homo sapiens
  Payload ID: 19439
  Gene Name: WD repeat domain 63
  Uniprot ID: Q8IWG1
  ENSP ID: ENSP00000317463
MAPKQKKKTSRGKKRLKPVLAASEDMEPVNMESMGHPEIYPLVLTTKTQEIFNCRIDEDVTDEQPYKLINKEDIFEDLRNRAAVSDFHPVKKIVQEYPGNELLLVYDKDFKYGLNFYLIATEEGKENYLNPPEVPEEQEEYKEHIPEDVYIYKPPVSKPWVSLGSEKEIEEESVTESTKQITYMISRKRSEFGAPIKFSDQNASSVKDAYIECTAYPDKNFTLKQLEKDVGMQVIPQIKDISTQTKCVEIALQQNEIMNTFIDDWKYLAEEEGTFGDKTDTHLKEYQSFTDLHSPTEKMITCVSWHPTIYGLIAVSVAVRLSFEDRVHFSGKLLLQPSLILFWSFSDPIHPQLMLESPDDIFCFKFCPSDPNIIAGGCINGQIVMWDITAHADRIENIKAGGSRSKRATLKPMFLLEPESNKEAMYIRHCAVSSIENGHKKVITDIHWLSDTFEINRMGSVFENRSGICCQLVTCSADCTICFWDIRPQKPLTPQTTEKKKEESIEIPFDVPSTFLHLDLSWKPLTKVRLSKGETSLDHCPTKISLNEDHLLCKTQDKMLAQSKTEKAEEMNPYHNLESGMANLLKPIDDFCTKFFVGTEEGEVIYTDWKMEKDPETGRLMSKKPVSHHTIHDGTVHTIQRSPFYNDIILTVGGWNVAIWKEGVMTGPLLQSCCAPKRYTSGHWSLTRPGVFYIGREDGYIDIWDLLEKTHEPAQSQNICITMITYIKPWIFSSKQQFIATADYYGTLHILEIPWTLSRPSTNEMASVNHYFEREVKHLEYVEQRKKIREQEKKEMELEMAKKKVKTYQKSKEQMQAELKMDYESYLELEKTVLINLGLIKVTEKGSYMEVM

SEQ ID NO: 97482 - protein, 852 aa, Homo sapiens; identical to SEQ ID NO: 97481
  Payload ID: 19439
  Gene Name: WD repeat domain 63
  Uniprot ID: Q8IWG1
  ENSP ID: ENSP00000359628

SEQ ID NO: 97483 - protein, 368 aa, Homo sapiens
  Payload ID: 19439
  Gene Name: WD repeat domain 63
  ENSP ID: ENSP00000433294
MAPKQKKKTSRGKKRLKPVLAASEDMEPVNMESMGHPEIYPLVLTTKTQEIFNCRIDEDVTDEQPYKLINKEDIFEDLRNRAAVSDFHPVKKIVQEYPGNELLLVYDKDFKYGLNFYLIATEEGKENYLNPPEVPEEQEEYKEHIPEDVYIYKPPVSKPWVSLGSEKEIEEESVTESTKQITYMISRKRSEFGAPIKFSDQNASSVKDAYIECTAYPDKNFTLKQLEKDVGMQVIPQIKDISTQTKWTYPKNATTQYYPREFSEEEKETLKQSKPLVDFLNNASISVEIALQQNEIMNTFIDDWKYLAEEEGTFGDKTDTHLKEYQSFTDLHSPTEKMITCVSWHPTIYGTCHVLSTPSLSCVLPTTL

SEQ ID NO: 97484 - protein, 124 aa, Homo sapiens
  Payload ID: 19439
  Gene Name: WD repeat domain 63
  ENSP ID: ENSP00000435102
MAPKQKKKTSRGKKRLKPVLAGHPEIYPLVLTTKTQEIFNCRIDEDVTDEQPYKLINKEDIFEDLRNRAAVSDFHPVKKIVQEYPGNELLLVYDKDFKYGLNFYLIATEEGKENYLNPPEVPEE

SEQ ID NO: 97485 - protein, 128 aa, Homo sapiens
  Payload ID: 19439
  Gene Name: WD repeat domain 63
  ENSP ID: ENSP00000435544
TSGHWSLTRPGVFYIGREDGYIDIWDLLEKTHEPAQSQNICITMITYIKPWIFSSKQQFIATADYYGTLHILEIPWTLSRPSTNEMASVNHYFEREVKHLEYVEQRKKIREQEKKEMELEMAKKKVVS

SEQ ID NO: 97486 - protein, 1081 aa, Homo sapiens
  Payload ID: 19440
  Gene Name: WD repeat domain 64
  Uniprot ID: B1ANS9
  ENSP ID: ENSP00000355510
MDIRKEKRLNMALQMSNFKKALNRFEKLVEQTAAQKRDERAGLFIHKEDAIGYDKFYASVQKLFGPDVKNQDVKRFYRKLCNNTDASADWCEIFGYFSSEEDPIASQLDEENLVFFVSRKRRILISGSRRRDVIKSIVKIPHLDLLITATQKGLITVFNNQDTSWITGCDYLLQLKRIVATTERTIIVWDYKAQGSSQENYFVIKPMDHCLLCVCVVPLPDHLCRDDILLGDDGGFVNRFTVNSDDFGIKQAKSKRKLQNQVLDSKNFKSVKRKLHNDWVMKIRYISALNCFGSCSLDSNHSLVLESLKRLEDNLPVREFSMPRGANTFCYCVKANVIVTGGDDKVIRLWHPNISTKPVGKLVGHMFSIAEIVTNEKDQHVVSLSSAKVFRVWDIQTLSLLQVFHDSQGGPGDMQIYSMIYDANHGMLITGSSVMDMYPLTRMIQDTKQVPHTHEREINVMLYNKYFHQVLTICSESIIRVWELETGLQVYQILEPHGFNTEVTSAAVDESGFLFATGAYNGTVRIWDFGSGQEMKVLPEGKDWKEDEHCLRRLIFLKAQEKHQQLVLALERNGTIKMIQGKEDDIYLMVIWELPDVVPFLQDGKHAVHLRMSTRDRNMAIPFPDVELIVERNFSQPTDNPTMDLLRVNCIDLLQVEGYNLIAAGTLNGVIILWNFVTSTVKKVYRPEDCFTVNPDLHPKHFKINDILFLFRTPECARRSSQDSICSSSQCESSKGPQSSKGSKQSIHDSEVKGEQTDVMVGKQQPMDKKHPGIANLPEAQPPILVTAHEDGHLRLWTLEGRLLKDMLPFTKHSAISLTSLYTDSCTRILLAGNVEGHVILCNISSFLDPPHDEKKFKQLLSWRAHSLEIIQVIYVEEKQVVLTASIDGSVRLWHALNGHYCGYFGQRRLFELSQTRDFILPCDVTEYPIEIKEESKFTEKQKYEYPLIFDREKWRKMSSVSLLFKRTPPKAFEVEQDFKFFKSLSSPKIRRYPLEGFVTENREAGIVFGSLPIYSISSPTSLRFLPLIGVEAQKDSSDGITGKKKGGHVQREKAPRRRSLKKNLVPQINLASSFFPAIPK

SEQ ID NO: 97487 - protein, 634 aa, Homo sapiens
  Payload ID: 19440
  Gene Name: WD repeat domain 64
  ENSP ID: ENSP00000402446
MKIRYISALNCFGSCSLDSNHSLVLESLKRLEDNLPVREFSMPRGANTFCYCVKANVIVTGGDDKVIRLWHPNISTKPVGKLVGHMFSIAEIVTNEKDQHVVSLSSAKVFRVWDIQTLSLLQVFHDSQGGPGDMQIYSMIYDANHGMLITGSSVMDMYPLTRMIQDTKQVPHTHEREINVMLYNKYFHQVLTICSESIIRVWELETGLQVYQILEPHGFNTEVTSAAVDESGFLFATGAYNGTVRIWDFGSGQEMKVLPEGKDWKEDEHCLRRLIFLKAQEKHQQLVLALERNGTIKMIQGKEDDIYLMVIWELPDVVPFLQDGKHAVHLRMSTRDRNMAIPFPDVELIVERNFSQPTDNPTMDLLRVNCIDLLQVEGYNLIAAGTLNEGHVILCNISSFLDPPHDEKKFKQLLSWRAHSLEIIQVIYVEEKQVVLTASIDGSVRLWHALNGHYCGYFGQRRLFELSQTRDFILPCDVTEYPIEIKEESKFTEKQKYEYPLIFDREKWRKMSSVSLLFKRTPPKAFEVEQDFKFFKSLSSPKIRRYPLEGFVTENREAGIVFGSLPIYSISSPTSLRFLPLIGVEAQKDSSDGITGKKKGGHVQREKVTRRRSLKKNLVPQINLASSFFPAIPK

SEQ ID NO: 97488 - protein, 560 aa, Homo sapiens
  Payload ID: 19440
  Gene Name: WD repeat domain 64
  ENSP ID: ENSP00000406342
  MOD_RES (1)..(1): Any amino acid
XTVRIWDFGSGQEMKVLPEGKDWKEDEHCLRRLIFLKAQEKHQQLVLALERNGTIKMIQGKEDDIYLMVIWELPDVVPFLQDGKHAVHLRMSTRDRNMAIPFPDVELIVERNFSQPTDNPTMDLLRVNCIDLLQVEGYNLIAAGTLNGVIILWNFVTSTVKKVYRPEDCFTVNPDLHPKHFKINDILFLFRTPECARRSSQDSICSSSQCESSKGPQSSKGSKQSIHDSEVKGEQTDVMVGKQQPMDKKHPGIANLPEAQPPILVTAHEDGHLRLWTLEGRLLKDMLPFTKHSAISLTSLYTDSCTRILLAGNVEGHVILCNISSFLDPPHDEKKFKQLLSWRAHSLEIIQVIYVEEKQVVLTASIDGSVRLWHALNGHYCGYFGQRRLFELSQTRDFILPCDVTEYPIEIKEESKFTEKQKYEYPLIFDREKWRKMSSVSLLFKRTPPKAFEVEQDFKFFKSLSSPKIRRYPLEGFVTENREAGIVFGSLPIYSISSPTSLRFLPLIGVEAQKDSSDGITGKKKGGHVQREKAPRRRSLKKNLVPQINLASSFFPAIPK

SEQ ID NO: 97489 - protein, 685 aa, Homo sapiens
  Payload ID: 19440
  Gene Name: WD repeat domain 64
  ENSP ID: ENSP00000406656
LGDDGGFVNRFTVNSDDFGIKQAKSKRKLQNQVLDSKNFKSVKRKLHNDWVMKIRYISALNCFGSCSLDSNHSLVLESLKRLEDNLPVREFSMPRGANTFCYCVKANVIVTGGDDKVIRLWHPNISTKPVGKLVGHMFSIAEIVTNEKDQHVVSLSSAKVFRVWDIQTLSLLQVFHDSQGGPGDMQIYSMIYDANHGMLITGSSVMDMYPLTRMIQDTKQVPHTHEREINVMLYNKYFHQVLTICSESIIRVWELETGLQVYQILEPHGFNTEVTSAAVDESGFLFATGAYNGTVRIWDFGSGQEMKVLPEGKDWKEDEHCLRRLIFLKAQEKHQQLVLALERNGTIKMIQGKEDDIYLMVIWELPDVVPFLQDGKHAVHLRMSTRDRNMAIPFPDVELIVERNFSQPTDNPTMDLLRVNCIDLLQVEGYNLIAAGTLNEGHVILCNISSFLDPPHDEKKFKQLLSWRAHSLEIIQVIYVEEKQVVLTASIDGSVRLWHALNGHYCGYFGQRRLFELSQTRDFILPCDVTEYPIEIKEESKFTEKQKYEYPLIFDREKWRKMSSVSLLFKRTPPKAFEVEQDFKFFKSLSSPKIRRYPLEGFVTENREAGIVFGSLPIYSISSPTSLRFLPLIGVEAQKDSSDGITGKKKGGHVQREKAPRRRSLKKNLVPQINLASSFFPAIPK

SEQ ID NO: 97490 - protein, 522 aa, Homo sapiens
  Payload ID: 19440
  Gene Name: WD repeat domain 64
  ENSP ID: ENSP00000431729
RMIQDTKQVPHTHEREINVMLYNKYFHQVLTICSESIIRVWELETGLQVYQILEPHGFNTEVTSAAVDESGFLFATGAYNGTVRIWDFGSGQEMKVLPEGKDWKEDEHCLRRLIFLKAQEKHQQLVLALERNGTIKMIQGKEDDIYLMVIWELPDVVPFLQDGKHAVHLRMSTRDRNMAIPFPDVELIVERNFSQPTDNPTMDLLRVNCIDLLQVEGYNLIAAGTLNGVIILWNFVTSTVKKVYRPEDCFTVNPDLHPKHFKINDILFLFRTPECARRSSQDSICSSSQCESSKGPQSSKGSKQSIHDSEVKGEQTDVMVGKQQPMDKKHPGIANLPEAQPPILVTAHEDGHLRLWTLEGRLLKDMLPFTKHSAISLTSLYTDSCTRILLAGNVEGHVILCNISSFLDPPHDEKKFKQLLSWRAHSLEIIQVIYVEEKQVVLTASIDGSVRLWHALNGHYCGYFGQRRLFELSQTRDFILPCDVTEYPIEIKEESKFTEKQKYEYPLIFDREKFEDIPWKVS

SEQ ID NO: 97491 - protein, 1149 aa, Homo sapiens
  Payload ID: 19441
  Gene Name: WD repeat domain 66
  Uniprot ID: Q8TBY9
  ENSP ID: ENSP00000288912
MSDAAEAPREATGENGETEMKEEEEPNPNYKEVEDPQQESKDDTIAWRESQEEERKTGEEEGEEEGKEDKKIVMEETEEKAGEVQEKEASGIQEETTVEPQEVTASMIRLETQITDSQSITSGIFPKTQRGSKSKLSLQLEDAETDELLRDLSTQIEFLDLDQISPEEQQISSPERQPSGELEEKTDRMPQDELGQERRDLEPENREEGQERRVSDIQSKAGISRESLVSSTTEDILFQKDKSTPVYPLTMTWSFGWNSSLPVYYIREERQRVLLYVCAHTAIIYNVFRNNQYHLQGHANIISCLCVSEDRRWIATADKGPDCLVIIWDSFTGIPVHTIFDSCPEGNGIMAMAMTHDAKYLATISDAEVQKVCIWKWTLAVETPACTLELPTEYGVQNYVTFNPTNNKELVSNSKTRAIYYAWYEERDTLAHSAPLLTEKTFNKLVGKFSQSIFHLNLTQILSATMEGKLVVWDIHRPPSSASTFLGFPYIKPCKLVHLQKEGITVLTTIDSYIVTGDIKGNIKFYDHTLSIVNWYSHLKLGAIRTLSFSKTPATPPTEKSNYPPDCTLKGDLFVLRNFIIGTSDAAVYHLTTDGTKLEKLFVEPKDAICAISCHPYQPLIAIGSICGMIKVWNYENKQYLFSRVFEKGLGVQSLTYNPEGALLGAGFTEGTVYILDAMSLENESPEPFKYSRTSVTHISFSHDSQYMATADRSFTVAVYMLVVRNGQRVWEYLARLRSHRKSIRSLLFGVYLDSNEPRLLSLGTDRLLIEYDLLRSYKDHLEVLDIHHTDQGCYPTCMVWYPPLTRELFLLICNSGYKVKLFNATTKMCRKTLLGPAYGSPIEQTQVLPVRSMAELQKRYLVFINRDKVGLQILPVDGNPHKTSAIVCHPNGVAGMAVSYDGCYAFTAGGHDRSVVQWKITLSVLEAAVSLGGEDLTPFYGLLSGGREGKFYRELEDYFYYSQLRSQGIDTMETRKVSEHICLSELPFVMRAIGFYPSEEKIDDIFNEIKFGEYVDTGKLIDKINLPDFLKVYLNHKPPFGNTMSGIHKSFEVLGYTNSKGKKAIRREDFLRLLVTKGEHMTEEEMLDCFASLFGLNPEGWKSEPATCSVKGSEICLEEELPDEITAEIFATEILGLTISEDSGQDGQ

SEQ ID NO: 97492 - protein, 941 aa, Homo sapiens
  Payload ID: 19441
  Gene Name: WD repeat domain 66
  Uniprot ID: Q8TBY9
  ENSP ID: ENSP00000380595
MSDAAEAPREATGENGETEMKEEEEPNPNYKEVEDPQQESKDDTIAWRESQEEERKTGEEEGEEEGKEDKKIVMEETEEKAGEVQEKEASGIQEETTVEPQEVTASMIRLETQITDSQSITSGIFPKTQRGSKSKLSLQLEDAETDELLRDLSTQIEFLDLDQISPEEQQISSPERQPSGELEEKTDRMPQDELGQERRDLEPENREEGQERRVSDIQSKAGISRESLVSSTTEDILFQKDKSTPVYPLTMTWSFGWNSSLPVYYIREERQRVLLYVCAHTAIIYNVFRNNQYHLQGHANIISCLCVSEDRRWIATADKGPDCLVIIWDSFTGIPVHTIFDSCPEGNGIMAMAMTHDAKYLATISDAEVQKVCIWKWTLAVETPACTLELPTEYGVQNYVTFNPTNNKELVSNSKTRAIYYAWYEERDTLAHSAPLLTEKTFNKLVGKFSQSIFHLNLTQILSATMEGKLVVWDIHRPPSSASTFLGFPYIKPCKLVHLQKEGITVLTTIDSYIVTGDIKGNIKFYDHTLSIVNWYSHLKLGAIRTLSFSKTPATPPTEKSNYPPDCTLKGDLFVLRNFIIGTSDAAVYHLTTDGTKLEKLFVEPKDAICAISCHPYQPLIAIGSICGMIKVWNYENKQYLFSRVFEKGLGVQSLTYNPEGALLGAGFTEGTVYILDAMSLENESPEPFKYSRTSVTHISFSHDSQYMATADRSFTVAVYMLVVRNGQRVWEYLARLRSHRKSIRSLLFGVYLDSNEPRLLSLGTDRLLIEYDLLRSYKDHLEVLDIHHTDQGCYPTCMVWYPPLTRELFLLICNSGYKVKLFNATTKMCRKTLLGPAYGSPIEQTQVLPVRSMAELQKRYLVFINRDKVGLQILPVDGNPHKTSAIVCHPNGVAGMAVSYDGCYAFTAGGHDRSVVQWKITLSHPGSQAPILSPSDTSRS

SEQ ID NO: 97493 - protein, 1490 aa, Homo sapiens
  Payload ID: 19442
  Gene Name: WD repeat domain 7
  Uniprot ID: Q9Y4E6
  ENSP ID: ENSP00000254442
MAGNSLVLPIVLWGRKAPTHCISAVLLTDDGATIVTGCHDGQICLWDLSVELQINPRALLFGHTASITCLSKACASSDKQYIVSASESGEMCLWDVSDGRCIEFTKLACTHTGIQFYQFSVGNQREGRLLCHGHYPEILVVDATSLEVLYSLVSKISPDWISSMSIIRSHRTQEDTVVALSVTGILKVWIVTSEISDMQDTEPIFEEESKPIYCQNCQSISFCAFTQRSLLVVCSKYWRVFDAGDYSLLCSGPSENGQTWTGGDFVSSDKVIIWTENGQSYIYKLPASCLPASDSFRSDVGKAVENLIPPVQHILLDRKDKELLICPPVTRFFYGCREYFHKLLIQGDSSGRLNIWNISDTADKQGSEEGLAMTTSISLQEAFDKLNPCPAGIIDQLSVIPNSNEPLKVTASVYIPAHGRLVCGREDGSIVIVPATQTAIVQLLQGEHMLRRGWPPHRTLRGHRNKVTCLLYPHQVSARYDQRYLISGGVDFSVIIWDIFSGEMKHIFCVHGGEITQLLVPPENCSARVQHCICSVASDHSVGLLSLREKKCIMLASRHLFPIQVIKWRPSDDYLVVGCSDGSVYVWQMDTGALDRCVMGITAVEILNACDEAVPAAVDSLSHPAVNLKQAMTRRSLAALKNMAHHKLQTLATNLLASEASDKGNLPKYSHNSLMVQAIKTNLTDPDIHVLFFDVEALIIQLLTEEASRPNTALISPENLQKASGSSDKGGSFLTGKRAAVLFQQVKETIKENIKEHLLDDEEEDEEIMRQRREESDPEYRSSKSKPLTLLEYNLTMDTAKLFMSCLHAWGLNEVLDEVCLDRLGMLKPHCTVSFGLLSRGGHMSLMLPGYNQPACKLSHGKTEVGRKLPASEGVGKGTYGVSRAVTTQHLLSIISLANTLMSMTNATFIGDHMKKGPTRPPRPSTPDLSKARGSPPTSSNIVQGQIKQVAAPVVSARSDADHSGSDPPSAPALHTCFLVNEGWSQLAAMHCVMLPDLLGLDKFRPPLLEMLARRWQDRCLEVREAAQALLLAELRRIEQAGRKEAIDAWAPYLPQYIDHVISPGVTSEAAQTITTAPDASGPEAKVQEEEHDLVDDDITTGCLSSVPQMKKISTSYEERRKQATAIVLLGVIGAEFGAEIEPPKLLTRPRSSSQIPEGFGLTSGGSNYSLARHTCKALTFLLLQPPSPKLPPHSTIRRTAIDLIGRGFTVWEPYMDVSAVLMGLLELCADAEKQLANITMGLPLSPAADSARSARHALSLIATARPPAFITTIAKEVHRHTALAANTQSQQNMHTTTLARAKGEILRVIEILIEKMPTDVVDLLVEVMDIIMYCLEGSLVKKKGLQECFPAICRFYMVSYYERNHRIAVGARHGSVALYDIRTGKCQTIHGHKGPITAVAFAPDGRYLATYSNTDSHISFWQMNTSLLGSIGMLNSAPQLRCIKTYQVPPVQPASPGSHNALKLARLIWTSNRNVILMAHDGKEHRFMV

SEQ ID NO: 97494 - protein, 1457 aa, Homo sapiens
  Payload ID: 19442
  Gene Name: WD repeat domain 7
  Uniprot ID: Q9Y4E6
  ENSP ID: ENSP00000350187
MAGNSLVLPIVLWGRKAPTHCISAVLLTDDGATIVTGCHDGQICLWDLSVELQINPRALLFGHTASITCLSKACASSDKQYIVSASESGEMCLWDVSDGRCIEFTKLACTHTGIQFYQFSVGNQREGRLLCHGHYPEILVVDATSLEVLYSLVSKISPDWISSMSIIRSHRTQEDTVVALSVTGILKVWIVTSEISDMQDTEPIFEEESKPIYCQNCQSISFCAFTQRSLLVVCSKYWRVFDAGDYSLLCSGPSENGQTWTGGDFVSSDKVIIWTENGQSYIYKLPASCLPASDSFRSDVGKAVENLIPPVQHILLDRKDKELLICPPVTRFFYGCREYFHKLLIQGDSSGRLNIWNISDTADKQGSEEGLAMTTSISLQEAFDKLNPCPAGIIDQLSVIPNSNEPLKVTASVYIPAHGRLVCGREDGSIVIVPATQTAIVQLLQGEHMLRRGWPPHRTLRGHRNKVTCLLYPHQVSARYDQRYLISGGVDFSVIIWDIFSGEMKHIFCVHGGEITQLLVPPENCSARVQHCICSVASDHSVGLLSLREKKCIMLASRHLFPIQVIKWRPSDDYLVVGCSDGSVYVWQMDTGALDRCVMGITAVEILNACDEAVPAAVDSLSHPAVNLKQAMTRRSLAALKNMAHHKLQTLATNLLASEASDKGNLPKYSHNSLMVQAIKTNLTDPDIHVLFFDVEALIIQLLTEEASRPNTALISPENLQKASGSSDKGGSFLTGKRAAVLFQQVKETIKENIKEHLLDDEEEDEEIMRQRREESDPEYRSSKSKPLTLLEYNLTMDTAKLFMSCLHAWGLNEVLDEVCLDRLGMLKPHCTVSFGLLSRGGHMSLMLPGYNQPACKLSHGKTEVGRKLPASEGVGKGTYGVSRAVTTQHLLSIISLANTLMSMTNATFIGDHMKKGPTRPPRPSTPDLSKARGSPPTSSNIVQGQIKQGWSQLAAMHCVMLPDLLGLDKFRPPLLEMLARRWQDRCLEVREAAQALLLAELRRIEQAGRKEAIDAWAPYLPQYIDHVISPGVTSEAAQTITTAPDASGPEAKVQEEEHDLVDDDITTGCLSSVPQMKKISTSYEERRKQATAIVLLGVIGAEFGAEIEPPKLLTRPRSSSQIPEGFGLTSGGSNYSLARHTCKALTFLLLQPPSPKLPPHSTIRRTAIDLIGRGFTVWEPYMDVSAVLMGLLELCADAEKQLANITMGLPLSPAADSARSARHALSLIATARPPAFITTIAKEVHRHTALAANTQSQQNMHTTTLARAKGEILRVIEILIEKMPTDVVDLLVEVMDIIMYCLEGSLVKKKGLQECFPAICRFYMVSYYERNHRIAVGARHGSVALYDIRTGKCQTIHGHKGPITAVAFAPDGRYLATYSNTDSHISFWQMNTSLLGSIGMLNSAPQLRCIKTYQVPPVQPASPGSHNALKLARLIWTSNRNVILMAHDGKEHRFMV

SEQ ID NO: 97495 - protein, 169 aa, Homo sapiens
  Payload ID: 19442
  Gene Name: WD repeat domain 7
  ENSP ID: ENSP00000466438
MAGNSLVLPIVLWGRKAPTHCISAVLLTDDGATIVTGCHDGQICLWDLSVELQINPRALLFGHTASITCLSKACASSDKQYIVSASESGEMCLWDVSDGRCIEFTKLACTHTGIQFYQFSVGNQREGRLLCHGHYPEILVVDATSLEVLYSLVSKISPDWISSMSIIRS

SEQ ID NO: 97496 - protein, 40 aa, Homo sapiens
  Payload ID: 19442
  Gene Name: WD repeat domain 7
  ENSP ID: ENSP00000466480
  MOD_RES (1)..(1): Any amino acid
XMVSYYERNHRIAVGARHGSVALYDIRTGKCQALYQAKER

SEQ ID NO: 97497 - protein, 67 aa, Homo sapiens
  Payload ID: 19442
  Gene Name: WD repeat domain 7
  ENSP ID: ENSP00000467485
MNTSLLGSIGMLNSAPQLRCIKTYQVPPVQPASPGSHNALKLARLIWTSNRNVILMAHDGKEHRFMV

SEQ ID NO: 97498 - protein, 62 aa, Homo sapiens
  Payload ID: 19442
  Gene Name: WD repeat domain 7
  ENSP ID: ENSP00000467596
  MOD_RES (1)..(1): Any amino acid
XALSLIATARPPAFITTIAKEQAYENSNTLKVFTLFTCTQTYGSCSKYPITAEYAHNNSCTS

SEQ ID NO: 97499 - protein, 815 aa, Homo sapiens
  Payload ID: 19442
  Gene Name: WD repeat domain 7
  ENSP ID: ENSP00000481823
MAGNSLVLPIVLWGRKAPTHCISAVLLTDDGATIVTGCHDGQICLWDLSVELQINPRALLFGHTAVLFQQVKETIKENIKEHLLDDEEEDEEIMRQRREESDPEYRSSKSKPLTLLEYNLTMDTAKLFMSCLHAWGLNEVLDEVCLDRLGMLKPHCTVSFGLLSRGGHMSLMLPGYNQPACKLSHGKTEVGRKLPASEGVGKGTYGVSRAVTTQHLLSIISLANTLMSMTNATFIGDHMKKGPTRPPRPSTPDLSKARGSPPTSSNIVQGQIKQVAAPVVSARSDADHSGSDPPSAPALHTCFLVNEGWSQLAAMHCVMLPDLLGLDKFRPPLLEMLARRWQDRCLEVREAAQALLLAELRRIEQAGRKEAIDAWAPYLPQYIDHVISPGVTSEAAQTITTAPDASGPEAKVQEEEHDLVDDDITTGCLSSVPQMKKISTSYEERRKQATAIVLLGVIGAEFGAEIEPPKLLTRPRSSSQIPEGFGLTSGGSNYSLARHTCKALTFLLLQPPSPKLPPHSTIRRTAIDLIGRGFTVWEPYMDVSAVLMGLLELCADAEKQLANITMGLPLSPAADSARSARHALSLIATARPPAFITTIAKEVHRHTALAANTQSQQNMHTTTLARAKGEILRVIEILIEKMPTDVVDLLVEVMDIIMYCLEGSLVKKKGLQECFPAICRFYMVSYYERNHRIAVGARHGSVALYDIRTGKCQTIHGHKGPITAVAFAPDGRYLATYSNTDSHISFWQMNTSLLGSIGMLNSAPQLRCIKTYQVPPVQPASPGSHNALKLARLIWTSNRNVILMAHDGKEHRFMV

SEQ ID NO: 97500 - protein, 654 aa, Homo sapiens
  Payload ID: 19443
  Gene Name: WD repeat domain 70
  Uniprot ID: Q9NW82
  ENSP ID: ENSP00000265107
MERSGPSEVTGSDASGPDPQLAVTMGFTGFGKKARTFDLEAMFEQTRRTAVERSRKTLEAREKEEEMNREKELRRQNEDIEPTSSRSNVVRDCSKSSSRDTSSSESEQSSDSSDDELIGPPLPPKMVGKPVNFMEEDILGPLPPPLNEEEEEAEEEEEEEEEEENPVHKIPDSHEITLKHGTKTVSALGLDPSGARLVTGGYDYDVKFWDFAGMDASFKAFRSLQPCECHQIKSLQYSNTGDMILVVSGSSQAKVIDRDGFEVMECIKGDQYIVDMANTKGHTAMLHTGSWHPKIKGEFMTCSNDATVRTWEVENPKKQKSVFKPRTMQGKKVIPTTCTYSRDGNLIAAACQNGSIQIWDRNLTVHPKFHYKQAHDSGTDTSCVTFSYDGNVLASRGGDDSLKLWDIRQFNKPLFSASGLPTMFPMTDCCFSPDDKLIVTGTSIQRGCGSGKLVFFERRTFQRVYEIDITDASVVRCLWHPKLNQIMVGTGNGLAKVYYDPNKSQRGAKLCVVKTQRKAKQAETLTQDYIITPHALPMFREPRQRSTRKQLEKDRLDPLKSHKPEPPVAGPGRGGRVGTHGGTLSSYIVKNIALDKTDDSNPREAILRHAKAAEDSPYWVSPAYSKTQPKTMFAQVESDDEEAKNEPEWKKRKI

SEQ ID NO: 97501 - protein, 387 aa, Homo sapiens
  Payload ID: 19443
  Gene Name: WD repeat domain 70
  ENSP ID: ENSP00000425841
MERSGPSEVTGSDASGPDPQLAVTMGFTGFGKKARTFDLEAMFEQTRRTAVERSRKTLEAREKEEEMNREKELRRQNEDIEPTSSRSNVVRDCSKSSSRDTSSSESEQSSDSSDDELIGPPLPPKMVGKPVNFMEEDILGPLPPPLNEEEEEAEEEEEEEEEEENPVHKIPDSHEITLKHGTKTVSALGLDPSGARLVTGGYDYDVKFWDFAGMDASFKAFRSLQPCECHQIKSLQYSNTGDMILVVSGSSQAKVIDRDGFEVMECIKGDQYIVDMANTKGHTAMLHTGSWHPKIKGEFMTCSNDATVRTWEVENPKKQKSVFKPRTMQGKKVIPTTCTYSRDGNLIAAACQNGSIQIWDRNLTSNKLRLSYGTVCMLWAHTEVCVM

SEQ ID NO: 97502 - protein, 1102 aa, Homo sapiens
  Payload ID: 19444
  Gene Name: WD repeat domain 72
  Uniprot ID: Q3MJ13
  ENSP ID: ENSP00000353699
MRTSLQAVALWGQKAPPHSITAIMITDDQRTIVTGSQEGQLCLWNLSHELKISAKELLFGHSASVTCLARARDFSKQPYIVSAAENGEMCVWNVTNGQCMEKATLPYRHTAICYYHCSFRMTGEGWLLCCGEYQDVLIIDAKTLAVVHSFRSSQFPDWINCMCIVHSMRIQEDSLLVVSVAGELKVWDLSSSINSIQEKQDVYEKESKFLESLNCQTIRFCTYTERLLLVVFSKCWKVYDYCDFSLLLTEVSRNGQFFAGGEVIAAHRILIWTEDGHSYIYQLLNSGLSKSIYPADGRVLKETIYPHLLCSTSVQENKEQSRPFVMGYMNERKEPFYKVLFSGEVSGRITLWHIPDVPVSKFDGSPREIPVTATWTLQDNFDKHDTMSQSIIDYFSGLKDGAGTAVVTSSEYIPSLDKLICGCEDGTIIITQALNAAKARLLEGGSLVKDSPPHKVLKGHHQSVTSLLYPHGLSSKLDQSWMLSGDLDSCVILWDIFTEEILHKFFLEAGPVTSLLMSPEKFKLRGEQIICCVCGDHSVALLHLEGKSCLLHARKHLFPVRMIKWHPVENFLIVGCADDSVYIWEIETGTLERHETGERARIILNCCDDSQLVKSVLPIASETLKHKSIEQRSSSPYQLGPLPCPGLQVESSCKVTDAKFCPRPFNVLPVKTKWSNVGFHILLFDLENLVELLLPTPLSDVDSSSSFYGGEVLRRAKSTVEKKTLTLRKSKTACGPLSAEALAKPITESLAQGDNTIKFSEENDGIKRQKKMKISKKMQPKPSRKVDASLTIDTAKLFLSCLLPWGVDKDLDYLCIKHLNILKLQGPISLGISLNEDNFSLMLPGWDLCNSGMIKDYSGVNLFSRKVLDLSDKYTATLPNQVGIPRGLENNCDSLRESDTIVYLLSRLFLVNKLVNMPLELACRVGSSFRMESIHNKMRGAGNDILNMSSFYSCLRNGKNESHVPEADLSLLKLISCWRDQSVQVTEAIQAVLLAEVQQHMKSLGKIPVNSQPVSMAENGNCEMKQMLPKLEWTEELELQCVRNTLPLQTPVSPVKHDSNSNSANFQDVEDMPDRCALEESESPGEPRHHSWIAKVCPCKVS

SEQ ID NO: 97503 - protein, 1102 aa, Homo sapiens; identical to SEQ ID NO: 97502
  Payload ID: 19444
  Gene Name: WD repeat domain 72
  Uniprot ID: Q3MJ13
  ENSP ID: ENSP00000379619

SEQ ID NO: 97504 - protein, 1112 aa, Homo sapiens
  Payload ID: 19444
  Gene Name: WD repeat domain 72
  ENSP ID: ENSP00000452765
MRTSLQAVALWGQKAPPHSITAIMITDDQRTIVTGSQEGQLCLWNLSHELKISAKELLFGHSASVTCLARARDFSKQPYIVSAAENGEMCVWNVTNGQCMEKATLPYRHTAICYYHCSFRMTGEGWLLCCGEYQDVLIIDAKTLAVVHSFRSSQFPDWINCMCIVHSMRIQEDSLLVVSVAGELKVWDLSSSINSIQEKQDVYEKESKFLESLNCQTIRFCTYTERLLLVVFSKCWKVYDYCDFSLLLTEVSRNGQFFAGGEVIAAHRILIWTEDGHSYIYQLLNRWAQMGAAYKTFSGLSKSIYPADGRVLKETIYPHLLCSTSVQENKSRPFVMGYMNERKEPFYKVLFSGEVSGRITLWHIPDVPVSKFDGSPREIPVTATWTLQDNFDKHDTMSQSIIDYFSGLKDGAGTAVVTSSEYIPSLDKLICGCEDGTIIITQALNAAKARLLEGGSLVKDSPPHKVLKGHHQSVTSLLYPHGLSSKLDQSWMLSGDLDSCVILWDIFTEEILHKFFLEAGPVTSLLMSPEKFKLRGEQIICCVCGDHSVALLHLEGKSCLLHARKHLFPVRMIKWHPVENFLIVGCADDSVYIWEIETGTLERHETGERARIILNCCDDSQLVKSVLPIASETLKHKSIEQRSSSPYQLGPLPCPGLQVESSCKVTDAKFCPRPFNVLPVKTKWSNVGFHILLFDLENLVELLLPTPLSDVDSSSSFYGGEVLRRAKSTVEKKTLTLRKSKTACGPLSAEALAKPITESLAQGDNTIKFSEENDGIKRQKKMKISKKMQPKPSRKVDASLTIDTAKLFLSCLLPWGVDKDLDYLCIKHLNILKLQGPISLGISLNEDNFSLMLPGWDLCNSGMIKDYSGVNLFSRKVLDLSDKYTATLPNQVGIPRGLENNCDSLRESDTIVYLLSRLFLVNKLVNMPLELACRVGSSFRMESIHNKMRGAGNDILNMSSFYSCLRNGKNESHVPEADLSLLKLISCWRDQSVQVTEAIQAVLLAEVQQHMKSLGKIPVNSQPVSMAENGNCEMKQMLPKLEWTEELELQCVRNTLPLQTPVSPVKHDSNSNSANFQDVEDMPDRCALEESESPGEPRHHSWIAKVCPCKVS

SEQ ID NO: 97505 - protein, 1099 aa, Homo sapiens
  Payload ID: 19444
  Gene Name: WD repeat domain 72
  ENSP ID: ENSP00000453378
MRTSLQAVALWGQKAPPHSITAIMITDDQRTIVTGSQEGQLCLWNLSHELKISAKELLFGHSASVTCLARARDFSKQPYIVSAAENGEMCVWNVTNGQCMEKATLPYRHTAICYYHCSFRMTGEGWLLCCGEYQDVLIIDAKTLAVVHSFRSSQFPDWINCMCIVHSMRIQDSLLVVSVAGELKVWDLSSSINSIQEKQDVYEKESKFLESLNCQTIRFCTYTERLLLVVFSKCWKVYDYCDFSLLLTEVSRNGQFFAGGEVIAAHRILIWTEDGHSYIYQLLNSGLSKSIYPADGRVLKETIYPHLLCSTSVQENKSRPFVMGYMNERKEPFYKVLFSGEVSGRITLWHIPDVPVSKFDGSPREIPVTATWTLQDNFDKHDTMSQSIIDYFSGLKDGAGTAVVTSSEYIPSLDKLICGCEDGTIIITQALNAAKARLLEGGSLVKDSPPHKVLKGHHQSVTSLLYPHGLSSKLDQSWMLSGDLDSCVILWDIFTEEILHKFFLEAGPVTSLLMSPEKFKLRGEQIICCVCGDHSVALLHLEGKSCLLHARKHLFPVRMIKWHPVENFLIVGCADDSVYIWEIETGTLERHETGERARIILNCCDDSQLVKSVLPIASETLKHKSIEQRSSSPYQLGPLPCPGLQVESSCKVTDAKFCPRPFNVLPVKTKWSNVGFHILLFDLENLVELLLPTPLSDVDSSSSFYGGEVLRRAKSTVEKKTLTLRKSKTACGPLSAEALAKPITESLAQGDNTIKFSEENDGIKRQKKMKISKKMQPKPSRKVDASLTIDTAKLFLSCLLPWGVDKDLDYLCIKHLNILKLQGPISLGISLNEDNFSLMLPGWDLCNSGMIKDYSGVNLFSRKVLDLSDKYTATLPNQVGIPRGLENNCDSLRESDTIVYLLSRLFLVNKLVNMPLELACRVGSSFRMESIHNKMRGAGNDILNMSSFYSCLRNGKNESHVPEADLSLLKLISCWRDQSVQVTEAIQAVLLAEVQQHMKSLGKIPVNSQPVSMAENGNCEMKQMLPKLEWTEELELQCVRNTLPLQTPVSPVKHDSNSNSANFQDVEDMPDRCALEESESPGEPRHHSWIAKVCPCKVS

SEQ ID NO: 97506 - protein, 775 aa, Homo sapiens
  Payload ID: 19444
  Gene Name: WD repeat domain 72
  ENSP ID: ENSP00000453813
MRTSLQAVALWGQKAPPHSITAIMITDDQRTIVTGSQEGQLCLWNLSHELKISAKELLFGHSASVTCLARARDFSKQPYIVSAAENGEMCVWNVTNGQCMEKATLPYRHTAICYYHCSFRMTGEGWLLCCGEYQDVLIIDAKTLAVVHSFRSSQFPDWINCMCIVHSMRIQEDSLLVVSVAGELKVWDLSSSINSIQEKQDVYEKESKFLESLNCQTIRFCTYTERLLLVVFSKCWKVYDYCDFSLLLTEVSRNGQFFAGGEVIAAHRILIWTEDGHSYIYQLLNSGLSKSIYPADGRVLKETIYPHLLCSTSVQENKEQSRPFVMGYMNERKEPFYKVLFSGEVSGRITLWHIPDVPVSKFDGSPREIPVTATWTLQDNFDKHDTMSQSIIDYFSGLKDGAGTAVVTSSEYIPSLDKLICGCEDGTIIITQALNAAKARLLEGGSLVKDSPPHKVLKGHHQSVTSLLYPHGLSSKLDQSWMLSGDLDSCVILWDIFTEEILHKFFLEAGPVTSLLMSPEKFKLRGEQIICCVCGDHSVALLHLEGKSCLLHARKHLFPVRMIKWHPVENFLIVGCADDSVYIWEIETGTLERHETGERARIILNCCDDSQLVKSVLPIASETLKHKSIEQRSSSPYQLGPLPCPGLQVESSCKVTDAKFCPRPFNVLPVKTKWSNVGFHILLFDLENLVELLLPTPLSDVDSSSSFYGGEVLRRAKSTVEKKTLTLRKSKTACGPLSAEALAKPITESLAQGDNTIKFSEENDGIKRQKKMKIS

SEQ ID NO: 97507 - protein, 88 aa, Homo sapiens
  Payload ID: 19444
  Gene Name: WD repeat domain 72
  ENSP ID: ENSP00000477754
MAGVPPPAWLPPCSLISDCCASNQRDSVGVGPSEPAPVSPVKHDSNSNSANFQDVEDMPDRCALEESESPGEPRHHSWIAKVCPCKVS

SEQ ID NO: 97508 - protein, 378 aa, Homo sapiens
  Payload ID: 19445
  Gene Name: WD repeat domain 73
  Uniprot ID: Q6P4I2
  ENSP ID: ENSP00000387982
MDPGDDWLVESLRLYQDFYAFDLSGATRVLEWIDDKGVFVAGYESLKKNEILHLKLPLRLSVKENKGLFPERDFKVRHGGFSDRSIFDLKHVPHTRLLVTSGLPGCYLQVWQVAEDSDVIKAVSTIAVHEKEESLWPRVAVFSTLAPGVLHGARLRSLQVVDLESRKTTYTSDVSDSEELSSLQVLDADTFAFCCASGRLGLVDTRQKWAPLENRSPGPGSGGERWCAEVGSWGQGPGPSIASLGSDGRLCLLDPRDLCHPVSSVQCPVSVPSPDPELLRVTWAPGLKNCLAISGFDGTVQVYDATSWDGTRSQDGTRSQVEPLFTHRGHIFLDGNGMDPAPLVTTHTWHPCRPRTLLSATNDASLHVWDWVDLCAPR

SEQ ID NO: 97509 - protein, 131 aa, Homo sapiens
  Payload ID: 19445
  Gene Name: WD repeat domain 73
  ENSP ID: ENSP00000453204
  MOD_RES (1)..(1): Any amino acid
XWLVESLRLYQDFYAFDLSGATRVLEWIDDKGVFVAGYESLKKNEILHLKLPLRLSVKENKGLFPERDFKVRHGGFSDRSIFDLKHVPHTRLLVTSGLPGCYLQVWQVAEDSATQEAEAEEFLEPERRRLQ

SEQ ID NO: 97510 - protein, 178 aa, Homo sapiens
  Payload ID: 19445
  Gene Name: WD repeat domain 73
  ENSP ID: ENSP00000453732
  MOD_RES (1)..(1): Any amino acid
XDPGDDWLVESLRLYQDFYAFDLSGATRVLEWIDDKGVFVAGYESLKKNEILHLKLPLRLSVKENKGLFPERDFKVRHGGFSDRSIFDLKHVPHTRLLVTSGLPGCYLQVWQVAEDSDVIKAVSTIAVHEKEESLWPRVAVFSTLAPGVLHGARLRSLQVVDLESRKTTYTSGVGDTQ

SEQ ID NO: 97511 - protein, 85 aa, Homo sapiens
  Payload ID: 19445
  Gene Name: WD repeat domain 73
  ENSP ID: ENSP00000453779
  MOD_RES (1)..(1): Any amino acid
XGDDWLVESLRLYQDFYAFDLSGATRVLEWIDDKGVFVAGYESLKKNEILHLKLPLRLSVKENKIAGYQWPSRLLSAGVAGCRGQ

SEQ ID NO: 97512 - protein, 385 aa, Homo sapiens
  Payload ID: 19446
  Gene Name: WD repeat domain 74
  Uniprot ID: Q6RFH5
  ENSP ID: ENSP00000278856
MAAAAARWNHVWVGTETGILKGVNLQRKQAANFTAGGQPRREEAVSALCWGTGGETQMLVGCADRTVKHFSTEDGIFQGQRHCPGGEGMFRGLAQADGTLITCVDSGILRVWHDKDKDTSSDPLLELRVGPGVCRMRQDPAHPHVVATGGKENALKIWDLQGSEEPVFRAKNVRNDWLDLRVPIWDQDIQFLPGSQKLVTCTGYHQVRVYDPASPQRRPVLETTYGEYPLTAMTLTPGGNSVIVGNTHGQLAEIDLRQGRLLGCLKGLAGSVRGLQCHPSKPLLASCGLDRVLRIHRIQNPRGLEHKVYLKSQLNCLLLSGRDNWEDEPQEPQEPNKVPLEDTETDELWASLEAAAKRKLSGLEQPQGALQTRRRKKKRPGSTSP

SEQ ID NO: 97513 - protein, 366 aa, Homo sapiens
  Payload ID: 19446
  Gene Name: WD repeat domain 74
  Uniprot ID: Q6RFH5
  ENSP ID: ENSP00000308931
MAAAAARWNHVWVGTETGILKGVNLQRKQAANFTAGGQPRREEAVSALCWGTGGETQMLVGCADRTVKHFSTEDGIFQGQRHCPGGEGMFRGLAQADGTLITCVDSGILRVWHDKDKDTSSDPLLELRVGPGVCRMRQDPAHPHVVATGGKENALKIWDLQGSEEPVFRAKNVRNDWLDLRVPIWDQDIQFLPGSQKLVTCTGYHQVRVYDPASPQRRPVLETTYGEYPLTAMTLTPGGNSVIVGNTHGQLAEIDLRQGRLLGCLKGLAGSVRGLQCHPSKPLLASCGLDRVLRIHRIQNPRGLEHKDEPQEPQEPNKVPLEDTETDELWASLEAAAKRKLSGLEQPQGALQTRRRKKKRPGSTSP

SEQ ID NO: 97514 - protein, 328 aa, Homo sapiens
  Payload ID: 19446
  Gene Name: WD repeat domain 74
  ENSP ID: ENSP00000432113
MLVGCADRTVKHFSTEDGIFQGQRHCPGGEGMFRGLAQADGTLITCVDSGILRVWHDKDKDTSSDPLLELRVGPGVCRMRQDPAHPHVVATGGKENALKIWDLQGSEEPVFRAKNVRNDWLDLRVPIWDQDIQFLPGSQKLVTCTGYHQVRVYDPASPQRRPVLETTYGEYPLTAMTLTPGGNSVIVGNTHGQLAEIDLRQGRLLGCLKGLAGSVRGLQCHPSKPLLASCGLDRVLRIHRIQNPRGLEHKVYLKSQLNCLLLSGRDNWEDEPQEPQEPNKVPLEDTETDELWASLEAAAKRKLSGLEQPQGALQTRRRKKKRPGSTSP

SEQ ID NO: 97515 - protein, 385 aa, Homo sapiens; identical to SEQ ID NO: 97512
  Payload ID: 19446
  Gene Name: WD repeat domain 74
  Uniprot ID: Q6RFH5
  ENSP ID: ENSP00000432119

SEQ ID NO: 97516 - protein, 385 aa, Homo sapiens; identical to SEQ ID NO: 97512
  Payload ID: 19446
  Gene Name: WD repeat domain 74
  Uniprot ID: Q6RFH5
  ENSP ID: ENSP00000435726

SEQ ID NO: 97517 - protein, 41 aa, Homo sapiens
  Payload ID: 19446
  Gene Name: WD repeat domain 74
  ENSP ID: ENSP00000438700
MAAAAARWNHVWVGTETGILKGGWQARASGSAGVHSRPWRD

SEQ ID NO: 97518 - protein, 38 aa, Homo sapiens
  Payload ID: 19446
  Gene Name: WD repeat domain 74
  ENSP ID: ENSP00000439541
  MOD_RES (1)..(1): Any amino acid
XWASLEAAAKRKLSGLEQPQGALQTRRRKKKRPGSTSP

SEQ ID NO: 97519 - protein, 57 aa, Homo sapiens
  Payload ID: 19446
  Gene Name: WD repeat domain 74
  ENSP ID: ENSP00000440612
MAAAAARWNHVWVGTETGILKGVNLQRKQAANFTAGGQPRREEAVSALCWGTGGETQ

SEQ ID NO: 97520 - protein, 830 aa, Homo sapiens
  Payload ID: 19447
  Gene Name: WD repeat domain 75
  Uniprot ID: Q8IWA0
  ENSP ID: ENSP00000314193
MVEEENIRVVRCGGSELNFRRAVFSADSKYIFCVSGDFVKVYSTVTEECVHILHGHRNLVTGIQLNPNNHLQLYSCSLDGTIKLWDYIDGILIKTFIVGCKLHALFTLAQAEDSVFVIVNKEKPDIFQLVSVKLPKSSSQEVEAKELSFVLDYINQSPKCIAFGNEGVYVAAVREFYLSVYFFKKKTTSRFTLSSSRNKKHAKNNFTCVACHPTEDCIASGHMDGKIRLWRNFYDDKKYTYTCLHWHHDMVMDLAFSVTGTSLLSGGRESVLVEWRDATEKNKEFLPRLGATIEHISVSPAGDLFCTSHSDNKIIIIHRNLEASAVIQGLVKDRSIFTGLMIDPRTKALVLNGKPGHLQFYSLQSDKQLYNLDIIQQEYINDYGLIQIELTKAAFGCFGNWLATVEQRQEKETELELQMKLWMYNKKTQGFILNTKINMPHEDCITALCFCNAEKSEQPTLVTASKDGYFKVWILTDDSDIYKKAVGWTCDFVGSYHKYQATNCCFSEDGSLLAVSFEEIVTIWDSVTWELKCTFCQRAGKIRHLCFGRLTCSKYLLGATENGILCCWNLLSCALEWNAKLNVRVMEPDPNSENIAAISQSSVGSDLFVFKPSEPRPLYIQKGISREKVQWGVFVPRDVPESFTSEAYQWLNRSQFYFLTKSQSLLTFSTKSPEEKLTPTSKQLLAEESLPTTPFYFILGKHRQQQDEKLNETLENELVQLPLTENIPAISELLHTPAHVLPSAAFLCSMFVNSLLLSKETKSAKEIPEDVDMEEEKESEDSDEENDFTEKVQDTSNTGLGEDIIHQLSKSEEKELRKFRKIDYSWIAAL

SEQ ID NO: 97521 - protein, 97 aa, Homo sapiens
  Payload ID: 19447
  Gene Name: WD repeat domain 75
  ENSP ID: ENSP00000400728
MVEEENIRVVRCGGSELNFRRAVFSADSKYIFCVSGDFVKVYSTVTEECVHILHGHRNLVTGIQLNPNNHLQSQPTWKLLIKDGFALPFTFIPKEIK

SEQ ID NO: 97522 - protein, 89 aa, Homo sapiens
  Payload ID: 19447
  Gene Name: WD repeat domain 75
  ENSP ID: ENSP00000414226
MVEEENIRVVRCGGSELNFRRAVFSADSKYIFCVSGDFVKVYSTVTEECVHILHGHRNLVTGIQLNPNNHLQVPLHALRISKRAVFLFP

SEQ ID NO: 97523 - protein, 89 aa, Homo sapiens; identical to SEQ ID NO: 97522
  Payload ID: 19447
  Gene Name: WD repeat domain 75
  ENSP ID: ENSP00000486831

SEQ ID NO: 97524 - protein, 626 aa, Homo sapiens
  Payload ID: 19448
  Gene Name: WD repeat domain 76
  Uniprot ID: Q9H967
  ENSP ID: ENSP00000263795
MSRSGAAAEKADSRQRPQMKVNEYKENQNIAYVSLRPAQTTVLIKTAKVYLAPFSLSNYQLDQLMCPKSLSEKNSNNEVACKKTKIKKTCRRIIPPKMKNTSSKAESTLQNSSSAVHTESNKLQPKRTADAMNLSVDVESSQDGDSDEDTTPSLDFSGLSPYERKRLKNISENADFFASLQLSESAARLREMIEKRQPPKSKRKKPKRENGIGCRRSMRLLKVDPSGVSLPAAPTPPTLVADETPLLPPGPLEMTSENQEDNNERFKGFLHTWAGMSKPSSKNTEKGLSSIKSYKANLNGMVISEDTVYKVTTGPIFSMALHPSETRTLVAVGAKFGQVGLCDLTQQPKEDGVYVFHPHSQPVSCLYFSPANPAHILSLSYDGTLRCGDFSRAIFEEVYRNERSSFSSFDFLAEDASTLIVGHWDGNMSLVDRRTPGTSYEKLTSSSMGKIRTVHVHPVHRQYFITAGLRDTHIYDARRLNSRRSQPLISLTEHTKSIASAYFSPLTGNRVVTTCADCNLRIFDSSCISSKIPLLTTIRHNTFTGRWLTRFQAMWDPKQEDCVIVGSMAHPRRVEIFHETGKRVHSFGGEYLVSVCSINAMHPTRYILAGGNSSGKIHVFMNEKSC

SEQ ID NO: 97525 - protein, 562 aa, Homo sapiens
  Payload ID: 19448
  Gene Name: WD repeat domain 76
  ENSP ID: ENSP00000370645
MCPKSLSEKNSNNEVACKKTKIKKTCRRIIPPKMKNTSSKAESTLQNSSSAVHTESNKLQPKRTADAMNLSVDVESSQDGDSDEDTTPSLDFSGLSPYERKRLKNISENADFFASLQLSESAARLREMIEKRQPPKSKRKKPKRENGIGCRRSMRLLKVDPSGVSLPAAPTPPTLVADETPLLPPGPLEMTSENQEDNNERFKGFLHTWAGMSKPSSKNTEKGLSSIKSYKANLNGMVISEDTVYKVTTGPIFSMALHPSETRTLVAVGAKFGQVGLCDLTQQPKEDGVYVFHPHSQPVSCLYFSPANPAHILSLSYDGTLRCGDFSRAIFEEVYRNERSSFSSFDFLAEDASTLIVGHWDGNMSLVDRRTPGTSYEKLTSSSMGKIRTVHVHPVHRQYFITAGLRDTHIYDARRLNSRRSQPLISLTEHTKSIASAYFSPLTGNRVVTTCADCNLRIFDSSCISSKIPLLTTIRHNTFTGRWLTRFQAMWDPKQEDCVIVGSMAHPRRVEIFHETGKRVHSFGGEYLVSVCSINAMHPTRYILAGGNSSGKIHVFMNEKSC

SEQ ID NO: 97526 - protein, 228 aa, Homo sapiens
  Payload ID: 19448
  Gene Name: WD repeat domain 76
  ENSP ID: ENSP00000404665
MCPKSLSEKNSNNEVACKKTKIKKTCRRIIPPKMKNTSSKAESTLQNSSSAVHTESNKLQPKRTADAMNLSVDVESSQDGDSDEDTTPSLDFSGLSPYERKRLKNISENADFFASLQLSESAARLREMIEKRQPPKSKRKKPKRENGIGCRRSMRLLKVDPSGVSLPAAPTPPTLVADETPLLPPGPLEMTSENQEDNNERFKGFLHTWAGMSKPSSKNTEKGLSSIK

SEQ ID NO: 97527 - protein, 342 aa, Homo sapiens
  Payload ID: 19449
  Gene Name: WD repeat domain 77
  Uniprot ID: Q9BQA1
  ENSP ID: ENSP00000235090
MRKETPPPLVPPAAREWNLPPNAPACMERQLEAARYRSDGALLLGASSLSGRCWAGSLWLFKDPCAAPNEGFCSAGVQTEAGVADLTWVGERGILVASDSGAVELWELDENETLIVSKFCKYEHDDIVSTVSVLSSGTQAVSGSKDICIKVWDLAQQVVLSSYRAHAAQVTCVAASPHKDSVFLSCSEDNRILLWDTRCPKPASQIGCSAPGYLPTSLAWHPQQSEVFVFGDENGTVSLVDTKSTSCVLSSAVHSQCVTGLVFSPHSVPFLASLSEDCSLAVLDSSLSELFRSQAHRDFVRDATWSPLNHSLLTTVGWDHQVVHHVVPTEPLPAPGPASVTE

SEQ ID NO: 97528 - protein, 291 aa, Homo sapiens
  Payload ID: 19449
  Gene Name: WD repeat domain 77
  ENSP ID: ENSP00000409300
  MOD_RES (1)..(1): Any amino acid
XCAAPNEGFCSAGVQTEAGVADLTWVGERGILVASDSGAVELWELDENETLIVSKFCKYEHDDIVSTVSVLSSGTQAVSGSKDICIKVWDLAQQVVLSSYRAHAAQVTCVAASPHKDSVFLSCSEDNRILLWDTRCPKPASQIGCSAPGYLPTSLAWHPQQSEVFVFGDENGTVSLVDTKSTSCVLSSAVHSQCVTGLVFSPHRLDLSQPSPPSDSVPFLASLSEDCSLAVLDSSLSELFRSQAHRDFVRDATWSPLNHSLLTTVGWDHQVVHHVVPTEPLPAPGPASVTE

SEQ ID NO: 97529 - protein, 320 aa, Homo sapiens
  Payload ID: 19450
  Gene Name: WD repeat domain 78
  ENSP ID: ENSP00000360061
MTPGKHSGASARAANGGAWGYRDFRGGQKKGWCTTPQLVATMPVSPAGSHKQQNFGLNNATQPKKSISFFATMKATSVKGYTGANQSRMAVSKTVLIPPELKTVEKPNPNIKTTQVFDINGTDVTPRPLYHPDPLTGTAKPSKLLTSQEGSLGSEFISSYSLYQNTINPSTLGQFTRSVLGSSTVSKSSVSASESIAEDLEEPSYKRERLTSFTDLQVIRAAPEKIVTKEDLEKNIEIILTETETLRFFDLPTVMVSVESEEAEKVTQRNKNYEVLCRNRLGNDLYVERMMQTFNGAPKNKDVQCDKIIMEDKGNFYHSA

SEQ ID NO: 97530 - protein, 545 aa, Homo sapiens
  Payload ID: 19450
  Gene Name: WD repeat domain 78
  Uniprot ID: Q5VTH9
  ENSP ID: ENSP00000360062
MTPGKHSGASARAANGGAWGYRDFRGGQKKGWCTTPQLVATMPVSPAGSHKQQNFGLNNATQPKKSISFFATMKATSVKGYTGANQSRMAVSKTVLIPPELKTVEKPNPNIKTTQVFDINGTDVTPRPLYHPDPLTGTAKPSKLLTSQEGSLGSEFISSYSLYQNTINPSTLGQFTRSVLGSSTVSKSSVSASESIAEDLEEPSYKRERLTSFTDLQVIRAAPEKIVTKEDLEKNIEIILTETETLRFFDLPTVMVSVESEEAEKVTQRNKNYEVLCRNRLGNDLYVERMMQTFNGAPKNKDVQCDKIIMEDKGIMSTAWDLYDSYNAMELVSLSVKQSVVESSSKANVLPKDQDQRLPGSTTEKNSETSSLMDIENVILAKIHEDEEDHSDAILKSDKFHQDLFFMERVLMENIFQPKLAAYRQLPVLKEPEPEEPEDVLESAKHEEVEEESKKEEEEEIHAEESTIPANLERLWSFSCDLTKGLNVSSLAWNKTNPDLLAVGYGHFGFKEQKRGLACCWSIKNPMVTQTRIRSIFIWLLTKFS

SEQ ID NO: 97531 - protein, 848 aa, Homo sapiens
  Payload ID: 19450
  Gene Name: WD repeat domain 78
  Uniprot ID: Q5VTH9
  ENSP ID: ENSP00000360065
MTPGKHSGASARAANGGAWGYRDFRGGQKKGWCTTPQLVATMPVSPAGSHKQQNFGLNNATQPKKSISFFATMKATSVKGYTGANQSRMAVSKTVLIPPELKTVEKPNPNIKTTQVFDINGTDVTPRPLYHPDPLTGTAKPSKLLTSQEGSLGSEFISSYSLYQNTINPSTLGQFTRSVLGSSTVSKSSVSASESIAEDLEEPSYKRERLTSFTDLQVIRAAPEKIVTKEDLEKNIEIILTETETLRFFDLPTVMVSVESEEAEKVTQRNKNYEVLCRNRLGNDLYVERMMQTFNGAPKNKDVQCDKIIMEDKGIMSTAWDLYDSYNAMELVSLSVKQSVVESSSKANVLPKDQDQRLPGSTTEKNSETSSLMDIENVILAKIHEDEEDHSDAILKSDKFHQDLFFMERVLMENIFQPKLAAYRQLPVLKEPEPEEPEDVLESAKHEEVEEESKKEEEEEIHAEESTIPANLERLWSFSCDLTKGLNVSSLAWNKTNPDLLAVGYGHFGFKEQKRGLACCWSIKNPMWPERIYQSPYGVTAVDFSIGAPNLLAVGYHNGTIAIYNVRSNSNVPVLDSSESPQKHLGPVWQLQWIEQDRGTTGDGKREILVSISADGRISKWVIRKGLDCYDLMRLKRTTAASNKKGGEKEKKDEALISRQAPGMCFAFHPKDTNIYLAGTEEGHIHKCSCSYNEQYLDTYRGHKGPVYKVTWNPFCHDVFLSCSADWGVIIWQQENVKPSLSFYPATSVVYDVAWSPKSSYIFAAANENRVEIWDLHISTLDPLIVNTANPGIKFTTILFAKQTDCLLVGDSDGQVSVYELRNMPTVLETGRGDIMDTLLGSKSNQSA

SEQ ID NO: 97532 - protein, 55 aa, Homo sapiens
  Payload ID: 19450
  Gene Name: WD repeat domain 78
  ENSP ID: ENSP00000432461
KHSGASARAANGGAWGYRDFRGGQKKGWCTTPQLVATMPVSPAGSHKQQNFGLEA

SEQ ID NO: 97533 - protein, 122 aa, Homo sapiens
  Payload ID: 19450
  Gene Name: WD repeat domain 78
  ENSP ID: ENSP00000432979
  MOD_RES (1)..(1): Any amino acid
XQRNKNYEVLCRNRLGNDLYVERMMQTFNGAPKNKDVQCDKIIMEDKGIMSTAWDLYDSYNAMELVSLSVKQSVVESSSKANVLPKDQDQRLPGSTTEKTVVWERDVMTEEGQRECNQCCCL

SEQ ID NO: 97534 - protein, 167 aa, Homo sapiens
  Payload ID: 19450
  Gene Name: WD repeat domain 78
  ENSP ID: ENSP00000433037
GIMSTAWDLYDSYNAMELVSLSVKQSVVESSSKANVLPKDQDQRLPGSTTEKKPEPEEPEDVLESAKHEEVEEESKKEEEEEIHAEESTIPANLERLWSFSCDLTKGLNVSSLAWNKTNPDLLAVGYGHFGFKEQKRGLACCWSIKNPMVTQTRIRSIFIWLLTKFS

SEQ ID NO: 97535 - protein, 581 aa, Homo sapiens
  Payload ID: 19450
  Gene Name: WD repeat domain 78
  ENSP ID: ENSP00000433682
NIEIILTETETLRFFDLPTVMVSVESEEAEKVTQRNKNYEVLCRNRLGNDLYVERMMQTFNGAPKNKDVQCDKIIMEDKGIMSTAWDLYDSYNAMELVSLSVKQSVVESSSKANVLPKDQDQRLPGSTTEKNSETSSLMDIENVILAKIHEDEEDHSDAILKSDKFHQDLFFMERVLMENIFQPKLAAYRQLPVLKEPEPEEPEDVLESAKHEEVEEESKKEEEEEIHAEESTIPANLERLWSFSCDLTKGLNVSSLAWNKTNPDLLAVGYGHFGFKEQKRGLACCWSIKNPMWPERIYQSPYGVTAVDFSIGAPNLLAVGYHNGTIAIYNVRSNSNVPVLDSSESPQKHLGPVWQLQWIEQDRGTTGDGKREILVSISADGRISKWVIRKGLDCYDLMRLKRTTAASNKKGGEKEKKDEALISRQAPGMCFAFHPKGPVYKVTWNPFCHDVFLSCSADWGVIIWQQENVKPSLSFYPATSVVYDVAWSPKSSYIFAAANENRVEIWDLHISTLDPLIVNTANPGIKFTTILFAKQTDCLLVGDSDGQVSVYELRNMPTVLETGRGDIMDTLLGSKSNQSA

SEQ ID NO: 97536 - protein, 49 aa, Homo sapiens
  Payload ID: 19450
  Gene Name: WD repeat domain 78
  ENSP ID: ENSP00000434351
MKATSVKGYTGANQSRMAVSKTVLIPPELKTVEKPNPNIKTTQVIFLEF

SEQ ID NO: 97537 - protein, 159 aa, Homo sapiens
  Payload ID: 19450
  Gene Name: WD repeat domain 78
  ENSP ID: ENSP00000435836
  MOD_RES (1)..(1): Any amino acid
XTGANQSRMAVSKTVLIPPELKTVEKPNPNIKTTQVFDINGTDVTPRPLYHPDPLTGTAKPSKLLTSQEGSLGSEFISSYSLYQNTINPSTLGQFTRSVLGSSTVSKSSVSASESIAEDLEEPSYKRERLTSFTGNENILVYFSNSPLFSQYAYYWLDT

SEQ ID NO: 97538 - protein, 62 aa, Homo sapiens
  Payload ID: 19450
  Gene Name: WD repeat domain 78
  ENSP ID: ENSP00000436463
KHSGASARAANGGAWGYRDFRGGQKKGWCTTPQLVATMPVSPAGSHKQQNFGLSTYWYSKTK

SEQ ID NO: 97539 - protein, 890 aa, Homo sapiens
  Payload ID: 19451
  Gene Name: WD repeat domain 81
  Uniprot ID: Q562E7
  ENSP ID: ENSP00000312074
MDGEPPASSGLGLPDYTSGVSFHDQADLPETEDFQAGLYVTESPQPQEAEAVSLGRLSDKSSTSETSLGEERAPDEGGAPVDKSSLRSGDSSQDLKQSEGSEEEEEEEDSCVVLEEEEGEQEEVTGASELTLSDTVLSMETVVAGGSGGDGEEEEEALPEQSEGKEQKILLDTACKMVRWLSAKLGPTVASRHVARNLLRLLTSCYVGPTRQQFTVSSGESPPLSAGNIYQKRPVLGDIVSGPVLSCLLHIARLYGEPVLTYQYLPYISYLVAPGSASGPSRLNSRKEAGLLAAVTLTQKIIVYLSDTTLMDILPRISHEVLLPVLSFLTSLVTGFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGGGCPQDDGHSGTFGSVLVGNRIQIPNDSRPENPGPLGPISGVGGGGLGSGSDDNALKQELPRSVHGLSGNWLAYWQYEIGVSQQDAHFHFHQIRLQSFPGHSGAVKCVAPLSSEDFFLSGSKDRTVRLWPLYNYGDGTSETAPRLVYTQHRKSVFFVGQLEAPQHVVSCDGAVHVWDPFTGKTLRTVEPLDSRVPLTAVAVMPAPHTSITMASSDSTLRFVDCRKPGLQHEFRLGGGLNPGLVRALAISPSGRSVVAGFSSGFMVLLDTRTGLVLRGWPAHEGDILQIKAVEGSVLVSSSSDHSLTVWKELEQKPTHHYKSASDPIHTFDLYGSEVVTGTVSNKIGVCSLLEPPSQATTKLSSENFRGTLTSLALLPTKRHLLLGSDNGVIRLLA

SEQ ID NO: 97540 - protein, 1941 aa, Homo sapiens
  Payload ID: 19451
  Gene Name: WD repeat domain 81
  Uniprot ID: Q562E7
  ENSP ID: ENSP00000386609
MAQGSGGREGALRTPAGGWHSPPSPDMQELLRSVERDLSIDPRQLAPAPGGTHVVALVPARWLASLRDRRLPLGPCPRAEGLGEAEVRTLLQRSVQRLPAGWTRVEVHGLRKRRLSYPLGGGLPFEDGSCGPETLTRFMQEVAAQNYRNLWRHAYHTYGQPYSHSPAPSAVPALDSVRQALQRVYGCSFLPVGETTQCPSYAREGPCPPRGSPACPSLLRAEALLESPEMLYVVHPYVQFSLHDVVTFSPAKLTNSQAKVLFILFRVLRAMDACHRQGLACGALSLYHIAVDEKLCSELRLDLSAYERPEEDENEEAPVARDEAGIVSQEEQGGQPGQPTGQEELRSLVLDWVHGRISNFHYLMQLNRLAGRRQGDPNYHPVLPWVVDFTTPHGRFRDLRKSKFRLNKGDKQLDFTYEMTRQAFVAGGAGGGEPPHVPHHISDVLSDITYYVYKARRTPRSVLCGHVRAQWEPHEYPASMERMQNWTPDECIPEFYTDPSIFRSIHPDMPDLDVPAWCSSSQEFVAAHRALLESREVSRDLHHWIDLTFGYKLQGKEAVKEKNVCLHLVDAHTHLASYGVVQLFDQPHPQRLAGAPALAPEPPLIPKLLVQTIQETTGREDFTENPGQLPNGVGRPVLEATPCEASWTRDRPVAGEDDLEQATEALDSISLAGKAGDQLGSSSQASPGLLSFSVASASRPGRRNKAAGADPGEGEEGRILLPEGFNPMQALEELEKTGNFLAKGLGGLLEVPEQPRVQPAVPLQCLLHRDMQALGVLLAEMVFATRVRTLQPDAPLWVRFQAVRGLCTRHPKEVPVSLQPVLDTLLQMSGPEVPMGAERGKLDQLFEYRPVSQGLPPPCPSQLLSPFSSVVPFPPYFPALHRFILLYQARRVEDEAQGRELVFALWQQLGAVLKDITPEGLEILLPFVLSLMSEEHTAVYTAWYLFEPVAKALGPKNANKYLLKPLIGAYESPCQLHGRFYLYTDCFVAQLMVRLGLQAFLTHLLPHVLQVLAGAEASQEESKDLAGAAEEEESGLPGAGPGSCAFGEEIPMDGEPPASSGLGLPDYTSGVSFHDQADLPETEDFQAGLYVTESPQPQEAEAVSLGRLSDKSSTSETSLGEERAPDEGGAPVDKSSLRSGDSSQDLKQSEGSEEEEEEEDSCVVLEEEEGEQEEVTGASELTLSDTVLSMETVVAGGSGGDGEEEEEALPEQSEGKEQKILLDTACKMVRWLSAKLGPTVASRHVARNLLRLLTSCYVGPTRQQFTVSSGESPPLSAGNIYQKRPVLGDIVSGPVLSCLLHIARLYGEPVLTYQYLPYISYLVAPGSASGPSRLNSRKEAGLLAAVTLTQKIIVYLSDTTLMDILPRISHEVLLPVLSFLTSLVTGFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGGGCPQDDGHSGTFGSVLVGNRIQIPNDSRPENPGPLGPISGVGGGGLGSGSDDNALKQELPRSVHGLSGNWLAYWQYEIGVSQQDAHFHFHQIRLQSFPGHSGAVKCVAPLSSEDFFLSGSKDRTVRLWPLYNYGDGTSETAPRLVYTQHRKSVFFVGQLEAPQHVVSCDGAVHVWDPFTGKTLRTVEPLDSRVPLTAVAVMPAPHTSITMASSDSTLRFVDCRKPGLQHEFRLGGGLNPGLVRALAISPSGRSVVAGFSSGFMVLLDTRTGLVLRGWPAHEGDILQIKAVEGSVLVSSSSDHSLTVWKELEQKPTHHYKSASDPIHTFDLYGSEVVTGTVSNKIGVCSLLEPPSQATTKLSSENFRGTLTSLALLPTKRHLLLGSDNGVIRLLA

SEQ ID NO: 97541 - protein, 738 aa, Homo sapiens
  Payload ID: 19451
  Gene Name: WD repeat domain 81
  Uniprot ID: Q562E7
  ENSP ID: ENSP00000391074
MLVRVVLSLTPSFPEPSALYTACKMVRWLSAKLGPTVASRHVARNLLRLLTSCYVGPTRQQFTVSSGESPPLSAGNIYQKRPVLGDIVSGPVLSCLLHIARLYGEPVLTYQYLPYISYLVAPGSASGPSRLNSRKEAGLLAAVTLTQKIIVYLSDTTLMDILPRISHEVLLPVLSFLTSLVTGFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGGGCPQDDGHSGTFGSVLVGNRIQIPNDSRPENPGPLGPISGVGGGGLGSGSDDNALKQELPRSVHGLSGNWLAYWQYEIGVSQQDAHFHFHQIRLQSFPGHSGAVKCVAPLSSEDFFLSGSKDRTVRLWPLYNYGDGTSETAPRLVYTQHRKSVFFVGQLEAPQHVVSCDGAVHVWDPFTGKTLRTVEPLDSRVPLTAVAVMPAPHTSITMASSDSTLRFVDCRKPGLQHEFRLGGGLNPGLVRALAISPSGRSVVAGFSSGFMVLLDTRTGLVLRGWPAHEGDILQIKAVEGSVLVSSSSDHSLTVWKELEQKPTHHYKSASDPIHTFDLYGSEVVTGTVSNKIGVCSLLEPPSQATTKLSSENFRGTLTSLALLPTKRHLLLGSDNGVIRLLA

SEQ ID NO: 97542 - protein, 132 aa, Homo sapiens
  Payload ID: 19451
  Gene Name: WD repeat domain 81
  ENSP ID: ENSP00000395198
MVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGG

SEQ ID NO: 97543 - protein, 172 aa, Homo sapiens
  Payload ID: 19451
  Gene Name: WD repeat domain 81
  ENSP ID: ENSP00000395226
MLVRVVLSLTPSFPEPSALYTACKMVRWLSAKLGPTVASRHVARNLLRLLTSCYVGPTRQQFTVSSGESPPLSAGNIYQKRPVLGDIVSGPVLSCLLHIARLYGEPVLTYQYLPYISYLVAPGSASGPSRLNSRKEAGLLAAVTLTQKIIVYLSDTTLMDILPRISHEVLLP

SEQ ID NO: 97544 - protein, 580 aa, Homo sapiens
  Payload ID: 19451
  Gene Name: WD repeat domain 81
  ENSP ID: ENSP00000401560
MDILPRISHEVLLPVLSFLTSLVTGFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGGGCPQDDGHSGTFGSVLVGNRIQIPNDSRPENPGPLGPISGVGGGGLGSGSDDNALKQELPRSVHGLSGNWLAYWQYEIGVSQQDAHFHFHQIRLQSFPGHSGAVKCVAPLSSEDFFLSGSKDRTVRLWPLYNYGDGTSETAPRLVYTQHRKSVFFVGQLEAPQHVVSCDGAVHVWDPFTGKTLRTVEPLDSRVPLTAVAVMPAPHTSITMASSDSTLRFVDCRKPGLQHEFRLGGGLNPGLVRALAISPSGRSVVAGFSSGFMVLLDTRTGLVLRGWPAHEGDILQIKAVEGSVLVSSSSDHSLTVWKELEQKPTHHYKSASDPIHTFDLYGSEVVTGTVSNKIGVCSLLEPPSQATTKLSSENFRGTLTSLALLPTKRHLLLGSDNGVIRLLA

SEQ ID NO: 97545 - protein, 714 aa, Homo sapiens
  Payload ID: 19451
  Gene Name: WD repeat domain 81
  Uniprot ID: Q562E7
  ENSP ID: ENSP00000407845
MVRWLSAKLGPTVASRHVARNLLRLLTSCYVGPTRQQFTVSSGESPPLSAGNIYQKRPVLGDIVSGPVLSCLLHIARLYGEPVLTYQYLPYISYLVAPGSASGPSRLNSRKEAGLLAAVTLTQKIIVYLSDTTLMDILPRISHEVLLPVLSFLTSLVTGFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGGGCPQDDGHSGTFGSVLVGNRIQIPNDSRPENPGPLGPISGVGGGGLGSGSDDNALKQELPRSVHGLSGNWLAYWQYEIGVSQQDAHFHFHQIRLQSFPGHSGAVKCVAPLSSEDFFLSGSKDRTVRLWPLYNYGDGTSETAPRLVYTQHRKSVFFVGQLEAPQHVVSCDGAVHVWDPFTGKTLRTVEPLDSRVPLTAVAVMPAPHTSITMASSDSTLRFVDCRKPGLQHEFRLGGGLNPGLVRALAISPSGRSVVAGFSSGFMVLLDTRTGLVLRGWPAHEGDILQIKAVEGSVLVSSSSDHSLTVWKELEQKPTHHYKSASDPIHTFDLYGSEVVTGTVSNKIGVCSLLEPPSQATTKLSSENFRGTLTSLALLPTKRHLLLGSDNGVIRLLA

SEQ ID NO: 97546 - protein, 197 aa, Homo sapiens
  Payload ID: 19451
  Gene Name: WD repeat domain 81
  ENSP ID: ENSP00000458811
  MOD_RES (1)..(1): Any amino acid
XFQAGLYVTESPQPQEAEAVSLGRLSDKSSTSETSLGEERAPDEGGAPVDKSSLRSGDSSQDLKQSEGSEEEEEEEDSCVVLEEEEGEQEEVTGASELTLSDTVLSMETVVAGGSGGDGEEEEEALPEQSEGKEQKILLGPTRQQFTVSSGESPPLSAGNIYQKRPVLGDIVSGPVLSCLLHIARLYGEPVLTYQYL

SEQ ID NO: 97547 - protein, 171 aa, Homo sapiens
  Payload ID: 19451
  Gene Name: WD repeat domain 81
  ENSP ID: ENSP00000460742
MHAGPCSSQPDTVVPRTQRALFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMP

SEQ ID NO: 97548 - protein, 123 aa, Homo sapiens
  Payload ID: 19451
  Gene Name: WD repeat domain 81
  ENSP ID: ENSP00000466240
  MOD_RES (1)..(1): Any amino acid
XRLLTSCYVGPTRQQFTVSSGESPPLSAGNIYQKRPVLGDIVSGPVLSCLLHIARLYGEPVLTYQYLPYISYLVPKWGPGSDHPVCENHQPHRPHLPAHWTGDGPAAPERARGHLFPGLLSAA

SEQ ID NO: 97549 - protein, 738 aa, Homo sapiens; identical to SEQ ID NO: 97541
  Payload ID: 19451
  Gene Name: WD repeat domain 81
  Uniprot ID: Q562E7
  ENSP ID: ENSP00000477991

SEQ ID NO: 97550 - protein, 714 aa, Homo sapiens; identical to SEQ ID NO: 97545
  Payload ID: 19451
  Gene Name: WD repeat domain 81
  Uniprot ID: Q562E7
  ENSP ID: ENSP00000480101

SEQ ID NO: 97551 - protein, 890 aa, Homo sapiens; identical to SEQ ID NO: 97539
  Payload ID: 19451
  Gene Name: WD repeat domain 81
  Uniprot ID: Q562E7
  ENSP ID: ENSP00000480442

SEQ ID NO: 97552 - protein, 580 aa, Homo sapiens; identical to SEQ ID NO: 97544
  Payload ID: 19451
  Gene Name: WD repeat domain 81
  ENSP ID: ENSP00000481723

SEQ ID NO: 97553 - protein, 132 aa, Homo sapiens; identical to SEQ ID NO: 97542
  Payload ID: 19451
  Gene Name: WD repeat domain 81
  ENSP ID: ENSP00000487826

SEQ ID NO: 97554 - protein, 123 aa, Homo sapiens; identical to SEQ ID NO: 97548
  Payload ID: 19451
  Gene Name: WD repeat domain 81
  ENSP ID: ENSP00000488235
  MOD_RES (1)..(1): Any amino acid

SEQ ID NO: 97555 - protein, 197 aa, Homo sapiens; identical to SEQ ID NO: 97546
  Payload ID: 19451
  Gene Name: WD repeat domain 81
  ENSP ID: ENSP00000488266
  MOD_RES (1)..(1): Any amino acid

SEQ ID NO: 97556 - protein, 1940 aa, Homo sapiens
  Payload ID: 19451
  Gene Name: WD repeat domain 81
  ENSP ID: ENSP00000488468
MAQGSGGREGALRTPAGGWHSPPSPDMQELLRSVERDLSIDPRQLAPAPGGTHVVALVPARWLASLRDRRLPLGPCPRAEGLGEAEVRTLLQRSVQRLPAGWTRVEVHGLRKRRLSYPLGGGLPFEDGSCGPETLTRFMQEVAAQNYRNLWRHAYHTYGQPYSHSPAPSAVPALDSVRQALQRVYGCSFLPVGETTQCPSYAREGPCPPRGSPACPSLLRAEALLESPEMLYVVHPYVQFSLHDVVTFSPAKLTNSQAKVLFILFRVLRAMDACHRQGLACGALSLYHIAVDEKLCSELRLDLSAYERPEEDENEEAPVARDEAGIVSQEEQGGQPGQPTGQEELRSLVLDWVHGRISNFHYLMQLNRLAGRRQGDPNYHPVLPWVVDFTTPHGRFRDLRKSKFRLNKGDKQLDFTYEMTRQAFVAGGAGGGEPPHVPHHISDVLSDITYYVYKARRTPRSVLCGHVRAQWEPHEYPASMERMQNWTPDECIPEFYTDPSIFRSIHPDMPDLDVPAWCSSSQEFVAAHRALLESREVSRDLHHWIDLTFGYKLQGKEAVKEKNVCLHLVDAHTHLASYGVVQLFDQPHPQRLAGAPALAPEPPLIPKLLVQTIQETTGREDFTENPGQLPNGVGRPVLEATPCEASWTRDRPVAGEDDLEQATEALDSISLAGKAGDQLGSSSQASPGLLSFSVASASRPGRRNKAAGADPGEGEEGRILLPEGFNPMQALEELEKTGNFLAKGLGGLLEVPEQPRVQPAVPLQCLLHRDMQALGVLLAEMVFATRVRTLQPDAPLWVRFQAVRGLCTRHPKEVPVSLQPVLDTLLQMSGPEVPMGAERGKLDQLFEYRPVSQGLPPPCPSQLLSPFSSVVPFPPYFPALHRFILLYQARRVEDEAQGRELVFALWQQLGAVLKDITPEGLEILLPFVLSLMSEEHTAVYTAWYLFEPVAKALGPKNANKYLLKPLIGAYESPCQLHGRFYLYTDCFVAQLMVRLGLQAFLTHLLPHVLQVLAGAEASQEESKDLAGAAEEESGLPGAGPGSCAFGEEIPMDGEPPASSGLGLPDYTSGVSFHDQADLPETEDFQAGLYVTESPQPQEAEAVSLGRLSDKSSTSETSLGEERAPDEGGAPVDKSSLRSGDSSQDLKQSEGSEEEEEEEDSCVVLEEEEGEQEEVTGASELTLSDTVLSMETVVAGGSGGDGEEEEEALPEQSEGKEQKILLDTACKMVRWLSAKLGPTVASRHVARNLLRLLTSCYVGPTRQQFTVSSGESPPLSAGNIYQKRPVLGDIVSGPVLSCLLHIARLYGEPVLTYQYLPYISYLVAPGSASGPSRLNSRKEAGLLAAVTLTQKIIVYLSDTTLMDILPRISHEVLLPVLSFLTSLVTGFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGGGCPQDDGHSGTFGSVLVGNRIQIPNDSRPENPGPLGPISGVGGGGLGSGSDDNALKQELPRSVHGLSGNWLAYWQYEIGVSQQDAHFHFHQIRLQSFPGHSGAVKCVAPLSSEDFFLSGSKDRTVRLWPLYNYGDGTSETAPRLVYTQHRKSVFFVGQLEAPQHVVSCDGAVHVWDPFTGKTLRTVEPLDSRVPLTAVAVMPAPHTSITMASSDSTLRFVDCRKPGLQHEFRLGGGLNPGLVRALAISPSGRSVVAGFSSGFMVLLDTRTGLVLRGWPAHEGDILQIKAVEGSVLVSSSSDHSLTVWKELEQKPTHHYKSASDPIHTFDLYGSEVVTGTVSNKIGVCSLLEPPSQATTKLSSENFRGTLTSLALLPTKRHLLLGSDNGVIRLLA

SEQ ID NO: 97557 - protein, 172 aa, Homo sapiens; identical to SEQ ID NO: 97543
  Payload ID: 19451
  Gene Name: WD repeat domain 81
  ENSP ID: ENSP00000488702

SEQ ID NO: 97558 - protein, 171 aa, Homo sapiens; identical to SEQ ID NO: 97547
  Payload ID: 19451
  Gene Name: WD repeat domain 81
  ENSP ID: ENSP00000488799

SEQ ID NO: 97559 - protein, 313 aa, Homo sapiens
  Payload ID: 19452
  Gene Name: WD repeat domain 82
  Uniprot ID: Q6UXN9
  ENSP ID: ENSP00000296490
MKLTDSVLRSFRVAKVFRENSDKINCFDFSPNGETVISSSDDDSIVLYDCQEGKPKRTLYSKKYGVDLIRYTHAANTVVYSSNKIDDTIRYLSLHDNKYIRYFPGHSKRVVALSMSPVDDTFISGSLDKTIRLWDLRSPNCQGLMHLQGKPVCSFDPEGLIFAAGVNSEMVKLYDLRSFDKGPFATFKMQYDRTCEWTGLKFSNDGKLILISTNGSFIRLIDAFKGVVMHTFGGYANSKAVTLEASFTPDSQFIMIGSEDGKIHVWNGESGIKVAVLDGKHTGPITCLQFNPKFMTFASACSNMAFWLPTIDD

SEQ ID NO: 97560 - protein, 47 aa, Homo sapiens
  Payload ID: 19452
  Gene Name: WD repeat domain 82
  ENSP ID: ENSP00000417313
MSPVDDTFISGSLDKTIRLWDLRSPNCQGLMHLQGKPVCSFDPEGLI

SEQ ID NO: 97561 - protein, 74 aa, Homo sapiens
  Payload ID: 19452
  Gene Name: WD repeat domain 82
  ENSP ID: ENSP00000420779
MSPVDDTFISGSLDKTIRLWDLRSPNCQGLMHLQGKPVCSFDPEGLIFAAGVNSEMVKLYDLRSFDKGPFATFK

SEQ ID NO: 97562 - protein, 74 aa, Homo sapiens
  Payload ID: 19453
  Gene Name: WD repeat domain 83
  ENSP ID: ENSP00000396530
DKTLKLWNPLRGTLLRTYSGHGYEVLDAAGSFDNSSLCSGGGDKAVVLWDVASGQVVRKFRGHAGLRGWPRETL

SEQ ID NO: 97563 - protein, 315 aa, Homo sapiens
  Payload ID: 19453
  Gene Name: WD repeat domain 83
  Uniprot ID: Q9BRX9
  ENSP ID: ENSP00000402653
MAFPEPKPRPPELPQKRLKTLDCGQGAVRAVRFNVDGNYCLTCGSDKTLKLWNPLRGTLLRTYSGHGYEVLDAAGSFDNSSLCSGGGDKAVVLWDVASGQVVRKFRGHAGKVNTVQFNEEATVILSGSIDSSIRCWDCRSRRPEPVQTLDEARDGVSSVKVSDHEILAGSVDGRVRRYDLRMGQLFSDYVGSPITCTCFSRDGQCTLVSSLDSTLRLLDKDTGELLGEYKGHKNQEYKLDCCLSERDTHVVSCSEDGKVFFWDLVEGALALALPVGSGVVQSLAYHPTEPCLLTAMGGSVQCWREEAYEAEDGAG

SEQ ID NO: 97564 - protein, 153 aa, Homo sapiens
  Payload ID: 19453
  Gene Name: WD repeat domain 83
  ENSP ID: ENSP00000448331
MAFPEPKPRPPELPQKRLKTLDCGQGAVRAVRFNVDGNYCLTCGSDKTLKLWNPLRGTLLRTYSGHGYEVLDAAGSFDNSSLCSGGGDKAVVLWDVASGQVVRKFRGHAGKVNTVQFNEEATVILSVSAVGIAAHGGLSQCRRWMRPEMACPV

SEQ ID NO: 97565 - protein, 71 aa, Homo sapiens
  Payload ID: 19453
  Gene Name: WD repeat domain 83
  ENSP ID: ENSP00000448722
MAFPEPKPRPPELPQKRLKTLDCGQGAVRAVRFNVDGNYCLTCGSDKTLKLWNPLRGTLLRTYSGHGYELL

SEQ ID NO: 97566 - protein, 211 aa, Homo sapiens
  Payload ID: 19453
  Gene Name: WD repeat domain 83
  ENSP ID: ENSP00000449257
  MOD_RES (1)..(1): Any amino acid
XGQVVRKFRGHAGKVNTVQFNEEATVILSGSIDSSIRCWDCRSRRPEPVQTLDEARDGVSSVKVSDHEILAGRAWWCMPVFPSTREAEEGESLEPGRQRFRSVDGRVRRYDLRMGQLFSDYVGSPITCTCFSRDGQCTLVSSLDSTLRLLDKDTGELLGEYKGHKNQEYKLDCCLSERDTHVVSCSEDGKVFFWDLVEGALALALPVGSGV

SEQ ID NO: 97567 - protein, 71 aa, Homo sapiens; identical to SEQ ID NO: 97565
  Payload ID: 19453
  Gene Name: WD repeat domain 83
  ENSP ID: ENSP00000450416

SEQ ID NO: 97568 - protein, 104 aa, Homo sapiens
  Payload ID: 19454
  Gene Name: WD repeat domain 83 opposite strand
  ENSP ID: ENSP00000222190
MSTNNMSDPRRPNKVLRYKPPPSECNPALDDPTPDYMNLLGMIFSMCGLMLKWCAWVAVYCSFISFANSRSSEDTKQMMSSFMLSISAVVMSYLQNPQPMTPPW

SEQ ID NO: 97569 - protein, 106 aa, Homo sapiens
  Payload ID: 19454
  Gene Name: WD repeat domain 83 opposite strand
  Uniprot ID: Q9Y284
  ENSP ID: ENSP00000468969
MSTNNMSDPRRPNKVLRYKPPPSECNPALDDPTPDYMNLLGMIFSMCGLMLKLKWCAWVAVYCSFISFANSRSSEDTKQMMSSFMLSISAVVMSYLQNPQPMTPPW

SEQ ID NO: 97570 - protein, 85 aa, Homo sapiens
  Payload ID: 19454
  Gene Name: WD repeat domain 83 opposite strand
  ENSP ID: ENSP00000471797
  MOD_RES (1)..(1): Any amino acid
XSTNNMSDPRRPNKVLRYKPPPSECNPALDDPTPDYMNLLGMIFSMCGLMLKLKWCAWVAVYCSFISFANSRSSEDTKQMMSSFM

SEQ ID NO: 97571 - protein, 376 aa, Homo sapiens
  Payload ID: 19455
  Gene Name: WD repeat domain 86
  Uniprot ID: Q86TI4
  ENSP ID: ENSP00000335522
MGGGGSALRVCADHRGGINWLSLSPDGQRLLTGSEDGTARLWSTADGQCCALLQGHESYVTFCQLEDEAAFTCSADCTIRRWDVLTGQCLQVYRGHTSIVNRILVANNQLFSSSYDRTARVWSVDKGQMSREFRGHRNCVLTLAYSAPWDLPSTPCAEEAAAGGLLVTGSTDGTAKVWQVASGCCHQTLRGHTGAVLCLVLDTPGHTAFTGSTDATIRAWDILSGEQLRVFREHRGSVICLELVNRLVYSGSADRTVKCWLADTGECVRTFTAHRRNVSALKYHAGTLFTGSGDACARAFDAQSGELRRVFRGHTFIINCIQVHGQVLYTASHDGALRLWDVRGLRGAPRPPPPMRSLSRLFSNKVGCAAAPLQPA

SEQ ID NO: 97572 - protein, 277 aa, Homo sapiens
  Payload ID: 19455
  Gene Name: WD repeat domain 86
  Uniprot ID: Q86TI4
  ENSP ID: ENSP00000417512
MSREFRGHRNCVLTLAYSAPWDLPSTPCAEEAAAGGLLVTGSTDGTAKVWQVASGCCHQTLRGHTGAVLCLVLDTPGHTAFTGSTDATIRAWDILSGEQLRVFREHRGSVICLECSRAAGTLAPGPSTRSLESCGGCSGATHSSSTASRCTARCSTPPRTTAPCASGTCAGSEVPRGPLRPCAASRGSSATRWAAPPRPCSRPDPAGPLQTPAQTPSGSQSAPPCYPRWWRPMAGEGRGARKPGREESPSQASGFSLVARRRWERECSPWGPPPFPF

SEQ ID NO: 97573 - protein, 482 aa, Homo sapiens
  Payload ID: 19455
  Gene Name: WD repeat domain 86
  Uniprot ID: Q86TI4
  ENSP ID: ENSP00000419162
MGGGGSALRVCADHRGGINWLSLSPDGQRLLTGSEDGTARLWSTADGQCCALLQGHESYVTFCQLEDEAAFTCSADCTIRRWDVLTGQCLQVYRGHTSIVNRILVANNQLFSSSYDRTARVWSVDKGQMSREFRGHRNCVLTLAYSAPWDLPSTPCAEEAAAGGLLVTGSTDGTAKVWQVASGCCHQTLRGHTGAVLCLVLDTPGHTAFTGSTDATIRAWDILSGEQLRVFREHRGSVICLERERSGGLQSCPSCRPSLLLLAAGEPTRVLWQRGQDRQVLAGRHRGVCAHVHGPQTQRERPQVPRGHLVHGQRGRLRPGLRRAVWRAAEGVPGPHIHHQLHPGARPGALHRLARRRPAPLGRARAPRCPAAPSAHAQPLAALQQQGGLRRRAPAAGLIPRGPCRRQPRHPAAPRAPRPATRGGGARWPARGEERGSPGGRRARRRRLVFLWWPGGAGSGSARPGDRPLFPFRVAPVLPPHP

SEQ ID NO: 97574 - protein, 248 aa, Homo sapiens
  Payload ID: 19455
  Gene Name: WD repeat domain 86
  ENSP ID: ENSP00000482209
MSREFRGHRNCVLTLAYSAPWDLPSTPCAEEAAAGGLLVTGSTDGTAKVWQVASGCCHQTLRGHTGAVLCLVLDTPGHTAFTGSTDATIRAWDILSGEQLRVFREHRGSVICLELVNRLVYSGSADRTVKCWLADTGECVRTFTAHRRNVSALKYHAGTLFTGSGDACARAFDAQSGELRRVFRGHTFIINCIQVHGQVLYTASHDGALRLWDVRGLRGAPRPPPPMRSLSRLFSNKVGCAAAPLQPA

SEQ ID NO: 97575 - protein, 277 aa, Homo sapiens; identical to SEQ ID NO: 97572
  Payload ID: 19455
  Gene Name: WD repeat domain 86
  Uniprot ID: Q86TI4
  ENSP ID: ENSP00000486705

SEQ ID NO: 97576 - protein, 2873 aa, Homo sapiens
  Payload ID: 19456
  Gene Name: WD repeat domain 87
  Uniprot ID: Q6ZQQ6
  ENSP ID: ENSP00000368025
MSSPRLIPLWKDLKLLLNDTINKSKQPSEDPKNCLIVLSDRSQAVAWMKSKTEDMVEKRTFSMTERLPPIQSMVHAGSFHILVVYCGDLILRLFGDHFRAFKPLGKVPCRFNISCLCYDPEMKMLLSGILGAVVTWVIELGGTGLQIAHMVSMPGDELVQDIVLNGPSGSLLALCETVVRVLMHQGKGQLGEVKRFTSTSSGSSITCCFTCFDQGFLYAGNQAGEIQVWSLQQGHPLHSFQAHQSGVICIRSRPEAHTLLTAGSDSLIKEWNLTSGSLLRRLELGEELYRLQFIDSITFFCQTAHSFSLHRLPCFYSLFNVCGSAPQQLRRVCCGNNWFRILCTTEDGLLRFVSPVTGDLLVITWPFSILDQAVDWAYDPGKEELFVATGSSEVLVFDTTRCPCPAKYLLGTSPNSQDFVQCLAYGHFNLGRGLEGLIFSGHQSGVIRVLSQHSCARLEKFMHFGAVLALSTLSGGIFGGQGNSLLCSYGMDDYVHLSEAVLDGVKVQLRPLASILSSCHLTHLILLPKSVGAITETNCLRLWKFHDFLSSGSQNGLKFIETLPLHLCAITSFDVCLSLSLFVTGSADGSVRIWDFHGRLIGILDSSLHFGPVCFANDRGDLLVTFNQSLYLVSCLKLLPPALLTRLSFMSISDEVLEVPKPFIPSFFFSFETMFVPKYIYPGQAQQKLVGLEKLVNNRAIAFDHSVPHVIEEDEEGSPVLLRSSMHYSLQDMEDWMQVSKRYQCHYVLPPQLQLTSWDGLNPYQILRYYFGHGREWLFAPDCYIPNSVIRARLWPEGTPIYLQCNLHAPQRELEWDRSQEFFFWHSRVRAISNTEYPKNKEEDEHFLEMRLSKDVTYSVLTDGANRSWLGRKMSEITINSMIETMLNIMVHASLLKYQCCVGALGQIFASYQVSPALRSETARRLLNDTTNSNPLIRELAWEGLKRLGMITHLFAMPLAQGLMDKDERVRIKTLSLMAEIGIHSRTSLLQLTQKQETFREMQQQMIGEEPLDHLLGMRATDLQILSTQVEQRLNENLTLSHRDEKPAFSLDVSMPSELKSSLKPPTVSEESEVAIKPSKGQRRGQAGVKKHSQKWLRGLKKTKERDSKQMSTEPGLLEDESGTEAAPIEMEEASVYSQWSSSTSVIKLSKDVDSQEKDISKDHIALTLKRLQKIRDKRDKKATAQKLKKKHKKKGKEAKVINEETTPPVMEQPVTKKVKIQGRGASGISGRRSTAGDGSSWRDDLCRLMALRISGSQTKMSENLNAELVTFAQEMLVDRHPSWELFQEICPLLKKESKVLLEDLDWDVVPPEKKPIFIQEGAIREDMIQGVTQEVIRHKEVMPREEEQAQKKARDMLGLEETQVILKKGKKVIFLEPGNVTMGKEISKKEEKKTFQKSPKQGRKAVQKERKVGKIKREMTKEERDMSEEVEEMATLEEKVVKQEGKLVMIERTPSWQDWKKAWDEWKQVHGETRKSWKAWKEEWEKRLLQEEEKLHQAGEKLSPEEEMLQEDKKLKWEEWKQVWENMLSSKSKEQQYKDEEEVTLEEEVSREGEEKEQQVTEEQRHIQEEHKWARIHRKRARAEKKRAQEERKLAQEEEKLAQEERQLAQEERKLAQAYVKITQDDREMAQAEGKFAQKEETLAQRGEKLSQEAEKLAQKRKKLAKKWEKVAREEEKLAKKGGKLAEVKNILAQKVEELPQREQNLDWQEKELAQELEELEWDMEELSWKEEELNQEEGKLVEEKKKLAEEEEALAWQREKLSEEETKLAQEEELLIQEKEKLAQHKEKMPEEEERLGRKREQLIEKKMKLAQKRERWINSMEELTKNKMILYQKKNLAQEKKNLAQEKEKLAQRKENLLYNKERLTHSKKQLVQVKNKLGMFNKILAQVEEKLTQEKETVIKKKEKLAETEKKLVQVEDSLAKKQEKLAQEKMKLALEKAMVQGKKRLRGELDIAKEEKALNLEMKRLAEEKMRLVEGKETLSKGETPETSRQRKMTQVEQELFERKLSLEEKILLHEDRILAMEESEIAKGKLEFTRGQRIFVQGQRKLAKASRKLIKKRESLSKEPAKLNKILKALQKLTRDERKLTQEEIKMTKMKRALFVKERRLSIEQSKLDIKEWDFSEKRSELTKDEKKLARKQRKLANKMRRMINKEEKMTEEESKLARKHSEVILDDEEEGGIEEEEVIPFLKRRWRKRKEAKRGDKPKEKFSSQVDEVESEEHFSEEMESLLDELEKQESLSSEEEEEREEEEEREEEEEREEEEERKEEEEGEEKQVEKEEEEKKKKKKEKKKEEVQEKEEVFEEKEEIMSEEETESLSDEEEEEESCSLEEEVDREKEILKKEKQFKLQEQRRKSLRGRERVLSILRGVPHGKGRAIRLGVLKSPLKKLMSTALEMKEKTPVPVPEKQISWEDKKATVVEIPRKFLGTMDKEREVMGKYEPIPPHVLGTVLESQAQDLKTPFMSHILRRTVEAEELQHKPLGAWWKWFLQHPPLMGQTEVQLPLSQIPAKEQHADVSLSDVEWIRHVLERMEAGEQLSRDGFHRLCQLLKDLASKGNLEWLHLAKHEAIVYRHRQALESQDTRISSRQSMSPKYLKVIPPIKAKEKESWPKPLAVPTQKSPLATKRIPDPRAKNWHLLGEPYRSERAQQISIAHKEMEMQYFYPATRDIFPSAHASVEKQTLALMFQKDFWDFKDKRRFPKLPKLEKKTQPISKKKEELPLWETFVALYHVLRMLQQRYPKDSTAWMEQFYQLMDLYQLKSPRIQKLLQELLMREEPQPQEIIYEEALKATELVPGERLFCCLFCGSSHTPRSPQEFQGAVPLPWQNCVRTILPVGIARYGILELAWKSLPEADLHLTKALTHTVAPTL

SEQ ID NO: 97577 - protein, 2912 aa, Homo sapiens
  Payload ID: 19456
  Gene Name: WD repeat domain 87
  ENSP ID: ENSP00000405012
MSSPRLIPLWKDLKLLLNDTINKSKQPSEDPKNCLIVLSDRSQVLFKESRYPQNMPCVCYYFSDAHFFASLSWVTSNTKEIQAVAWMKSKTEDMVEKRTFSMTERLPPIQSMVHAGSFHILVVYCGDLILRLFGDHFRAFKPLGKVPCRFNISCLCYDPEMKMLLSGILGAVVTWVIELGGTGLQIAHMVSMPGDELVQDIVLNGPSGSLLALCETVVRVLMHQGKGQLGEVKRFTSTSSGSSITCCFTCFDQGFLYAGNQAGEIQVWSLQQGHPLHSFQAHQSGVICIRSRPEAHTLLTAGSDSLIKEWNLTSGSLLRRLELGEELYRLQFIDSITFFCQTAHSFSLHRLPCFYSLFNVCGSAPQQLRRVCCGNNWFRILCTTEDGLLRFVSPVTGDLLVITWPFSILDQAVDWAYDPGKEELFVATGSSEVLVFDTTRCPCPAKYLLGTSPNSQDFVQCLAYGHFNLGRGLEGLIFSGHQSGVIRVLSQHSCARLEKFMHFGAVLALSTLSGGIFGGQGNSLLCSYGMDDYVHLSEAVLDGVKVQLRPLASILSSCHLTHLILLPKSVGAITETNCLRLWKFHDFLSSGSQNGLKFIETLPLHLCAITSFDVCLSLSLFVTGSADGSVRIWDFHGRLIGILDSSLHFGPVCFANDRGDLLVTFNQSLYLVSCLKLLPPALLTRLSFMSISDEVLEVPKPFIPSFFFSFETMFVPKYIYPGQAQQKLVGLEKLVNNRAIAFDHSVPHVIEEDEEGSPVLLRSSMHYSLQDMEDWMQVSKRYQCHYVLPPQLQLTSWDGLNPYQILRYYFGHGREWLFAPDCYIPNSVIRARLWPEGTPIYLQCNLHAPQRELEWDRSQEFFFWHSRVRAISNTEYPKNKEEDEHFLEMRLSKDVTYSVLTDGANRSWLGRKMSEITINSMIETMLNIMVHASLLKYQCCVGALGQIFASYQVSPALRSETARRLLNDTTNSNPLIRELAWEGLKRLGMITHLFAMPLAQGLMDKDERVRIKTLSLMAEIGIHSRTSLLQLTQKQETFREMQQQMIGEEPLDHLLGMRATDLQILSTQVEQRLNENLTLSHRDEKPAFSLDVSMPSELKSSLKPPTVSEESEVAIKPSKGQRRGQAGVKKHSQKWLRGLKKTKERDSKQMSTEPGLLEDESGTEAAPIEMEEASVYSQWSSSTSVIKLSKDVDSQEKDISKDHIALTLKRLQKIRDKRDKKATAQKLKKKHKKKGKEAKVINEETTPPVMEQPVTKKVKIQGRGASGISGRRSTAGDGSSWRDDLCRLMALRISGSQTKMSENLNAELVTFAQEMLVDRHPSWELFQEICPLLKKESKVLLEDLDWDVVPPEKKPIFIQEGAIREDMIQGVTQEVIRHKEVMPREEEQAQKKARDMLGLEETQVILKKGKKVIFLEPGNVTMGKEISKKEEKKTFQKSPKQGRKAVQKERKVGKIKREMTKEERDMSEEVEEMATLEEKVVKQEGKLVMIERTPSWQDWKKAWDEWKQVHGETRKSWKAWKEEWEKRLLQEEEKLHQAGEKLSPEEEMLQEDKKLKWEEWKQVWENMLSSKSKEQQYKDEEEVTLEEEVSREGEEKEQQVTEEQRHIQEEHKWARIHRKRARAEKKRAQEERKLAQEEEKLAQEERQLAQEERKLAQAYVKITQDDREMAQAEGKFAQKEETLAQRGEKLSQEAEKLAQKRKKLAKKWEKVAREEEKLAKKGGKLAEVKNILAQKVEELPQREQNLDWQEKELAQELEELEWDMEELSWKEEELNQEEGKLVEEKKKLAEEEEALAWQREKLSEEETKLAQEEELLIQEKEKLAQHKEKMPEEEERLGRKREQLIEKKMKLAQKRERWINSMEELTKNKMILYQKKNLAQEKKNLAQEKEKLAQRKENLLYNKERLTHSKKQLVQVKNKLGMFNKILAQVEEKLTQEKETVIKKKEKLAETEKKLVQVEDSLAKKQEKLAQEKMKLALEKAMVQGKKRLRGELDIAKEEKALNLEMKRLAEEKMRLVEGKETLSKGETPETSRQRKMTQVEQELFERKLSLEEKILLHEDRILAMEESEIAKGKLEFTRGQRIFVQGQRKLAKASRKLIKKRESLSKEPAKLNKILKALQKLTRDERKLTQEEIKMTKMKRALFVKERRLSIEQSKLDIKEWDFSEKRSELTKDEKKLARKQRKLANKMRRMINKEEKMTEEESKLARKHSEVILDDEEEGGIEEEEVIPFLKRRWRKRKEAKRGDKPKEKFSSQVDEVESEEHFSEEMESLLDELEKQESLSSEEEEEREEEEEREEEEEREEEEERKEEEEGEEKQVEKEEEEKKKKKKEKKKEEVQEKEEVFEEKEEIMSEEETESLSDEEEEEESCSLEEEVDREKEILKKEKQFKLQEQRRKSLRGRERVLSILRGVPHGKGRAIRLGVLKSPLKKLMSTALEMKEKTPVPVPEKQISWEDKKATVVEIPRKFLGTMDKEREVMGKYEPIPPHVLGTVLESQAQDLKTPFMSHILRRTVEAEELQHKPLGAWWKWFLQHPPLMGQTEVQLPLSQIPAKEQHADVSLSDVEWIRHVLERMEAGEQLSRDGFHRLCQLLKDLASKGNLEWLHLAKHEAIVYRHRQALESQDTRISSRQSMSPKYLKVIPPIKAKEKESWPKPLAVPTQKSPLATKRIPDPRAKNWHLLGEPYRSERAQQISIAHKEMEMQYFYPATRDIFPSAHASVEKQTLALMFQKDFWDFKDKRRFPKLPKLEKKTQPISKKKEELPLWETFVALYHVLRMLQQRYPKDSTAWMEQFYQLMDLYQLKSPRIQKLLQELLMREEPQPQEIIYEEALKATELVPGERLFCCLFCGSSHTPRSPQEFQGAVPLPWQNCVRTILPVGIARYGILELAWKSLPEADLHLTKALTHTVAPTL

SEQ ID NO: 97578 - protein, 679 aa, Homo sapiens
  Payload ID: 19456
  Gene Name: WD repeat domain 87
  ENSP ID: ENSP00000484308
MVSMPGDELVQDIVLNGPSGSLLALCETVVRVLMHQGKGQLGEVKRFTSTSSGSSITCCFTCFDQGFLYAGNQAGEIQVWSLQQGHPLHSFQAHQSGVICIRSRPEAHTLLTAGSDSLIKEWNLTSGSLLRRLELGEELYRLQFIDSITFFCQTAHSFSLHRLPCFYSLFNVCGSAPQQLRRVCCGNNWFRILCTTEDGLLRFVSPVTGDLLVITWPFSILDQAVDWAYDPGKEELFVATGSSEVLVFDTTRCPCPAKYLLGTSPNSQDFVQCLAYGHFNLGRGLEGLIFSGHQSGVIRVLSQHSCARLEKFMHFGAVLALSTLSGGIFGGQGNSLLCSYGMDDYVHLSEAVLDGVKVQLRPLASILSSCHLTHLILLPKSVGAITETNCLRLWKFHDFLSSGSQNGLKFIETLPLHLCAITSFDVCLSLSLFVTGSADGSVRIWDFHGRLIGILDSSLHFGPVCFANDRGDLLVTFNQSLYLVSCLKLLPPALLTRLSFMSISDEVLEVPKPFIPSFFFSFETMFVPKYIYPGQAQQKLVGLEKLVNNRAIAFDHSVPHVIEEDEEGSPVLLRSSMHYSLQDMEDWMQVSKRYQCHYVLPPQLQLTSWDGLNPYQILRYYFGHGREWLFAPDCYIPNSVIRARLWPEGTPIYLQCNLHAPQRELEWDRSQNSFSGTAG

SEQ ID NO: 97579 - protein, 472 aa, Homo sapiens
  Payload ID: 19457
  Gene Name: WD repeat domain 88
  Uniprot ID: Q6ZMY6
  ENSP ID: ENSP00000348129
MASPPRCSPTAHDRECKLPPPSAPASEYCPGKLSWGTMARALGRFKLSIPHTHLLATLDPLALDREPPPHLLPEKHQVPEKLIWGDQDPLSKIPFKILSGHEHAVSTCHFCVDDTKLLSGSYDCTVKLWDPVDGSVVRDFEHRPKAPVVECSITGDSSRVIAASYDKTVRAWDLETGKLLWKVRYDTFIVSCKFSPDGKYVVSGFDVDHGICIMDAENITTVSVIKDHHTRSITSCCFDPDSQRVASVSLDRCIKIWDVTSQATLLTITKAHSNAISNCCFTFSGHFLCTSSWDKNLKIWNVHTGEFRNCGACVTLMQGHEGSVSSCHFARDSSFLISGGFDRTVAIWDVAEGYRKLSLKGHNDWVMDVAISNNKKWILSASKDRTMRLWNIEEIDEIPLVIKYKKAVGLKLKQCERCDRPFSIFKSDTSSEMFTQCVFCRIDTRGLPADTSSSSSSSERENSPPPRGSKDD

SEQ ID NO: 97580 - protein, 426 aa, Homo sapiens
  Payload ID: 19457
  Gene Name: WD repeat domain 88
  Uniprot ID: Q6ZMY6
  ENSP ID: ENSP00000355148
MASPPRCSPTAHDRECKLPPPSAPASEYCPGKLSWGTMARALGRFKLSIPHTHLLATLDPLALDREPPPHLLPEKHQVPEKLIWGDQDPLSKIPFKILSGHEHAVSTCHFCVDDTKLLSGSYDCTVKLWDPVDGSVVRDFEHRPKAPVVECSITGDSSRVIAASYDKTVRAWDLETGKLLWKVRYDTFIVSCKFSPDGKYVVSGFDVDHGICIMDAENITTVSVIKDHHTRSITSCCFDPDSQRVASVSLDRCIKIWDVTSQATLLTITKAHSNAISNCCFTFSGHFLCTSSWDKNLKIWNVHTGEFRNCGACVTLMQGHEGSVSSCHFARDSSFLISGGFDRTVAIWDVAEGYRKLSLKGHNDWVMDVAISNNKKWILSASKDRTMRLWNIEEIDEIPLVIKYKKAVGLKLKQEKKEAYLKLKQG

SEQ ID NO: 97581 - protein, 164 aa, Homo sapiens
  Payload ID: 19457
  Gene Name: WD repeat domain 88
  ENSP ID: ENSP00000467383
MASPPRCSPTAHDRECKLPPPSAPASEYCPGKLSWGTMARALGRFKLSIPHTHLLATLDPLALDREPPPHLLPEKHQVPEKLIWGDQDPLSKIPFKILSGHEHAVSTCHFCVDDTKLLSGSYDCTVKLWDPVDGSVVRDFEHRPKAPVVECSITGDSSSHCRIL

SEQ ID NO: 97582 - protein, 387 aa, Homo sapiens
  Payload ID: 19458
  Gene Name: WD repeat domain 89
  Uniprot ID: Q96FK6
  ENSP ID: ENSP00000267522
MEKIEEQFANLHIVKCSLGTKEPTYLLGIDTSKTVQAGKENLVAVLCSNGSIRIYDKERLNVLREFSGYPGLLNGVRFANSCDSVYSACTDGTVKCWDARVAREKPVQLFKGYPSNIFISFDINCNDHIICAGTEKVDDDALLVFWDARMNSQNLSTTKDSLGAYSETHSDDVTQVRFHPSNPNMVVSGSSDGLVNVFDINIDNEEDALVTTCNSISSVSCIGWSGKGYKQIYCMTHDEGFYWWDLNHLDTDEPVTRLNIQDVREVVNMKEDALDYLIGGLYHEKTDTLHVIGGTNKGRIHLMNCSMSGLTHVTSLQGGHAATVRSFCWNVQDDSLLTGGEDAQLLLWKPGAIEKTFTKKESMKIASSVHQRVRVHSNDSYKRRKKQ

SEQ ID NO: 97583 - protein, 387 aa, Homo sapiens; identical to SEQ ID NO: 97582
  Payload ID: 19458
  Gene Name: WD repeat domain 89
  Uniprot ID: Q96FK6
  ENSP ID: ENSP00000378399

SEQ ID NO: 97584 - protein, 226 aa, Homo sapiens
  Payload ID: 19458
  Gene Name: WD repeat domain 89
  ENSP ID: ENSP00000451702
MEKIEEQFANLHIVKCSLGTKEPTYLLGIDTSKTVQAGKENLVAVLCSNGSIRIYDKERLNVLREFSGYPGLLNGVRFANSCDSVYSACTDGTVKCWDARVAREKPVQLFKGYPSNIFISFDINCNDHIICAGTEKVDDDALLVFWDARMNSQNLSTTKDSLGAYSETHSDDVTQVRFHPSNPNMVVSGSSDGLVNVFDINIDNEEDALVTTCNSISSVSCIGWSG

SEQ ID NO: 97585 - protein, 387 aa, Homo sapiens; identical to SEQ ID NO: 97582
  Payload ID: 19458
  Gene Name: WD repeat domain 89
  Uniprot ID: Q96FK6
  ENSP ID: ENSP00000480112

SEQ ID NO: 97586 - protein, 1748 aa, Homo sapiens
  Payload ID: 19459
  Gene Name: WD repeat domain 90
  Uniprot ID: Q96KV7
  ENSP ID: ENSP00000293879
MARAWQHPFLNVFRHFRVDEWKRSAKQGDVAVVTDKTLKGAVYRIRGSVSAANYIQLPKSSTQSLGLTGRYLYVLFRPLPSKHFVIHLDVSSKDNQVIRVSFSNLFKEFKSTATWLQFPLVLEARTPQRDLVGLAPSGARWTCLQLDLQDVLLVYLNRCYGHLKSIRLCASLLVRNLYTSDLCFEPAISGAQWAKLPVTPMPREMAFPVPKGESWHDRYIHVRFPSESLKVPSKPIEKSCSPPEAVLLGPGPQPLPCPVASSKPVRFSVSPVVQTPSPTASGRAALAPRPFPEVSLSQERSDASNADGPGFHSLEPWAQLEASDIHTAAAGTHVLTHESAEVPVARTGSCEGFLPDPVLRLKGVIGFGGHGTRQALWTPDGAAVVYPCHAVIVVLLVDTGEQRFFLGHTDKVSALALDGSSSLLASAQARAPSVMRLWDFQTGRCLCLFRSPMHVVCSLSFSDSGALLCGVGKDHHGRTMVVAWGTGQVGLGGEVVVLAKAHTDFDVQAFRVTFFDETRMASCGQGSVRLWRLRGGVLRSCPVDLGEHHALQFTDLAFKQARDGCPEPSAAMLFVCSRSGHILEIDCQRMVVRHARRLLPTRTPGGPHPQKQTFSSGPGIAISSLSVSPAMCAVGSEDGFLRLWPLDFSSVLLEAEHEGPVSSVCVSPDGLRVLSATSSGHLGFLDTLSRVYHMLARSHTAPVLALAMEQRRGQLATVSQDRTVRIWDLATLQQLYDFTSSEDAPCAVTFHPTRPTFFCGFSSGAVRSFSLEAAEVLVEHTCHRGAVTGLTATPDGRLLFSSCSQGSLAQYSCADPQWHVLRVAADMVCPDAPASPSALAVSRDGRLLAFVGPSRCTVTVMGSASLDELLRVDIGTLDLASSRLDSAMAVCFGPAALGHLLVSTSSNRVVVLDAVSGRIIRELPGVHPEPCPSLTLSEDARFLLIAAGRTIKVWDYATQASPGPQVYIGHSEPVQAVAFSPDQQQVLSAGDAVFLWDVLAPTESDQSFPGAPPACKTGPGAGPLEDAASRASELPRQQVPKPCQASPPRLGVCARPPEGGDGARDTRNSGAPRTTYLASCKAFTPARVSCSPHSAKGTCPPPASGGWLRLKAVVGYSGNGRANMVWRPDTGFFAYTCGRLVVVEDLHSGAQQHWSGHSAEISTLALSHSAQVLASASGRSSTTAHCQIRVWDVSGGLCQHLIFPHSTTVLALAFSPDDRLLVTLGDHDGRTLALWGTATYDLVSSTRLPEPVHGVAFNPWDAGELTCVGQGTVTFWLLQQRGADISLQVRREPVPEAVGAGELTSLCYGAPPLLYCGTSSGQVCVWDTRAGRCFLSWEADDGGIGLLLFSGSRLVSGSSTGRLRLWAVGAVSELRCKGSGASSVFMEHELVLDGAVVSASFDDSVDMGVVGTTAGTLWFVSWAEGTSTRLISGHRSKVNEVVFSPGESHCATCSEDGSVRVWALASMELVIQFQVLNQSCLCLAWSPPCCGRPEQQRLAAGYGDGSLRIFSVSRTAMELKMHPHPVALTTVAFSTDGQTVLSGDKDGLVAVSHPCTGTTFRVLSDHQGAPISTICVTCKECEDLGVEGTDLWLAASGDQRVSVWASDWLRNHCELVDWLSFPMPATTETQGHLPPSLAAFCPWDGALLMYVGPGVYKEVIIYNLCQKQVVEKIPLPFFAMSLSLSPGTHLLAVGFAECMLRLVDCAMGTAQDFAGHDNAVHLCRFTPSARLLFTAARNEILVWEVPGL

SEQ ID NO: 97587 - protein, 299 aa, Homo sapiens
  Payload ID: 19459
  Gene Name: WD repeat domain 90
  Uniprot ID: Q96KV7
  ENSP ID: ENSP00000322808
MLWFGQPGPGGWNRKCLRPFTLPRGQHPQPSYGFPQVNEVVFSPGESHCATCSEDGSVRVWALASMELVIQFQVLNQSCLCLAWSPPCCGRPEQQRLAAGYGDGSLRIFSVSRTAMELKMHPHPVALTTVAFSTDGQTVLSGDKDGLVAVSHPCTGTTFRVLSDHQGAPISTICVTCKETQGHLPPSLAAFCPWDGALLMYVGPGVYKEVIIYNLCQKQVVEKIPLPFFAMSLSLSPGTHLLAVGFAECMLRLVDCAMGTAQDFAGHDNAVHLCRFTPSARLLFTAARNEILVWEVPGL

SEQ ID NO: 97588 - protein, 133 aa, Homo sapiens
  Payload ID: 19459
  Gene Name: WD repeat domain 90
  ENSP ID: ENSP00000447435
  MOD_RES (1)..(1): Any amino acid
XPGAGPLEDAASRASELPRQQVPKPCQASPPRLGVCARPPEGGDGARDTRNSGAPRTTYLASCKAFTPARVSCSPHSAKALGHRWPCWAPAASGSPSSQGTCPPPASGGWLRLKAVVGYSGNGRANMVWRPDT

SEQ ID NO: 97589 - protein, 115 aa, Homo sapiens
  Payload ID: 19459
  Gene Name: WD repeat domain 90
  ENSP ID: ENSP00000447915
EKIPLPFFAMSLSLSPGTHLLAVGFAGLHRPPGCSSRPPATRSLCGRSPASEMQQGLWWWASRLVMPGTWTQAWQRRQVVNGLMLGQARIHVNRLEQAVVNLAPCEYFHTCCPFA

SEQ ID NO: 97590 - protein, 1750 aa, Homo sapiens
  Payload ID: 19459
  Gene Name: WD repeat domain 90
  ENSP ID: ENSP00000448122
MARAWQHPFLNVFRHFRVDEWKRSAKQGDVAVVTDKTLKGAVYRIRGSVSAANYIQLPKSSTQSLGLTGRYLYVLFRPLPSKHFVIHLDVSSKDNQVIRVSFSNLFKEFKSTATWLQFPLVLEARTPQRDLVGLAPSGARWTCLQLDLQDVLLVYLNRCYGHLKSIRLCASLLVRNLYTSDLCFEPAISGAQWAKLPVTPMPREMAFPVPKGESWHDRYIHVRFPSESLKVPSKPIEKSCSPPEAVLLGPGPQPLPCPVASSKPVRFSVSPVVQTPSPTASGRAALAPRPFPEVSLSQERSDASNADGPGFHSLEPWAQLEASDIHTAAAGTHVLTHESAEVPVARTGSCEGFLPDPVLRLKGVIGFGGHGTRQALWTPDGAAVVYPCHAVIVVLLVDTGEQRFFLGHTDKVSALALDGSSSLLASAQARAPSVMRLWDFQTGRCLCLFRSPMHVVCSLSFSDSGALLCGVGKDHHGRTMVVAWGTGQVGLGGEVVVLAKAHTDFDVQAFRVTFFDETRMASCGQGSVRLWRLRGGVLRSCPVDLGEHHALQFTDLAFKQARDGCPEPSAAMLFVCSRSGHILEIDCQRMVVRHARRLLPTRTPGGPHPQKQTFSSGPGIAISSLSVSPAMCAVGSEDGFLRLWPLDFSSVLLEAEHEGPVSSVCVSPDGLRVLSATSSGHLGFLDTLSRVYHMLARSHTAPVLALAMEQRRGQLATVSQDRTVRIWDLATLQQLYDFTSSEDAPCAVTFHPTRPTFFCGFSSGAVRSFSLEAAEVLVEHTCHRGAVTGLTATPDGRLLFSSCSQGSLAQYSCADPQWHVLRVAADMVCPDAPASPSALAVSRDGRLLAFVGPSRCTVTVMGSASLDELLRVDIGTLDLASSRLDSAMAVCFGPAALGHLLVSTSSNRVVVLDAVSGRIIRELPGVHPEPCPSLTLSEDARFLLIAAGRTIKVWDYATQASPGPQVYIGHSEPVQAVAFSPDQQQVLSAGDAVFLWDVLAPTESDQSFPGAPPACKTGPGAGPLEDAASRASELPRQQVPKPCQASPPRLGVCARPPEGGDGARDTRNSGAPRTTYLASCKAFTPARVSCSPHSAKGTCPPPASGGWLRLKAVVGYSGNGRANMVWRPDTGFFAYTCGRLVVVEDLHSGAQQHWSGHSAEISTLALSHSAQVLASASGRSSTTAHCQIRVWDVSGGLCQHLIFPHSTTVLALAFSPDDRLLVTLGDHDGRTLALWGTATYDLVSSTRLPEPVHGVAFNPWDAGELTCVGQGTVTFWLLQQRGADISLQVRREPVPEAVGAGELTSLCYGAPPLLYCGTSSGQVCVWDTRAGRCFLSWEADDGGIGLLLFSGSRLVSGSSTGRLRLWAVGAVSELRCKGSGARSSSVFMEHELVLDGAVVSASFDDSVDMGVVGTTAGTLWFVSWAEGTSTRLISGHRSKVNEVVFSPGESHCATCSEDGSVRVWALASMELVIQFQVLNQSCLCLAWSPPCCGRPEQQRLAAGYGDGSLRIFSVSRTAMELKMHPHPVALTTVAFSTDGQTVLSGDKDGLVAVSHPCTGTTFRVLSDHQGAPISTICVTCKECEDLGVEGTDLWLAASGDQRVSVWASDWLRNHCELVDWLSFPMPATTETQGHLPPSLAAFCPWDGALLMYVGPGVYKEVIIYNLCQKQVVEKIPLPFFAMSLSLSPGTHLLAVGFAECMLRLVDCAMGTAQDFAGHDNAVHLCRFTPSARLLFTAARNEILVWEVPGL

SEQ ID NO: 97591 - protein, 475 aa, Homo sapiens
  Payload ID: 19459
  Gene Name: WD repeat domain 90
  ENSP ID: ENSP00000448603
ARSHTAPVLALAMEQRRGQLATVSQDRTVRIWDLATLQQLYDFTSSEDAPCAVTFHPTRPTFFCGFSSGAVRSFSLEAAEVLVEHTCHRGAVTGLTATPDGRLLFSSCSQGSLAQYSCADPQWHVLRVAADMVCPDAPASPSALAVSRDGRLLAFVGPSRCTVTVMGSASLDELLRVDIGTLDLASSRLDSAMAVCFGPAALGHLLVSTSSNRVVVLDAVSGRIIRELPGVHPEPCPSLTLSEDARFLLIAAGRTIKVWDYATQASPGPQVYIGHSEPVQAVAFSPDQQQVLSAGDAVFLWDVLAPTESDQSFPGAPPACKTGPGAGPLEDAASRASELPRQQVPKPCQASPPRLGVCARPPEGGDGHLPASRQRWVAASEGCRRLQREWAGQHGLEAGHRLLCLHVRPPGGGGGPALWRPAALVRPLCGDLHAGPQPQCPGPGLCLGPKQHDRPLSDPRLGRVWRPLPASHFPP

SEQ ID NO: 97592 - protein, 347 aa, Homo sapiens
  Payload ID: 19459
  Gene Name: WD repeat domain 90
  ENSP ID: ENSP00000449576
MLWFGQPGPGGWNRKCLRPFTLPRGQHPQPSYGFPQVNEVVFSPGESHCATCSEDGSVRVWALASMELVIQFQVLNQSCLCLAWSPPCCGRPEQQRLAAGYGDGSLRIFSVSRTAMELKMHPHPVALTTVAFSTDGQTVLSGDKDGLVAVSHPCTGTTFRVLSDHQGAPISTICVTCKECEDLGVEGTDLWLAASGDQRVSVWASDWLRNHCELVDWLSFPMPATTETQGHLPPSLAAFCPWDGALLMYVGPGVYKEVIIYNLCQKQVVEKIPLPFFAMSLSLSPGTHLLAVGFAECMLRLVDCAMGTAQDFAGHDNAVHLCRFTPSARLLFTAARNEILVWEVPGL

SEQ ID NO: 97593 - protein, 78 aa, Homo sapiens
  Payload ID: 19459
  Gene Name: WD repeat domain 90
  ENSP ID: ENSP00000450308
  MOD_RES (1)..(1): Any amino acid
XASGDQRVSVWASDWLRNHCELVDWLSFPMPATTETQGHLPPSLAAFCPWDGALLMYVGPGVYKEVIIYNLCQKQSAC

SEQ ID NO: 97594 - protein, 728 aa, Homo sapiens
  Payload ID: 19459
  Gene Name: WD repeat domain 90
  ENSP ID: ENSP00000483098
MARAWQHPFLNVFRHFRVDEWKRSAKQGDVAVVTDKTLKGAVYRIRGSVSAANYIQLPKSSTQSLGLTGRYLYVLFRPLPSKHFVIHLDVSSKDNQVIRVSFSNLFKEFKSTATWLQFPLVLEARTPQRDLVGLAPSGARWTCLQLDLQDVLLVYLNRCYGHLKSIRLCASLLVRNLYTSDLCFEPAISGAQWAKLPVTPMPREMAFPVPKGESWHDRYIHVRFPSESLKVPSKPIEKSCSPPEAVLLGPGPQPLPCPVASSKPVRFSVSPVVQTPSPTASGRAALAPRPFPEVSLSQERSDASNADGPGFHSLEPWAQLEASDIHTAAAGTHVLTHESAEVPVARTGSCEGFLPDPVLRLKGVIGFGGHGTRQALWTPDGAAVVYPCHAVIVVLLVDTGEQRFFLGHTDKVSALALDGSSSLLASAQARAPSVMRLWDFQTGRCLCLFRSPMHVVCSLSFSDSGALLCGVGKDHHGRTMVVAWGTGQVGLGGEVVVLAKAHTDFDVQAFRVTFFDETRMASCGQGSVRLWRLRGGVLRSCPVDLGEHHALQFTDLAFKQARDGCPEPSAAMLFVCSRSGHILEIDCQRMVVRHARRLLPTRTPGGPHPQKQTFSSGPGIAISSLSVSPAMCAVGSEDGFLRLWPLDFSSVLLEAGDAVGTLSQLRESLAWMLGRGRPSPRGSAVSRPGSWLHRVPRPSGISRALGRLMPGRPAGQPHGRARWDVGSV

SEQ ID NO: 97595 - protein, 747 aa, Homo sapiens
  Payload ID: 19460
  Gene Name: WD repeat domain 91
  Uniprot ID: A4D1P6
  ENSP ID: ENSP00000346466
MAEAVERTDELVREYLLFRGFTHTLRQLDAEIKADKEKGFRVDKIVDQLQQLMQVYDLAALRDYWSYLERRLFSRLEDIYRPTIHKLKTSLFRFYLVYTIQTNRNDKAQEFFAKQATELQNQAEWKDWFVLPFLPSPDTNPTFATYFSRQWADTFIVSLHNFLSVLFQCMPVPVILNFDAECQRTNQVQEENEVLRQKLFALQAEIHRLKKEEQQPEEEEALVQHKLPPYVSNMDRLGDSELAMVCSQRNASLSQSPRVGFLSSLLPQSKKSPSRLSPAQGPPQPQSSAKKESFGGQGTKGKDPTSGAKDGKSLLSGLATGESGWSQHRQRRLQDHGKERKELFSTTTSQCAEKKPEASGPEAEPCPELHTEPVEPLTRASSAGPEGGGVRPEQPFIVLGQEEYGEHHSSIMHCRVDCSGRRVASLDVDGVIKVWSFNPIMQTKASSISKSPLLSLEWATKRDRLLLLGSGVGTVRLYDTEAKKNLCEININDNMPRILSLACSPNGASFVCSAAAPSLTSQVDFSAPDIGSKGMNQVPGRLLLWDTKTMKQQLQFSLDPEPIAINCTAFNHNGNLLVTGAADGVIRLFDMQQHECAMSWRAHYGEVYSVEFSYDENTVYSIGEDGKFIQWNIHKSGLKVSEYSLPSDATGPFVLSGYSGYKQVQVPRGRLFAFDSEGNYMLTCSATGGVIYKLGGDEKVLESCLSLGGHRAPVVTVDWSTAMDCGTCLTASMDGKIKLTTLLAHKA

SEQ ID NO: 97596 - protein, 712 aa, Homo sapiens
  Payload ID: 19460
  Gene Name: WD repeat domain 91
  ENSP ID: ENSP00000392555
MIFHCEVDKIVDQLQQLMQVYDLAALRDYWSYLERRLFSRLEDIYRPTIHKLKTSLFRFYLVYTIQTNRNDKAQEFFAKQATELQNQAEWKDWFVLPFLPSPDTNPTFATYFSRQWADTFIVSLHNFLSVLFQCMPVPVILNFDAECQRTNQVQEENEVLRQKLFALQAEIHRLKKEEQQPEEEEALVQHKLPPYVSNMDRLGDSELAMVCSQRNASLSQSPRVGFLSSLLPQSKKSPSRLSPAQGPPQPQSSAKKESFGGQGTKGKDPTSGAKDGKSLLSGLATGESGWSQHRQRRLQDHGKERKELFSTTTSQCAEKKPEASGPEAEPCPELHTEPVEPLTRASSAGPEGGGVRPEQPFIVLGQEEYGEHHSSIMHCRVDCSGRRVASLDVDGVIKVWSFNPIMQTKASSISKSPLLSLEWATKRDRLLLLGSGVGTVRLYDTEAKKNLCEININDNMPRILSLACSPNGASFVCSAAAPSLTSQVDFSAPDIGSKGMNQVPGRLLLWDTKTMKQQLQFSLDPEPIAINCTAFNHNGNLLVTGAADGVIRLFDMQQHECAMSWRAHYGEVYSVEFSYDENTVYSIGEDGKFIQWNIHKSGLKVSEYSLPSDATGPFVLSGYSGYKQVQVPRGRLFAFDSEGNYMLTCSATGGVIYKLGGDEKVLESCLSLGGHRAPVVTVDWSTAMDCGTCLTASMDGKIKLTTLLAHKA

SEQ ID NO: 97597 - protein, 357 aa, Homo sapiens
  Payload ID: 19461
  Gene Name: WD repeat domain 92
  Uniprot ID: Q96MX6
  ENSP ID: ENSP00000295121
MSAFEKPQIIAHIQKGFNYTVFDCKWVPCSAKFVTMGNFARGTGVIQLYEIQHGDLKLLREIEKAKPIKCGTFGATSLQQRYLATGDFGGNLHIWNLEAPEMPVYSVKGHKEIINAIDGIGGLGIGEGAPEIVTGSRDGTVKVWDPRQKDDPVANMEPVQGENKRDCWTVAFGNAYNQEERVVCAGYDNGDIKLFDLRNMALRWETNIKNGVCSLEFDRKDISMNKLVATSLEGKFHVFDMRTQHPTKGFASVSEKAHKSTVWQVRHLPQNRELFLTAGGAGGLHLWKYEYPIQRSKKDSEGIEMGVAGSVSLLQNVTLSTQPISSLDWSPDKRGLCVCSSFDQTVRVLIVTKLNKI

SEQ ID NO: 97598 - protein, 187 aa, Homo sapiens
  Payload ID: 19461
  Gene Name: WD repeat domain 92
  ENSP ID: ENSP00000384518
MPVYSVKGHKEIINAIDGIGGLGIGEGAPEIVTGSRDGTVKVWDPRQKDDPVANMEPVQGENKRDCWTVAFGNAYNQEERVVCAGYDNGDIKLFDLRNMALRWETNIKNGVCSLEFDRKDISMNKLVATSLEGKFHVFDMRTQHPTKGFASVSEKAHKSTVWQVRHLPQNRELFLTAGGAGGLHLWK

SEQ ID NO: 97599 - protein, 288 aa, Homo sapiens
  Payload ID: 19461
  Gene Name: WD repeat domain 92
  Uniprot ID: Q96MX6
  ENSP ID: ENSP00000386746
MSAFEKPQIIAHIQKGFNYTVFDCKWVPCSAKFVTMGNFARGTGVIQLYEIQHGDLKLLREIEKAKPIKCGTFGATSLQQRYLATGDFGGNLHIWNLEAPEMPVYSVKGHKEIINAIDGIGGLGIGEGAPEIVTGSRDGTVKVWDPRQKDDPVANMEPVQGENKRDCWTVAFGNAYNQEERVVCAGYDNGDIKLFDLRNMALRWETNIKNGVCSLEFDRKDISMNKLVATSLEGKFHVFDMRTQHPTKGFASVSEKAHKSTVWQVRHLPQNRELFLTAGGAGGLHLWK

SEQ ID NO: 97600 - protein, 92 aa, Homo sapiens
  Payload ID: 19461
  Gene Name: WD repeat domain 92
  ENSP ID: ENSP00000410301
  MOD_RES (1)..(1): Any amino acid
XRNMALRWETNIKNGVCSLEFDRKDISMNKLVATSLEGKFHVFDMRTQHPTKGFASVSEKAHKSTVWQVRHLPQNRELFLTAGGAGGLHLWK

SEQ ID NO: 97601 - protein, 686 aa, Homo sapiens
  Payload ID: 19462
  Gene Name: WD repeat domain 93
  Uniprot ID: Q6P2C0
  ENSP ID: ENSP00000268130
MSFPRGSQTQKIKHPIGTRKGPLEVPPPTEKDWPKDDEQDHVLVDPDEELDSLPQPYRMINKLVNLLFDQSWEIIEERNALREAESSQIQPTVYPPLGEIQLNKMPNCMAVSQDYVFIGGAKGFSIYNLYSAKQIYAWEKLKVDVTSIWATDLGNEILIAPVDEMGIIRLFYFYKEGLYLVKAINEVDDTSKQTTCIKMEISQGGDFAAFLLQGAGDIWLDVYKLPKETWLKKLEHPQLTSNPKKKVRQPQLNSLGPISADPLEMDANVSFKGDIKLSLPVYIMKIKPPKPVTGTTFKSPLEVFAKIKDCYGLGSGQNHFIKDSQWEQQAEIFNASYKKYLDREWEEEPLSTATFYFLLPSCLFAMPPEVKGPSGMACVLGIHWTRSHNFFLYSLNRTLKDKADPEGVWPCAAPIAVSQLSCSSSYLVLACEDGVLTLWDLAKGFPLGVAALPQGCFCQSIHFLKYFSVHKGQNMYPEGQVKSQMKCVVLCTDASLHLVEASGTQGPTISVLVERPVKHLDKTICAVAPVPALPGMVLIFSKNGSVCLMDVAKREIICAFAPPGAFPLEVPWKPVFAVSPDHPCFLLRGDYSHETASTDDAGIQYSVFYFNFEACPLLENISKNCTIPQRDLDNMAFPQALPLEKRCERFLQKSYRKLEKNPEKEEEHWARLQRYSLSLQRENFKK

SEQ ID NO: 97602 - protein, 173 aa, Homo sapiens
  Payload ID: 19462
  Gene Name: WD repeat domain 93
  ENSP ID: ENSP00000453022
MSFPRGSQTQKIKHPIGTRKGPLEVPPPTEKDWPKDDEQDHVLVDPDEELDSLPQPYRMINKLVNLLFDQSWEIIEERNALREAESSQIQPTVYPPLGEIQLNKMPNCMAVSQDYVFIGGAKGFSIYNLYSAKQIYAWEKLKVDVTSIWATDLGNEILIAPVDEMGIVLHLPF

SEQ ID NO: 97603 - protein, 658 aa, Homo sapiens
  Payload ID: 19462
  Gene Name: WD repeat domain 93
  Uniprot ID: Q6P2C0
  ENSP ID: ENSP00000453971
MSFPRGSQTQKIKHPIGTRKGPLEVPPPTEKDWPKDDEQDHVLVDPDEELDSLPQPYRMINKLVNLLFDQSWEIIEERNALREAESSQIQPTVYPPLGEIQLNKMPNCMAVSQDYVFIGGAKGFSIYNLYSAKQIYAWEKLKVDVTSIWATDLGNEILIAPVDEMGIIRLFYFYKEGLYLVKAINEVDDTSKQTTCIKMEISQGGDFAAFLLQGAGDIWLDVYKLPKETWLKKLEHPQLTSNPKKKVRQPQLNSLGPISADPLEMDANVSFKGDIKLSLPVYIMKIKPPKPVTGTTFKSPLEVFAKIKDCYGLGSGQNHFIKDSQWEQQAEIFNASYKKYLDREWEEEPLSTATFYFLLPSCLFAMPPEVKGPSGMACVLGIHWTRSHNFFLYSLNRTLKDKADPEGVWPCAAPIAVSQLSCSSSYLVLACEDGVLTLWDLAKGQNMYPEGQVKSQMKCVVLCTDASLHLVEASGTQGPTISVLVERPVKHLDKTICAVAPVPALPGMVLIFSKNGSVCLMDVAKREIICAFAPPGAFPLEVPWKPVFAVSPDHPCFLLRGDYSHETASTDDAGIQYSVFYFNFEACPLLENISKNCTIPQRDLDNMAFPQALPLEKRCERFLQKSYRKLEKNPEKEEEHWARLQRYSLSLQRENFKK

SEQ ID NO: 97604 - protein, 1622 aa, Homo sapiens
  Payload ID: 19463
  Gene Name: WD repeat domain 97
  Uniprot ID: A6NE52
  ENSP ID: ENSP00000320648
MEAEVWEAEGYNLVLDSDLYDADGYDVPDPGLLTEKNELTFTEPSQVLPFLTSSQQWQSLTPRARARRLWLLLRTSLHEVVEKEKRAELRAARLTHGLEPLRRLEVAAGLRSVAQDPVGGRFVVLDGAGRLHLHKEDGWAQETLLAPVRLTGLVTVLGPLGAVGRFVGWGPAGLAILRPNLSLLWLSEQGVGRAPGWAPTCCLPVPDLRLLLVAEMNSSLALWQFRSGGRRLVLRGSALHPPPSPTGRLMRLAVAPVPPHHVLRCFAAYGSAVLTFDLHAWTLVDVRRDLHKTTISDLAYCEEVEAMVTASRDSTVKVWEADWQIRMVFVGHTGPVTAMTVLPNTTLVLSASQDGTLRTWDLQAAAQVGEVALGFWGQDKLSRRVGRLLAPVRPGWPVLSLCASSMQLWRVRELYSPLAQLPAKVLHVQVAPALPAPAHQSLPTRLVCACADGSVYLLSAATGRIVSSLLLEPEDCAAAVAYCLPREALWLLTRAGHLVRANAARCPMSVLHRVCPPPPPAPQPCCLHLYSHLTDLEGAFSSWEIVRQHWGELRCSSVACAWKNKNRYLPVVGHTDGTLSVLEWLSSKTVFQTEAHSPGPVVAIASTWNSIVSSGGDLTVKMWRVFPYAEESLSLLRTFSCCYPAVALCALGRRVTAGFEDPDSATYGLVQFGLGDSPRLDHRPQDDPTDHITGLCCCPTLKLYACSSLDCTVRIWTAENRLLRLLQLNGAPQALAFCSNSGDLVLALGSRLCLVSHRLYLPTSYLVKKMCRKAPDVVDDPPLPLMSQESLTSAQLQRLTNLHGAASLSEALSLIHRRRATSQHLVPKEDLDAIVARDRDLQQLRLGLVVPAAQPPPSWQQRQEGFDNYLRLIYGSGLLGMQSGRGSQQWSAGTLRVERETRDVCAVPQAAHCLARAEVSTAAQTVPTALSPQDLGALGQHFSQSPRVTVPIPPTHRRVHSKASQLLARSSLSHYLGISLDLQLQLEQLRGRTTMALDLPSSHLQCRIPLLPKRWDKEPLSSLRGFFPATVQPHKHCLRPICFPGYVPNSAVLQQMWLNAEPGASQDALWLWRPRPSQTQWQRKLLQWMGEKPGEEGEEDKKEEEEEKEDEELDWALASLSPHSNQQLDSWELEDQSAVDWTQEPRRRSCKVARTHPHPWHRHGSLLLDEHYGHLPKFLHFFIYQTWFKKLFPIFSLQAYPEAGTIEGLASLLVALLEKTTWVDRVHILQVLLRLLPNMSSDLQGQLQGLLVHLLNLDQPPSLQDQTQKKFVILALQLLLACSLESRDVVLELMSYFLYSPVHCRPELKKLLHGLGLQDPEGFLFKEMMTWVQGPDLDSKAGLRTCCHQKLEDMIQELQETPSQTSVVSGAPTRASVIPSGTSWSASGIFGRLSQVSEVPLMVVSPAEPHSLAPELQAQRMLAPKRSWGTPQLRLRVLSETLKSFCLEPEARLHPAGPAQLPGEPPPLEETDWSHSQLLDLGPIDALNFFCEQLRAQQRSSLQEKAAHPHPPEPYTVAPVPDMVVPPPREHWYHPILRLQEAKPQRSARSAMRLRGPMRSRLCAGRTLDGPIRTLKLPLPRVEPQPFPLDWPMPPRPLPPRLLQPALQRYFLPADADPDTYS

SEQ ID NO: 97605 - protein, 837 aa, Homo sapiens
  Payload ID: 19463
  Gene Name: WD repeat domain 97
  ENSP ID: ENSP00000435391
MEAEVWEAEGYNLVLDSDLYDADGYDVPDPGLLTEKNELTFTEPSQVLPFLTSSQQWQSLTPRARARRLWLLLRTSLHEVVEKEKRAELRAARLTHGLEPLRRLEVAAGLRSVAQDPVGGRFVVLDGAGRLHLHKEDGWAQETLLAPVRLTGLVTVLGPLGAVGRFVGWGPAGLAILRPNLSLLWLSEQGVGRAPGWAPTCCLPVPDLRLLLVAEMNSSLALWQFRSGGRRLVLRGSALHPPPSPTGRLMRLAVAPVPPHHVLRCFAAYGSAVLTFDLHAWTLVDVRRDLHKTTISDLAYCEEVEAMVTASRDSTVKVWEADWQIRMVFVGHTGPVTAMTVLPNTTLVLSASQDGTLRTWDLQAAAQVGEVALGFWGQDKLSRRVGRLLAPVRPGWPVLSLCASSMQLWRVRELYSPLAQLPAKVLHVQVAPALPAPAHQSLPTRLVCACADGSVYLLSAATGRIVSSLLLEPEDCAAAVAYCLPREALWLLTRAGHLVRANAARCPMSVLHRVCPPPPPAPQPCCLHLYSHLTDLEGAFSSWEIVRQHWGELRCSSVACAWKNKNRYLPVVGHTDGTLSVLEWLSSKTVFQTEAHSPGPVVAIASTWNSIVSSGGDLTVKMWRVFPYAEESLSLLRTFSCCYPAVALCALGRRVTAGFEDPDSATYGLVQFGLGDSPRLDHRPQDDPTDHITGLCCCPTLKLYACSSLDCTVRIWTAENRLLRLLQLNGAPQALAFCSNSGDLVLALGSRLCLVSHRLYLPTSYLVKKMCRKAPDVVDDPPLPLMSQESLTSAQLQRLTNLHGAASLRSHAGLLSPPGGPPFPLWVGAWRCGALWS

SEQ ID NO: 97606 - protein, 446 aa, Homo sapiens
  Payload ID: 19464
  Gene Name: WD repeat domain, phosphoinositide interacting 1
  Uniprot ID: Q5MNZ9
  ENSP ID: ENSP00000262139
MEAEAADAPPGGVESALSCFSFNQDCTSLATGTKAGYKLFSLSSVEQLDQVHGSNEIPDVYIVERLFSSSLVVVVSHTKPRQMNVYHFKKGTEICNYSYSSNILSIRLNRQRLLVCLEESIYIHNIKDMKLLKTLLDIPANPTGLCALSINHSNSYLAYPGSLTSGEIVLYDGNSLKTVCTIAAHEGTLAAITFNASGSKLASASEKGTVIRVFSVPDGQKLYEFRRGMKRYVTISSLVFSMDSQFLCASSNTETVHIFKLEQVTNSRPEEPSTWSGYMGKMFMAATNYLPTQVSDMMHQDRAFATARLNFSGQRNICTLSTIQKLPRLLVASSSGHLYMYNLDPQDGGECVLIKTHSLLGSGTTEENKENDLRPSLPQSYAATVARPSASSASTVPGYSEDGGALRGEVIPEHEFATGPVCLDDENEFPPIILCRGNQKGKTKQS

SEQ ID NO: 97607 - protein, 364 aa, Homo sapiens
  Payload ID: 19464
  Gene Name: WD repeat domain, phosphoinositide interacting 1
  ENSP ID: ENSP00000437345
MNVYHFKKGTEICNYSYSSNILSIRLNRQRLLVCLEESIYIHNIKDMKLLKTLLDIPANPTGLCALSINHSNSYLAYPGSLTSGEIVLYDGNSLKTVCTIAAHEGTLAAITFNASGSKLASASEKGTVIRVFSVPDGQKLYEFRRGMKRYVTISSLVFSMDSQFLCASSNTETVHIFKLEQVTNSRPEEPSTWSGYMGKMFMAATNYLPTQVSDMMHQDRAFATARLNFSGQRNICTLSTIQKLPRLLVASSSGHLYMYNLDPQDGGECVLIKTHSLLGSGTTEENKENDLRPSLPQSYAATVARPSASSASTVPGYSEDGGALRGEVIPEHEFATGPVCLDDENEFPPIILCRGNQKGKTKQS

SEQ ID NO: 97608 - protein, 369 aa, Homo sapiens
  Payload ID: 19464
  Gene Name: WD repeat domain, phosphoinositide interacting 1
  ENSP ID: ENSP00000465470
MEAEAADAPPGGVESALSCFSFNQDCTSLATGTKAGYKLFSLSSVEQLDQVHGSNEIPDVYIVERLFSSSLVVVVSHTKPRQMNVYHFKKGTEICNYSYSSNILSIRLNRQRLLVCLEESIYIHNIKDMKLLKTLLDIPANPTGLCALSINHSNSYLAYPGSLTSGEIVLYDGNSLKTVCTIAAHEGTLAAITFNASGSKLASASEKGTVIRVFSVPDGQKLYEFRRGMKRYVTISSLVFSMDSQFLCASSNTETVHIFKLEQVTNRQSTRRAFDLEWLHGKDVYGCYQLPPYPGVRHDASGQGFCHCTLELLRTEEHLYPLNDPEVATAASCVIQWTPLYVQFGSSGWRRVCLNQNPQLAWLRNNRRE

SEQ ID NO: 97609 - protein, 54 aa, Homo sapiens
  Payload ID: 19464
  Gene Name: WD repeat domain, phosphoinositide interacting 1
  ENSP ID: ENSP00000465557
  MOD_RES (1)..(1): Any amino acid
XVARPSASSASTVPGYSEDGGALRGEVIPEHEFATGPVCLDDENEFPPVSIRNP

SEQ ID NO: 97610 - protein, 82 aa, Homo sapiens
  Payload ID: 19464
  Gene Name: WD repeat domain, phosphoinositide interacting 1
  ENSP ID: ENSP00000465695
  MOD_RES (1)..(1): Any amino acid
XEENKENDLRPSLPQSYAATVARPSASSASTVPGYSEDGGALRGEVIPEHEFATGPVCLDDENEFPPIILCRGNQKGKTKQS

SEQ ID NO: 97611 - protein, 205 aa, Homo sapiens
  Payload ID: 19464
  Gene Name: WD repeat domain, phosphoinositide interacting 1
  ENSP ID: ENSP00000466270
VTISSLVFSMDSQFLCASSNTETVHIFKLEQVTNSRPEEPSTWSGYMGKMFMAATNYLPTQVSDMMHQDRAFATARLNFSGQRNICTLSTIQKLPRLLVASSSGHLYMYNLDPQDGGECVLIKTHSLLGSGTTEENKENDLRPSLPQSYAATVARPSASSASTVPGYSEDGGALRGEVIPEHEFATGPVCLDDENEFPPVSIRNP

SEQ ID NO: 97612 - protein, 454 aa, Homo sapiens
  Payload ID: 19465
  Gene Name: WD repeat domain, phosphoinositide interacting 2
  Uniprot ID: Q9Y4P8
  ENSP ID: ENSP00000288828
MNLASQSGEAGAGQLLFANFNQDNTEVKGASRAAGLGRRAVVWSLAVGSKSGYKFFSLSSVDKLEQIYECTDTEDVCIVERLFSSSLVAIVSLKAPRKLKVCHFKKGTEICNYSYSNTILAVKLNRQRLIVCLEESLYIHNIRDMKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRCVSICSLAFSMDGMFLSASSNTETVHIFKLETVKEKPPEEPTTWTGYFGKVLMASTSYLPSQVTEMFNQGRAFATVRLPFCGHKNICSLATIQKIPRLLVGAADGYLYMYNLDPQEGGECALMKQHRLDGSLETTNEILDSASHDCPLVTQTYGAAAGKGTYVPSSPTRLAYTDDLGAVGGACLEDEASALRLDEDSEHPPMILRTD

SEQ ID NO: 97613 - protein, 425 aa, Homo sapiens
  Payload ID: 19465
  Gene Name: WD repeat domain, phosphoinositide interacting 2
  Uniprot ID: Q9Y4P8
  ENSP ID: ENSP00000371821
MNLASQSGEAGAGQLLFANFNQDNTSLAVGSKSGYKFFSLSSVDKLEQIYECTDTEDVCIVERLFSSSLVAIVSLKAPRKLKVCHFKKGTEICNYSYSNTILAVKLNRQRLIVCLEESLYIHNIRDMKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRCVSICSLAFSMDGMFLSASSNTETVHIFKLETVKEKPPEEPTTWTGYFGKVLMASTSYLPSQVTEMFNQGRAFATVRLPFCGHKNICSLATIQKIPRLLVGAADGYLYMYNLDPQEGGECALMKQHRLDGSLETTNEILDSASHDCPLVTQTYGAAAGKAYTDDLGAVGGACLEDEASALRLDEDSEHPPMILRTD

SEQ ID NO: 97614 - protein, 436 aa, Homo sapiens
  Payload ID: 19465
  Gene Name: WD repeat domain, phosphoinositide interacting 2
  Uniprot ID: Q9Y4P8
  ENSP ID: ENSP00000384945
MNLASQSGEAGAGQLLFANFNQDNTSLAVGSKSGYKFFSLSSVDKLEQIYECTDTEDVCIVERLFSSSLVAIVSLKAPRKLKVCHFKKGTEICNYSYSNTILAVKLNRQRLIVCLEESLYIHNIRDMKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRCVSICSLAFSMDGMFLSASSNTETVHIFKLETVKEKPPEEPTTWTGYFGKVLMASTSYLPSQVTEMFNQGRAFATVRLPFCGHKNICSLATIQKIPRLLVGAADGYLYMYNLDPQEGGECALMKQHRLDGSLETTNEILDSASHDCPLVTQTYGAAAGKGTYVPSSPTRLAYTDDLGAVGGACLEDEASALRLDEDSEHPPMILRTD

SEQ ID NO: 97615 - protein, 443 aa, Homo sapiens
  Payload ID: 19465
  Gene Name: WD repeat domain, phosphoinositide interacting 2
  Uniprot ID: Q9Y4P8
  ENSP ID: ENSP00000385297
MNLASQSGEAGAGQLLFANFNQDNTEVKGASRAAGLGRRAVVWSLAVGSKSGYKFFSLSSVDKLEQIYECTDTEDVCIVERLFSSSLVAIVSLKAPRKLKVCHFKKGTEICNYSYSNTILAVKLNRQRLIVCLEESLYIHNIRDMKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRCVSICSLAFSMDGMFLSASSNTETVHIFKLETVKEKPPEEPTTWTGYFGKVLMASTSYLPSQVTEMFNQGRAFATVRLPFCGHKNICSLATIQKIPRLLVGAADGYLYMYNLDPQEGGECALMKQHRLDGSLETTNEILDSASHDCPLVTQTYGAAAGKAYTDDLGAVGGACLEDEASALRLDEDSEHPPMILRTD

SEQ ID NO: 97616 - protein, 384 aa, Homo sapiens
  Payload ID: 19465
  Gene Name: WD repeat domain, phosphoinositide interacting 2
  Uniprot ID: Q9Y4P8
  ENSP ID: ENSP00000429654
MFTHVLPFVISADTEDVCIVERLFSSSLVAIVSLKAPRKLKVCHFKKGTEICNYSYSNTILAVKLNRQRLIVCLEESLYIHNIRDMKVLHTIRETPPNPAGLCALSINNDNCYLAYPGSATIGEVQVFDTINLRAANMIPAHDSPLAALAFDASGTKLATASEKGTVIRVFSIPEGQKLFEFRRGVKRCVSICSLAFSMDGMFLSASSNTETVHIFKLETVKEKPPEEPTTWTGYFGKVLMASTSYLPSQVTEMFNQGRAFATVRLPFCGHKNICSLATIQKIPRLLVGAADGYLYMYNLDPQEGGECALMKQHRLDGSLETTNEILDSASHDCPLVTQTYGAAAGKAYTDDLGAVGGACLEDEASALRLDEDSEHPPMILRTD

SEQ ID NO: 97617 - protein, 384 aa, Homo sapiens
  Payload ID: 19466
  Gene Name: WD repeat, sterile alpha motif and U-box domain containing 1
  Uniprot ID: Q8N9V3
  ENSP ID: ENSP00000350866
MVKLIHTLADHGDDVNCCAFSFSLLATCSLDKTIRLYSLRDFTELPHSPLKFHTYAVHCCCFSPSGHILASCSTDGTTVLWNTENGQMLAVMEQPSGSPVRVCQFSPDSTCLASGAADGTVVLWNAQSYKLYRCGSVKDGSLAACAFSPNGSFFVTGSSCGDLTVWDDKMRCLHSEKAHDLGITCCDFSSQPVSDGEQGLQFFRLASCGQDCQVKIWIVSFTHILARRTEHQLKQFTEDWSEEDVSTWLCAQDLKDLVGIFKMNNIDGKELLNLTKESLADDLKIESLGLRSKVLRKIEELRTKVKSLSSGIPDEFICPITRELMKDPVIASDGYSYEKEAMENWISKKKRTSPMTNLVLPSAVLTPNRTLKMAINRWLETHQK

SEQ ID NO: 97618 - protein, 476 aa, Homo sapiens
  Payload ID: 19466
  Gene Name: WD repeat, sterile alpha motif and U-box domain containing 1
  Uniprot ID: Q8N9V3
  ENSP ID: ENSP00000352820
MVKLIHTLADHGDDVNCCAFSFSLLATCSLDKTIRLYSLRDFTELPHSPLKFHTYAVHCCCFSPSGHILASCSTDGTTVLWNTENGQMLAVMEQPSGSPVRVCQFSPDSTCLASGAADGTVVLWNAQSYKLYRCGSVKDGSLAACAFSPNGSFFVTGSSCGDLTVWDDKMRCLHSEKAHDLGITCCDFSSQPVSDGEQGLQFFRLASCGQDCQVKIWIVSFTHILGFELKYKSTLSGHCAPVLACAFSHDGQMLVSGSVDKSVIVYDTNTENILHTLTQHTRYVTTCAFAPNTLLLATGSMDKTVNIWQFDLETLCQARRTEHQLKQFTEDWSEEDVSTWLCAQDLKDLVGIFKMNNIDGKELLNLTKESLADDLKIESLGLRSKVLRKIEELRTKVKSLSSGIPDEFICPITRELMKDPVIASDGYSYEKEAMENWISKKKRTSPMTNLVLPSAVLTPNRTLKMAINRWLETHQK

SEQ ID NO: 97619 - protein, 476 aa, Homo sapiens; identical to SEQ ID NO: 97618
  Payload ID: 19466
  Gene Name: WD repeat, sterile alpha motif and U-box domain containing 1
  Uniprot ID: Q8N9V3
  ENSP ID: ENSP00000376545

SEQ ID NO: 97620 - protein, 429 aa, Homo sapiens
  Payload ID: 19466
  Gene Name: WD repeat, sterile alpha motif and U-box domain containing 1
  ENSP ID: ENSP00000386891
MVKLIHTLADHGDDVNCCAFSFSLLATCSLDKTIRLYSLRDFTELPHSPLKFHTYAVHCCCFSPSGHILASCSTDGTTVLWNTENGQMLAVMEQPSGSPVRVCQFSPDSTCLASGAADGTVVLWNAQSYKLYRCGSVKDGSLAACAFSPNGSFFVTGSSCGDLTVWDDKMRCLHSEKAHDLGITCCDFSSQPVSDGEQGLQFFRLASCGQDCQVKIWIVSFTHILGFELKYKSTLSGHCAPVLACAFSHDGQMLVSGSVDKSVIVYDTNTENILHTLTQHTRYVTTCAFAPNTLLLATGSMDKTVNIWQFDLETLCQARRTEHQLKQFTEDWSEEDVSTWLCAQDLKDLVGIFKMNNIDGKELLNLTKESLADDLKIDGYSYEKEAMENWISKKKRTSPMTNLVLPSAVLTPNRTLKMAINRWLETHQK

SEQ ID NO: 97621 - protein, 476 aa, Homo sapiens; identical to SEQ ID NO: 97618
  Payload ID: 19466
  Gene Name: WD repeat, sterile alpha motif and U-box domain containing 1
  Uniprot ID: Q8N9V3
  ENSP ID: ENSP00000387078

SEQ ID NO: 97622 - protein, 1271 aa, Homo sapiens
  Payload ID: 19467
  Gene Name: WDFY family member 4
  ENSP ID: ENSP00000265453
  MOD_RES (1)..(1): Any amino acid
XRDFQSEVLLSAMELFHMTSGGDAAMFRDGKEPQPSAEAAAAPSLANISCFTQKLVEKLYSGMFSADPRHILLFILEHIMVVIETASSQRDTVLSTLYSSLNKVILYCLSKPQQSLSECLGLLSILGFLQEHWDVVFATYNSNISFLLCLMHCLLLLNERSYPEGFGLEPKPRMSTYHQVFLSPNEDVKEKREDLPSLSDVQHNIQKTVQTLWQQLVAQRQQTLEDAFKIDLSVKPGEREVKIEEVTPLWEETMLKAWQHYLASEKKSLASRSNVAHHSKVTLWSGSLSSAMKLMPGRQAKDPECKTEDFVSCIENYRRRGQELYASLYKDHVQRRKCGNIKAANAWARIQEQLFGELGLWSQGEETKPCSPWELDWREGPARMRKRIKRLSPLEALSSGRHKESQDKNDHISQTNAENQDELTLREAEGEPDEVGVDCTQLTFFPALHESLHSEDFLELCRERQVILQELLDKEKVTQKFSLVIVQGHLVSEGVLLFGHQHFYICENFTLSPTGDVYCTRHCLSNISDPFIFNLCSKDRSTDHYSCQCHSYADMRELRQARFLLQDIALEIFFHNGYSKFLVFYNNDRSKAFKSFCSFQPSLKGKATSEDTLSLRRYPGSDRIMLQKWQKRDISNFEYLMYLNTAAGRTCNDYMQYPVFPWVLADYTSETLNLANPKIFRDLSKPMGAQTKERKLKFIQRFKEVEKTEGDMTVQCHYYTHYSSAIIVASYLVRMPPFTQAFCALQGGSFDVADRMFHSVKSTWESASRENMSDVRELTPEFFYLPEFLTNCNGVEFGCMQDGTVLGDVQLPPWADGDPRKFISLHRKALESDFVSANLHHWIDLIFGYKQQGPAAVDAVNIFHPYFYGDRMDLSSITDPLIKSTILGFVSNFGQVPKQLFTKPHPARTAAGKPLPGKDVSTPVSLPGHPQPFFYSLQSLRPSQVTVKDMYLFSLGSESPKGAIGHIVSTEKTILAVERNKVLLPPLWNRTFSWGFDDFSCCLGSYGSDKVLMTFENLAAWGRCLCAVCPSPTTIVTSGTSTVVCVWELSMTKGRPRGLRLRQALYGHTQAVTCLAASVTFSLLVSGSQDCTCILWDLDHLTHVTRLPAHREGISAITISDVSGTIVSCAGAHLSLWNVNGQPLASITTAWGPEGAITCCCLMEGPAWDTSQIIITGSQDGMVRVWKTEDVKMSVPGRPAGEEPPAQPPSPRGHKWEKNLALSRELDVSIALTGKPSKTSPAVTALAVSRNHTKLLVGDERGRIFCWSADG

SEQ ID NO: 97623 - protein, 3184 aa, Homo sapiens
  Payload ID: 19467
  Gene Name: WDFY family member 4
  Uniprot ID: Q6ZS81
  ENSP ID: ENSP00000320563
MEAEDLSKAEDRNEDPGSKNEGQLAAVQPDVPHGGQSSSPTALWDMLERKFLEYQQLTHKSPIERQKSLLSLLPLFLKAWEHSVGIICFPSLQRLAEDVSDQLAQQLQKALVGKPAEQARLAAGQLLWWKGDVDQDGYLLLKSVYVLTGTDSETLGRVAESGLPALLLQCLYLFFVFPLDKDELLESDLQVQKMFVQMLLNICSDSQGLEGLLSGSELQSLLIATTCLREHSCCFWKEPTFCVLRAISKAQNLSIIQYLQATDCVRLSLQNLSRLTDTLPAPEVSEAVSLILGFVKDSYPVSSALFLEFENSEGYPLLLKVLLRYDGLTQSEVDPHLEELLGLVVWLTTCGRSELKVFDSITYPQLEGFKFHHEASGVTVKNLQAFQVLQNVFHKASDSVLCIQVLSVIRTMWAWNARNFFLLEWTLQPISQFVEIMPLKPAPVQEHFFQLLEALVFELHYVPHEILRKVQHLIKESPGPSCTLMALQSILSIAGGDPLFTDIFRDSGLLGLLLAQLRKQAKIMRKSGNKVSTPGVQDPERELTCVMLRIVVTLLKGSVRNAVVLKDHGMVPFIKIFLDDECYREASLSILEQLSAINAEEYMSIIVGALCSSTQGELQLKLDLLKSLLRILVTPKGRAAFRVSSGFNGLLSLLSDLEGSLQEPPLQAWGAVSPRQTLELVLYTLCAVSAALHWDPVNGYFFRRNGLFEKLAEDLCLLGCFGALEEEGNLLRSWVDTKARPFADLLGTAFSSSGSLPPRIQSCLQILGFLDSMASGTLHLRGDLKESLRTKQGPVVDVQKGETGSDPQRNFKQWPDLEERMDEGDAAIMHPGVVCIMVRLLPRLYHEDHPQLSEEIQCSLASHIQSLVKSEKNRQVMCEAGLLGTLMASCHRALVTSGSPLHSRLIRIFEKLASQAIEPDVLRQFLGLGIPSSLSATTKILDSSHTHRGNPGCSGSQTAQGLAEGPWPAAPDAGLHPGVTQAPQPLGESQDSTTALQTALSLISMTSPRNLQPQRAALAPSFVEFDMSVEGYGCLFIPTLSTVMGTSTEYSVSGGIGTGATRPFPPPGGLTFSCWFLISRHGAATEGHPLRFLTLVRHLARTEQPFVCFSVSLCPDDLSLVVSTEEKEFQPLDVMEPEDDSEPSAGCQLQVRCGQLLACGQWHHLAVVVTKEMKRHCTVSTCLDGQVIGSAKMLYIQALPGPFLSMDPSAFVDVYGYIATPRVWKQKSSLIWRLGPTYLFEEAISMETLEVINKLGPRYCGNFQAVHVQGEDLDSEATPFVAEERVSFGLHIASSSITSVADIRNAYNEVDSRLIAKEMNISSRDNAMPVFLLRNCAGHLSGSLRTIGAVAVGQLGVRVFHSSPAASSLDFIGGPAILLGLISLATDDHTMYAAVKVLHSVLTSNAMCDFLMQHICGYQIMAFLLRKKASLLNHRIFQLILSVAGTVELGFRSSAITNTGVFQHILCNFELWMNTADNLELSLFSHLLEILQSPREGPRNAEAAHQAQLIPKLIFLFNEPSLIPSKISTIIGILACQLRGHFSTQDLLRIGLFVVYTLKPSSVNERQICMDGALDPSLPAGSQTSGKTIWLRNQLLEMLLSVISSPQLHLSSESKEEMFLKLGPDWFLLLLQGHLHASTTVLALKLLLYFLASPSLRTRFRDGLCAGSWVERSTEGVDIVMDNLKSQSPLPEQSPCLLPGFRVLNDFLAHHVHIPEVYLIVSTFFLQTPLTELMDGPKDSLDAMLQWLLQRHHQEEVLQAGLCTEGALLLLEMLKATMSQPLAGSEDGAWAQTFPASVLQFLSLVHRTYPQDPAWRAPEFLQTLAIAAFPLGAQKGVGAESTRNTSSPEAAAEGDSTVEGLQAPTKAHPARRKLREFTQLLLRELLLGASSPKQWLPLEVLLEASPDHATSQQKRDFQSEVLLSAMELFHMTSGGDAAMFRDGKEPQPSAEAAAAPSLANISCFTQKLVEKLYSGMFSADPRHILLFILEHIMVVIETASSQRDTVLSTLYSSLNKVILYCLSKPQQSLSECLGLLSILGFLQEHWDVVFATYNSNISFLLCLMHCLLLLNERSYPEGFGLEPKPRMSTYHQVFLSPNEDVKEKREDLPSLSDVQHNIQKTVQTLWQQLVAQRQQTLEDAFKIDLSVKPGEREVKIEEVTPLWEETMLKAWQHYLASEKKSLASRSNVAHHSKVTLWSGSLSSAMKLMPGRQAKDPECKTEDFVSCIENYRRRGQELYASLYKDHVQRRKCGNIKAANAWARIQEQLFGELGLWSQGEETKPCSPWELDWREGPARMRKRIKRLSPLEALSSGRHKESQDKNDHISQTNAENQDELTLREAEGEPDEVGVDCTQLTFFPALHESLHSEDFLELCRERQVILQELLDKEKVTQKFSLVIVQGHLVSEGVLLFGHQHFYICENFTLSPTGDVYCTRHCLSNISDPFIFNLCSKDRSTDHYSCQCHSYADMRELRQARFLLQDIALEIFFHNGYSKFLVFYNNDRSKAFKSFCSFQPSLKGKATSEDTLSLRRYPGSDRIMLQKWQKRDISNFEYLMYLNTAAGRTCNDYMQYPVFPWVLADYTSETLNLANPKIFRDLSKPMGAQTKERKLKFIQRFKEVEKTEGDMTVQCHYYTHYSSAIIVASYLVRMPPFTQAFCALQGGSFDVADRMFHSVKSTWESASRENMSDVRELTPEFFYLPEFLTNCNGVEFGCMQDGTVLGDVQLPPWADGDPRKFISLHRKALESDFVSANLHHWIDLIFGYKQQGPAAVDAVNIFHPYFYGDRMDLSSITDPLIKSTILGFVSNFGQVPKQLFTKPHPARTAAGKPLPGKDVSTPVSLPGHPQPFFYSLQSLRPSQVTVKDMYLFSLGSESPKGAIGHIVSTEKTILAVERNKVLLPPLWNRTFSWGFDDFSCCLGSYGSDKVLMTFENLAAWGRCLCAVCPSPTTIVTSGTSTVVCVWELSMTKGRPRGLRLRQALYGHTQAVTCLAASVTFSLLVSGSQDCTCILWDLDHLTHVTRLPAHREGISAITISDVSGTIVSCAGAHLSLWNVNGQPLASITTAWGPEGAITCCCLMEGPAWDTSQIIITGSQDGMVRVWKTEDVKMSVPGRPAGEEPPAQPPSPRGHKWEKNLALSRELDVSIALTGKPSKTSPAVTALAVSRNHTKLLVGDERGRIFCWSADG

SEQ ID NO: 97624 - protein, 654 aa, Homo sapiens
  Payload ID: 19467
  Gene Name: WDFY family member 4
  Uniprot ID: Q6ZS81
  ENSP ID: ENSP00000354141
MEAEDLSKAEDRNEDPGSKNEGQLAAVQPDVPHGGQSSSPTALWDMLERKFLEYQQLTHKSPIERQKSLLSLLPLFLKAWEHSVGIICFPSLQRLAEDVSDQLAQQLQKALVGKPAEQARLAAGQLLWWKGDVDQDGYLLLKSVYVLTGTDSETLGRVAESGLPALLLQCLYLFFVFPLDKDELLESDLQVQKMFVQMLLNICSDSQGLEGLLSGSELQSLLIATTCLREHSCCFWKEPTFCVLRAISKAQNLSIIQYLQATDCVRLSLQNLSRLTDTLPAPEVSEAVSLILGFVKDSYPVSSALFLEFENSEGYPLLLKVLLRYDGLTQSEVDPHLEELLGLVVWLTTCGRSELKVFDSITYPQLEGFKFHHEASGVTVKNLQAFQVLQNVFHKASDSVLCIQVLSVIRTMWAWNARNFFLLEWTLQPISQFVEIMPLKPAPVQEHFFQLLEALVFELHYVPHEILRKVQHLIKESPGPSCTLMALQSILSIAGGDPLFTDIFRDSGLLGLLLAQLRKQAKIMRKSGNKVSTPGVQDPERELTCVMLRIVVTLLKGSVRNAVVLKDHGMVPFIKIFLDDECYREASLSILEQLSAINAEEYMSIIVGALCSSTQGELQLKLDLLKVISSPPLRLASLWICTKRSTFAQAFVFM

SEQ ID NO: 97625 - protein, 552 aa, Homo sapiens
  Payload ID: 19467
  Gene Name: WDFY family member 4
  ENSP ID: ENSP00000363276
  MOD_RES (1)..(1): Any amino acid
XDDTVVWAEECVACANWLWMNTADNLELSLFSHLLEILQSPREGPRNAEAAHQAQLIPKLIFLFNEPSLIPSKISTIIGILACQLRGHFSTQDLLRIGLFVVYTLKPSSVNERQICMDGALDPSLPAGSQTSGKTIWLRNQLLEMLLSVISSPQLHLSSESKEEMFLKLGPDWFLLLLQGHLHASTTVLALKLLLYFLASPSLRTRFRDGLCAGSWVERSTEGVDIVMDNLKSQSPLPEQSPCLLPGFRVLNDFLAHHVHIPEVYLIVSTFFLQTPLTELMDGPKDSLDAMLQWLLQRHHQEEVLQAGLCTEGALLLLEMLKATMSQPLAGSEDGAWAQTFPASVLQFLSLVHRTYPQDPAWRAPEFLQTLAIAAFPLGAQKGVGAESTRNTSSPEAAAEGDSTVEGLQAPTKAHPARRKLREFTQLLLRELLLGASSPKQWLPLEVLLEASPDHATSQQKRDFQSEVLLSAMELFHMTSGGDAAMFRDGKEPQPSAEAAAAPSLANISCFTQKLVEKLYSGMFSADPRHILLFILEHIMVISAPLQARDFS

SEQ ID NO: 97626 - protein, 205 aa, Homo sapiens
  Payload ID: 19468
  Gene Name: WDYHV motif containing 1
  Uniprot ID: Q96HA8
  ENSP ID: ENSP00000287387
MEGNGPAAVHYQPASPPRDACVYSSCYCEENIWKLCEYIKNHDQYPLEECYAVFISNERKMIPIWKQQARPGDGPVIWDYHVVLLHVSSGGQNFIYDLDTVLPFPCLFDTYVEDAFKSDDDIHPQFRRKFRVIRADSYLKNFASDRSHMKDSSGNWREPPPPYPCIETGDSKMNLNDFISMDPKVGWGAVYTLSEFTHRFGSKNC

SEQ ID NO: 97627 - protein, 196 aa, Homo sapiens
  Payload ID: 19468
  Gene Name: WDYHV motif containing 1
  ENSP ID: ENSP00000428615
MEGNGPAAVHYQPASPPRDACVYSSCYCEENIWKLCEYIKNHDQYPLEECYAVFISNERKMIPIWKQQARPGDGPVIWDYHVVLLHVSSGGQNFIYDLDTVLPFPCLFDTYVEDAFKSDDDIHPQFRRKFRVIRADSYLKNFASDRSHMKDSSGNWREPPPPYPCIETGGINPVDNFLTFKKIKGPSPYYYCLAFI

SEQ ID NO: 97628 - protein, 57 aa, Homo sapiens
  Payload ID: 19468
  Gene Name: WDYHV motif containing 1
  ENSP ID: ENSP00000429258
MKDSSGNWREPPPPYPCIETGDSKMNLNDFISMDPKVGWGAVYTLSEFTHRFGSKNC

SEQ ID NO: 97629 - protein, 63 aa, Homo sapiens
  Payload ID: 19468
  Gene Name: WDYHV motif containing 1
  ENSP ID: ENSP00000430390
  MOD_RES (1)..(1): Any amino acid
XSSRSSSGPGPGPASRPWKVMAPLLSTTSRPAPRGTPASTAAATVKKIFGSSVNTSKTMTSIL

SEQ ID NO: 97630 - protein, 145 aa, Homo sapiens
  Payload ID: 19468
  Gene Name: WDYHV motif containing 1
  Uniprot ID: Q96HA8
  ENSP ID: ENSP00000430427
MIPIWKQQARPGDGPVIWDYHVVLLHVSSGGQNFIYDLDTVLPFPCLFDTYVEDAFKSDDDIHPQFRRKFRVIRADSYLKNFASDRSHMKDSSGNWREPPPPYPCIETGDSKMNLNDFISMDPKVGWGAVYTLSEFTHRFGSKNC

SEQ ID NO: 97631 - protein, 87 aa, Homo sapiens
  Payload ID: 19468
  Gene Name: WDYHV motif containing 1
  ENSP ID: ENSP00000434252
MEGNGPAAVHYQPASPPRDACVYSSCYCEENIWKLCEYIKNHDQYPLEECYAVFISNERKMIPIWKQQARPGDGPVIWVRQLIQRVL

SEQ ID NO: 97632 - protein, 432 aa, Homo sapiens
  Payload ID: 19469
  Gene Name: WEE1 G2 checkpoint kinase
  Uniprot ID: P30291
  ENSP ID: ENSP00000299613
MDTEKSGKREFDVRQTPQVNINPFTPDSLLLHSSGQCRRRKRTYWNDSCGEDMEASDYELEDETRPAKRITITESNMKSRYTTEFHELEKIGSGEFGSVFKCVKRLDGCIYAIKRSKKPLAGSVDEQNALREVYAHAVLGQHSHVVRYFSAWAEDDHMLIQNEYCNGGSLADAISENYRIMSYFKEAELKDLLLQVGRGLRYIHSMSLVHMDIKPSNIFISRTSIPNAASEEGDEDDWASNKVMFKIGDLGHVTRISSPQVEEGDSRFLANEVLQENYTHLPKADIFALALTVVCAAGAEPLPRNGDQWHEIRQGRLPRIPQVLSQEFTELLKVMIHPDPERRPSAMALVKHSVLLSASRKSAEQLRIELNAEKFKNSLLQKELKKAQMAKAAAEERALFTDRMATRSTTQSNRTSRLIGKKMNRSVSLTIY

SEQ ID NO: 97633 - protein, 646 aa, Homo sapiens
  Payload ID: 19469
  Gene Name: WEE1 G2 checkpoint kinase
  Uniprot ID: P30291
  ENSP ID: ENSP00000402084
MSFLSRQQPPPPRRAGAACTLRQKLIFSPCSDCEEEEEEEEEEGSGHSTGEDSAFQEPDSPLPPARSPTEPGPERRRSPGPAPGSPGELEEDLLLPGACPGADEAGGGAEGDSWEEEGFGSSSPVKSPAAPYFLGSSFSPVRCGGPGDASPRGCGARRAGEGRRSPRPDHPGTPPHKTFRKLRLFDTPHTPKSLLSKARGIDSSSVKLRGSSLFMDTEKSGKREFDVRQTPQVNINPFTPDSLLLHSSGQCRRRKRTYWNDSCGEDMEASDYELEDETRPAKRITITESNMKSRYTTEFHELEKIGSGEFGSVFKCVKRLDGCIYAIKRSKKPLAGSVDEQNALREVYAHAVLGQHSHVVRYFSAWAEDDHMLIQNEYCNGGSLADAISENYRIMSYFKEAELKDLLLQVGRGLRYIHSMSLVHMDIKPSNIFISRTSIPNAASEEGDEDDWASNKVMFKIGDLGHVTRISSPQVEEGDSRFLANEVLQENYTHLPKADIFALALTVVCAAGAEPLPRNGDQWHEIRQGRLPRIPQVLSQEFTELLKVMIHPDPERRPSAMALVKHSVLLSASRKSAEQLRIELNAEKFKNSLLQKELKKAQMAKAAAEERALFTDRMATRSTTQSNRTSRLIGKKMNRSVSLTIY

SEQ ID NO: 97634 - protein, 99 aa, Homo sapiens
  Payload ID: 19469
  Gene Name: WEE1 G2 checkpoint kinase
  ENSP ID: ENSP00000432284
MIHPDPERRPSAMALVKHSVLLSASRKSAEQLRIELNAEKFKNSLLQKELKKAQMAKAAAEERALFTDRMATRSTTQNDPNFQCKFKGLWSKEKYLCMP

SEQ ID NO: 97635 - protein, 214 aa, Homo sapiens
  Payload ID: 19469
  Gene Name: WEE1 G2 checkpoint kinase
  ENSP ID: ENSP00000434148
MSYFKEAELKDLLLQVGRGLRYIHSMSLVHMDIKPSNIFISRTSIPNAASEEGDEDDWASNKVMFKIGDLGHVTRISSPQVEEGDSRFLANEVLQENYTHLPKADIFALALTVVCAAGAEPLPRNGDQWHEIRQGRLPRIPQVLSQEFTELLKVMIHPDPERRPSAMALVKHSVLLSASRKSAEQLRIELNAEKFKNSLLQKELKKAQMAKAAA

SEQ ID NO: 97636 - protein, 162 aa, Homo sapiens
  Payload ID: 19469
  Gene Name: WEE1 G2 checkpoint kinase
  ENSP ID: ENSP00000434446
MSCIAFSFGGSLADAISENYRIMSYFKEAELKDLLLQVGRGLRYIHSMSLVHMDIKPSNIFISRTSIPNAASEEGDEDDWASNKVMFKIGDLGHVTRISSPQVEEGDSRFLANEVLQENYTHLPKADIFALALTVVCAAGAEPLPRNGDQWHEIRQGRLPRI

SEQ ID NO: 97637 - protein, 145 aa, Homo sapiens
  Payload ID: 19469
  Gene Name: WEE1 G2 checkpoint kinase
  ENSP ID: ENSP00000435945
  MOD_RES (1)..(1): Any amino acid
XDAISENYRIMSYFKEAELKDLLLQVGRGLRYIHSMSLVHMDIKPSNIFISRTSIPNAASEEGDEDDWASNKVMFKIGDLGHVTRISSPQVEEGDSRFLANEVLQEWYVLLVLNLFREMEINGMKSDRVDYLGYHKCFPKNLQSC

SEQ ID NO: 97638 - protein, 567 aa, Homo sapiens
  Payload ID: 19470
  Gene Name: WEE1 homolog 2 (S. pombe)
  Uniprot ID: P0C1S8
  ENSP ID: ENSP00000380675
MDDKDIDKELRQKLNFSYCEETEIEGQKKVEESREASSQTPEKGEVQDSEAKGTPPWTPLSNVHELDTSSEKDKESPDQILRTPVSHPLKCPETPAQPDSRSKLLPSDSPSTPKTMLSRLVISPTGKLPSRGPKHLKLTPAPLKDEMTSLALVNINPFTPESYKKLFLQSGGKRKIRGDLEEAGPEEGKGGLPAKRCVLRETNMASRYEKEFLEVEKIGVGEFGTVYKCIKRLDGCVYAIKRSMKTFTELSNENSALHEVYAHAVLGHHPHVVRYYSSWAEDDHMIIQNEYCNGGSLQAAISENTKSGNHFEEPKLKDILLQISLGLNYIHNSSMVHLDIKPSNIFICHKMQSESSGVIEEVENEADWFLSANVMYKIGDLGHATSINKPKVEEGDSRFLANEILQEDYRHLPKADIFALGLTIAVAAGAESLPTNGAAWHHIRKGNFPDVPQELSESFSSLLKNMIQPDAEQRPSAAALARNTVLRPSLGKTEELQQQLNLEKFKTATLERELREAQQAQSPQGYTHHGDTGVSGTHTGSRSTKRLVGGKSARSSSFTSGEREPLH

SEQ ID NO: 97639 - protein, 203 aa, Homo sapiens
  Payload ID: 19470
  Gene Name: WEE1 homolog 2 (S. pombe)
  ENSP ID: ENSP00000420388
VYKCIKRLDGCVYAIKRSMKTFTELSNENSALHEVYAHAVLGHHPHVVRYYSSWAEDDHMIIQNEYCNGGSLQAAISENTKSGNHFEEPKLKDILLQISLGLNYIHNSSMVHLDIKPSNIFICHKMQSESSGVIEEVENEADWFLSANVMYKIGDLGHATSINKPKVEEGDSRFLANEILQENMIQPDAEQRPSAAALARNTV

SEQ ID NO: 97640 - protein, 203 aa, Homo sapiens; identical to SEQ ID NO: 97639
  Payload ID: 19470
  Gene Name: WEE1 homolog 2 (S. pombe)
  ENSP ID: ENSP00000458529

SEQ ID NO: 97641 - protein, 567 aa, Homo sapiens; identical to SEQ ID NO: 97638
  Payload ID: 19470
  Gene Name: WEE1 homolog 2 (S. pombe)
  Uniprot ID: P0C1S8
  ENSP ID: ENSP00000459392

SEQ ID NO: 97642 - protein, 281 aa, Homo sapiens
  Payload ID: 19471
  Gene Name: Werner helicase interacting protein 1
  Uniprot ID: Q96S55
  ENSP ID: ENSP00000370141
MVTILMRAINSLGIHVLDSSRPTDPLSHSSNSSSEPAMFIEDKAVDTLAYLSDGDARAGLNGLQLAVLARLSSRKMFCKKSGQSYSPSRVLITENDVKEGLQRSHILYDRAGEEHYNCISALHKSMRGSDQNASLYWLARMLEGGEDPLYVARRLVRFASEDIGLADPSALTQAVAAYQGCHFIGMPECEVLLAQCVVYFARAPKSIEVYSAYNNVKACLRNHQGPLPPVPLHLRNAPTRLMKDLGYGKGYKYNPMYSEPVDQEYLPEELRGVDFFKQRRC

SEQ ID NO: 97643 - protein, 445 aa, Homo sapiens
  Payload ID: 19471
  Gene Name: Werner helicase interacting protein 1
  Uniprot ID: Q96S55
  ENSP ID: ENSP00000370146
MLQGKPLADTMRPDTLQDYFGQSKAVGQDTLLRSLLETNEIPSLILWGPPGCGKTTLAHIIASNSKKHSIRFVTLSATNAKTNDVRDVIKQAQNEKSFFKRKTILFIDEIHRFNKSQQDTFLPHVECGTITLIGATTENPSFQVNAALLSRCRVIVLEKLPVEAMVTILMRAINSLGIHVLDSSRPTDPLSHSSNSSSEPAMFIEDKAVDTLAYLSDGDARAGLNGLQLAVLARLSSRKMFCKKSGQSYSPSRVLITENDVKEGLQRSHILYDRAGEEHYNCISALHKSMRGSDQNASLYWLARMLEGGEDPLYVARRLVRFASEDIGLADPSALTQAVAAYQGCHFIGMPECEVLLAQCVVYFARAPKSIEVYSAYNNVKACLRNHQGPLPPVPLHLRNAPTRLMKDLGYGKGYKYNPMYSEPVDQEYLPEELRGVDFFKQRRC

SEQ ID NO: 97644 - protein, 640 aa, Homo sapiens
  Payload ID: 19471
  Gene Name: Werner helicase interacting protein 1
  Uniprot ID: Q96S55
  ENSP ID: ENSP00000370148
MEVSGPEDDPFLSQLHQVQCPVCQQMMPAAHINSHLDRCLLLHPAGHAEPAAGSHRAGERAKGPSPPGAKRRRLSESSALKQPATPTAAESSEGEGEEGDDGGETESRESYDAPPTPSGARLIPDFPVARSSSPGRKGSGKRPAAAAAAGSASPRSWDEAEAQEEEEAVGDGDGDGDADADGEDDPGHWDADAAEAATAFGASGGGRPHPRALAAEEIRQMLQGKPLADTMRPDTLQDYFGQSKAVGQDTLLRSLLETNEIPSLILWGPPGCGKTTLAHIIASNSKKHSIRFVTLSATNAKTNDVRDVIKQAQNEKSFFKRKTILFIDEIHRFNKSQQVNAALLSRCRVIVLEKLPVEAMVTILMRAINSLGIHVLDSSRPTDPLSHSSNSSSEPAMFIEDKAVDTLAYLSDGDARAGLNGLQLAVLARLSSRKMFCKKSGQSYSPSRVLITENDVKEGLQRSHILYDRAGEEHYNCISALHKSMRGSDQNASLYWLARMLEGGEDPLYVARRLVRFASEDIGLADPSALTQAVAAYQGCHFIGMPECEVLLAQCVVYFARAPKSIEVYSAYNNVKACLRNHQGPLPPVPLHLRNAPTRLMKDLGYGKGYKYNPMYSEPVDQEYLPEELRGVDFFKQRRC

SEQ ID NO: 97645 - protein, 665 aa, Homo sapiens
  Payload ID: 19471
  Gene Name: Werner helicase interacting protein 1
  Uniprot ID: Q96S55
  ENSP ID: ENSP00000370150
MEVSGPEDDPFLSQLHQVQCPVCQQMMPAAHINSHLDRCLLLHPAGHAEPAAGSHRAGERAKGPSPPGAKRRRLSESSALKQPATPTAAESSEGEGEEGDDGGETESRESYDAPPTPSGARLIPDFPVARSSSPGRKGSGKRPAAAAAAGSASPRSWDEAEAQEEEEAVGDGDGDGDADADGEDDPGHWDADAAEAATAFGASGGGRPHPRALAAEEIRQMLQGKPLADTMRPDTLQDYFGQSKAVGQDTLLRSLLETNEIPSLILWGPPGCGKTTLAHIIASNSKKHSIRFVTLSATNAKTNDVRDVIKQAQNEKSFFKRKTILFIDEIHRFNKSQQDTFLPHVECGTITLIGATTENPSFQVNAALLSRCRVIVLEKLPVEAMVTILMRAINSLGIHVLDSSRPTDPLSHSSNSSSEPAMFIEDKAVDTLAYLSDGDARAGLNGLQLAVLARLSSRKMFCKKSGQSYSPSRVLITENDVKEGLQRSHILYDRAGEEHYNCISALHKSMRGSDQNASLYWLARMLEGGEDPLYVARRLVRFASEDIGLADPSALTQAVAAYQGCHFIGMPECEVLLAQCVVYFARAPKSIEVYSAYNNVKACLRNHQGPLPPVPLHLRNAPTRLMKDLGYGKGYKYNPMYSEPVDQEYLPEELRGVDFFKQRRC

SEQ ID NO: 97646 - protein, 665 aa, Homo sapiens; identical to SEQ ID NO: 97645
  Payload ID: 19471
  Gene Name: Werner helicase interacting protein 1
  Uniprot ID: Q96S55
  ENSP ID: ENSP00000477551

SEQ ID NO: 97647 - protein, 1432 aa, Homo sapiens
  Payload ID: 19472
  Gene Name: Werner syndrome, RecQ helicase-like
  Uniprot ID: Q14191
  ENSP ID: ENSP00000298139
MSEKKLETTAQQRKCPEWMNVQNKRCAVEERKACVRKSVFEDDLPFLEFTGSIVYSYDASDCSFLSEDISMSLSDGDVVGFDMEWPPLYNRGKLGKVALIQLCVSESKCYLFHVSSMSVFPQGLKMLLENKAVKKAGVGIEGDQWKLLRDFDIKLKNFVELTDVANKKLKCTETWSLNSLVKHLLGKQLLKDKSIRCSNWSKFPLTEDQKLYAATDAYAGFIIYRNLEILDDTVQRFAINKEEEILLSDMNKQLTSISEEVMDLAKHLPHAFSKLENPRRVSILLKDISENLYSLRRMIIGSTNIETELRPSNNLNLLSFEDSTTGGVQQKQIREHEVLIHVEDETWDPTLDHLAKHDGEDVLGNKVERKEDGFEDGVEDNKLKENMERACLMSLDITEHELQILEQQSQEEYLSDIAYKSTEHLSPNDNENDTSYVIESDEDLEMEMLKHLSPNDNENDTSYVIESDEDLEMEMLKSLENLNSGTVEPTHSKCLKMERNLGLPTKEEEEDDENEANEGEEDDDKDFLWPAPNEEQVTCLKMYFGHSSFKPVQWKVIHSVLEERRDNVAVMATGYGKSLCFQYPPVYVGKIGLVISPLISLMEDQVLQLKMSNIPACFLGSAQSENVLTDIKLGKYRIVYVTPEYCSGNMGLLQQLEADIGITLIAVDEAHCISEWGHDFRDSFRKLGSLKTALPMVPIVALTATASSSIREDIVRCLNLRNPQITCTGFDRPNLYLEVRRKTGNILQDLQPFLVKTSSHWEFEGPTIIYCPSRKMTQQVTGELRKLNLSCGTYHAGMSFSTRKDIHHRFVRDEIQCVIATIAFGMGINKADIRQVIHYGAPKDMESYYQEIGRAGRDGLQSSCHVLWAPADINLNRHLLTEIRNEKFRLYKLKMMAKMEKYLHSSRCRRQIILSHFEDKQVQKASLGIMGTEKCCDNCRSRLDHCYSMDDSEDTSWDFGPQAFKLLSAVDILGEKFGIGLPILFLRGSNSQRLADQYRRHSLFGTGKDQTESWWKAFSRQLITEGFLVEVSRYNKFMKICALTKKGRNWLHKANTESQSLILQANEELCPKKLLLPSSKTVSSGTKEHCYNQVPVELSTEKKSNLEKLYSYKPCDKISSGSNISKKSIMVQSPEKAYSSSQPVISAQEQETQIVLYGKLVEARQKHANKMDVPPAILATNKILVDMAKMRPTTVENVKRIDGVSEGKAAMLAPLLEVIKHFCQTNSVQTDLFSSTKPQEEQKTSLVAKNKICTLSQSMAITYSLFQEKKMPLKSIAESRILPLMTIGMHLSQAVKAGCPLDLERAGLTPEVQKIIADVIRNPPVNSDMSKISLIRMLVPENIDTYLIHMAIEILKHGPDSGLQPSCDVNKRRCFPGSEEICSSSKRSKEEVGINTETSSAERKRRLPVWFAKGSDTSKKLMDKTKRGGLFS

SEQ ID NO: 97648 - protein, 794 aa, Homo sapiens
  Payload ID: 19473
  Gene Name: widely interspaced zinc finger motifs
  Uniprot ID: O95785
  ENSP ID: ENSP00000263381
MEGSLAGSLAAPDRPQGPERLPGPAPRENIEGGAEAAEGEGGIFRSTRYLPVTKEGPRDILDGRGGISVANFDPGTFSLMRCDFCGAGFDTRAGLSSHARAHLRDFGITNWELTVSPINILQELLATSAAEQPPSPLGREPGGPPGSFLTSRRPRLPLTVPFPPTWAEDPGPAYGDASGPEPARDIRCEFCGEFFENRKGLSSHARSHLRQMGVTEWYVNGSPIDTLREILKRRTQSRPGGPPNPPGPSPKALAKMMGGAGPGSSLEARSPSDLHISPLAKKLPPPPGSPLGHSPTASPPPTARKMFPGLAAPSLPKKLKPEQIRVEIKREMLPGALHGELHPSEGPWGAPREDMTPLNLSSRAEPVRDIRCEFCGEFFENRKGLSSHARSHLRQMGVTEWSVNGSPIDTLREILKKKSKPCLIKKEPPAGDLAPALAEDGPPTVAPGPVQSPLPLSPLAGRPGKPGAGPAQVPRELSLTPITGAKPSATGYLGSVAAKRPLQEDRLLPAEVKAKTYIQTELPFKAKTLHEKTSHSSTEACCELCGLYFENRKALASHARAHLRQFGVTEWCVNGSPIETLSEWIKHRPQKVGAYRSYIQGGRPFTKKFRSAGHGRDSDKRPSLGLAPGGLAVVGRSAGGEPGPEAGRAADGGERPLAASPPGTVKAEEHQRQNINKFERRQARPPDASAARGGEDTNDLQQKLEEVRQPPPRVRPVPSLVPRPPQTSLVKFVGNIYTLKCRFCEVEFQGPLSIQEEWVRHLQRHILEMNFSKADPPPEESQAPQAQTAAAEAP

SEQ ID NO: 97649 - protein, 832 aa, Homo sapiens
  Payload ID: 19473
  Gene Name: widely interspaced zinc finger motifs
  ENSP ID: ENSP00000373933
MDLGSPSLPKKSLPVPGALEQVASRLSSKVAAEVPHGSKQELQDLKAQSLTTCEVCGACFETRKGLSSHARSHLRQLGVAESESSGAPIDLLYELVKQKGLPDAHLGLPPGLAKKSSSLKEVVAGAPRPGLLSLAKPLDAPAVNKAIKSPPGFSAKGLGHPPSSPLLKKTPLALAGSPTPKNPEDKSPQLSLSPRPASPKAQWPQSEDEGPLNLTSGPEPARDIRCEFCGEFFENRKGLSSHARSHLRQMGVTEWYVNGSPIDTLREILKRRTQSRPGGPPNPPGPSPKALAKMMGGAGPGSSLEARSPSDLHISPLAKKLPPPPGSPLGHSPTASPPPTARKMFPGLAAPSLPKKLKPEQIRVEIKREMLPGALHGELHPSEGPWGAPREDMTPLNLSSRAEPVRDIRCEFCGEFFENRKGLSSHARSHLRQMGVTEWSVNGSPIDTLREILKKKSKPCLIKKEPPAGDLAPALAEDGPPTVAPGPVQSPLPLSPLAGRPGKPGAGPAQVPRELSLTPITGAKPSATGYLGSVAAKRPLQEDRLLPAEVKAKTYIQTELPFKAKTLHEKTSHSSTEACCELCGLYFENRKALASHARAHLRQFGVTEWCVNGSPIETLSEWIKHRPQKVGAYRSYIQGGRPFTKKFRSAGHGRDSDKRPSLGLAPGGLAVVGRSAGGEPGPEAGRAADGGERPLAASPPGTVKAEEHQRQNINKFERRQARPPDASAARGGEDTNDLQQKLEEVRQPPPRVRPVPSLVPRPPQTSLVKFVGNIYTLKCRFCEVEFQGPLSIQEEWVRHLQRHILEMNFSKADPPPEESQAPQAQTAAAEAP

SEQ ID NO: 97650 - protein, 965 aa, Homo sapiens
  Payload ID: 19473
  Gene Name: widely interspaced zinc finger motifs
  Uniprot ID: O95785
  ENSP ID: ENSP00000445824
MDLGSPSLPKKSLPVPGALEQVASRLSSKVAAEVPHGSKQELQDLKAQSLTTCEVCGACFETRKGLSSHARSHLRQLGVAESESSGAPIDLLYELVKQKGLPDAHLGLPPGLAKKSSSLKEVVAGAPRPGLLSLAKPLDAPAVNKAIKSPPGFSAKGLGHPPSSPLLKKTPLALAGSPTPKNPEDKSPQLSLSPRPASPKAQWPQSEDEGPLNLTLDSDGGRELDCQLCGAWFETRKGLSSHARAHLRHLGVSDPDAKGSPIDVLHGLIRRDGVQIRLPPRRGALAHPGRPPPTSAALSLLPPPPPAKKAKLKAAGMASPWGKQDLSAAAAAGIFWASDVEPSPLNLSSGPEPARDIRCEFCGEFFENRKGLSSHARSHLRQMGVTEWYVNGSPIDTLREILKRRTQSRPGGPPNPPGPSPKALAKMMGGAGPGSSLEARSPSDLHISPLAKKLPPPPGSPLGHSPTASPPPTARKMFPGLAAPSLPKKLKPEQIRVEIKREMLPGALHGELHPSEGPWGAPREDMTPLNLSSRAEPVRDIRCEFCGEFFENRKGLSSHARSHLRQMGVTEWSVNGSPIDTLREILKKKSKPCLIKKEPPAGDLAPALAEDGPPTVAPGPVQSPLPLSPLAGRPGKPGAGPAQVPRELSLTPITGAKPSATGYLGSVAAKRPLQEDRLLPAEVKAKTYIQTELPFKAKTLHEKTSHSSTEACCELCGLYFENRKALASHARAHLRQFGVTEWCVNGSPIETLSEWIKHRPQKVGAYRSYIQGGRPFTKKFRSAGHGRDSDKRPSLGLAPGGLAVVGRSAGGEPGPEAGRAADGGERPLAASPPGTVKAEEHQRQNINKFERRQARPPDASAARGGEDTNDLQQKLEEVRQPPPRVRPVPSLVPRPPQTSLVKFVGNIYTLKCRFCEVEFQGPLSIQEEWVRHLQRHILEMNFSKADPPPEESQAPQAQTAAAEAP

SEQ ID NO: 97651 - protein, 968 aa, Homo sapiens
  Payload ID: 19473
  Gene Name: widely interspaced zinc finger motifs
  ENSP ID: ENSP00000469022
MVAMDLGSPSLPKKSLPVPGALEQVASRLSSKVAAEVPHGSKQELQDLKAQSLTTCEVCGACFETRKGLSSHARSHLRQLGVAESESSGAPIDLLYELVKQKGLPDAHLGLPPGLAKKSSSLKEVVAGAPRPGLLSLAKPLDAPAVNKAIKSPPGFSAKGLGHPPSSPLLKKTPLALAGSPTPKNPEDKSPQLSLSPRPASPKAQWPQSEDEGPLNLTLDSDGGRELDCQLCGAWFETRKGLSSHARAHLRHLGVSDPDAKGSPIDVLHGLIRRDGVQIRLPPRRGALAHPGRPPPTSAALSLLPPPPPAKKAKLKAAGMASPWGKQDLSAAAAAGIFWASDVEPSPLNLSSGPEPARDIRCEFCGEFFENRKGLSSHARSHLRQMGVTEWYVNGSPIDTLREILKRRTQSRPGGPPNPPGPSPKALAKMMGGAGPGSSLEARSPSDLHISPLAKKLPPPPGSPLGHSPTASPPPTARKMFPGLAAPSLPKKLKPEQIRVEIKREMLPGALHGELHPSEGPWGAPREDMTPLNLSSRAEPVRDIRCEFCGEFFENRKGLSSHARSHLRQMGVTEWSVNGSPIDTLREILKKKSKPCLIKKEPPAGDLAPALAEDGPPTVAPGPVQSPLPLSPLAGRPGKPGAGPAQVPRELSLTPITGAKPSATGYLGSVAAKRPLQEDRLLPAEVKAKTYIQTELPFKAKTLHEKTSHSSTEACCELCGLYFENRKALASHARAHLRQFGVTEWCVNGSPIETLSEWIKHRPQKVGAYRSYIQGGRPFTKKFRSAGHGRDSDKRPSLGLAPGGLAVVGRSAGGEPGPEAGRAADGGERPLAASPPGTVKAEEHQRQNINKFERRQARPPDASAARGGEDTNDLQQKLEEVRQPPPRVRPVPSLVPRPPQTSLVKFVGNIYTLKCRFCEVEFQGPLSIQEEWVRHLQRHILEMNFSKADPPPEESQAPQAQTAAAEAP

SEQ ID NO: 97652 - protein, 133 aa, Homo sapiens
  Payload ID: 19473
  Gene Name: widely interspaced zinc finger motifs
  ENSP ID: ENSP00000469138
MEGSLAGSLAAPDRPQGPERLPGPAPRENIEGGAEAAEGEGGIFRSTRYLPVTKEGPRDILDGRGGISVANFDPGTFSLMRCDFCGAGFDTRAGLSSHARAHLRDFGITNWELTVSPINILQELLATSAAEQP

SEQ ID NO: 97653 - protein, 835 aa, Homo sapiens
  Payload ID: 19473
  Gene Name: widely interspaced zinc finger motifs
  Uniprot ID: O95785
  ENSP ID: ENSP00000469534
MVAMDLGSPSLPKKSLPVPGALEQVASRLSSKVAAEVPHGSKQELQDLKAQSLTTCEVCGACFETRKGLSSHARSHLRQLGVAESESSGAPIDLLYELVKQKGLPDAHLGLPPGLAKKSSSLKEVVAGAPRPGLLSLAKPLDAPAVNKAIKSPPGFSAKGLGHPPSSPLLKKTPLALAGSPTPKNPEDKSPQLSLSPRPASPKAQWPQSEDEGPLNLTSGPEPARDIRCEFCGEFFENRKGLSSHARSHLRQMGVTEWYVNGSPIDTLREILKRRTQSRPGGPPNPPGPSPKALAKMMGGAGPGSSLEARSPSDLHISPLAKKLPPPPGSPLGHSPTASPPPTARKMFPGLAAPSLPKKLKPEQIRVEIKREMLPGALHGELHPSEGPWGAPREDMTPLNLSSRAEPVRDIRCEFCGEFFENRKGLSSHARSHLRQMGVTEWSVNGSPIDTLREILKKKSKPCLIKKEPPAGDLAPALAEDGPPTVAPGPVQSPLPLSPLAGRPGKPGAGPAQVPRELSLTPITGAKPSATGYLGSVAAKRPLQEDRLLPAEVKAKTYIQTELPFKAKTLHEKTSHSSTEACCELCGLYFENRKALASHARAHLRQFGVTEWCVNGSPIETLSEWIKHRPQKVGAYRSYIQGGRPFTKKFRSAGHGRDSDKRPSLGLAPGGLAVVGRSAGGEPGPEAGRAADGGERPLAASPPGTVKAEEHQRQNINKFERRQARPPDASAARGGEDTNDLQQKLEEVRQPPPRVRPVPSLVPRPPQTSLVKFVGNIYTLKCRFCEVEFQGPLSIQEEWVRHLQRHILEMNFSKADPPPEESQAPQAQTAAAEAP

SEQ ID NO: 97654 - protein, 281 aa, Homo sapiens
  Payload ID: 19474
  Gene Name: Williams Beuren syndrome chromosome region 22
  Uniprot ID: O43709
  ENSP ID: ENSP00000265758
MASRGRRPEHGGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKFYLCLFSGPSTFIPEGLSENQDEVEPRESVFTNERFPLRMSRRGMVRKSRAWVLEKKERHRRQGREVRPDTQYTGRKRKPRF

SEQ ID NO: 97655 - protein, 140 aa, Homo sapiens
  Payload ID: 19474
  Gene Name: Williams Beuren syndrome chromosome region 22
  ENSP ID: ENSP00000390048
MASRGRRPEHGGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKPGTFDGCIRSGDPELSCSCTLRTQSSWS

SEQ ID NO: 97656 - protein, 140 aa, Homo sapiens
  Payload ID: 19474
  Gene Name: Williams Beuren syndrome chromosome region 22
  ENSP ID: ENSP00000390136
MASRGRRPEHGGPPELFYDETEARKYVRNSRMIDIQTRMAGRALELLYLPENKPCYLLDIGCGTGLSGSYLSDEGHYWVGLDISPAMLAFLLCSGSVMLTRSLKTLPSACTAFLLLFFLFSSGDPELSCSCTLRTQSSWS

SEQ ID NO: 97657 - protein, 123 aa, Homo sapiens
  Payload ID: 19474
  Gene Name: Williams Beuren syndrome chromosome region 22
  ENSP ID: ENSP00000391410
MADPQSCFMTRQKPGNTFASEGSLNTAGRPGVGKRQVAPVAGVARKGRRIWGSRMIDIQTRMAGRALELLYLPENKPCYLLDIGCGTGLSGSYLSDEGHYWVGLDISPAMLGPGIPSCPAAVP

SEQ ID NO: 97658 - protein, 89 aa, Homo sapiens
  Payload ID: 19474
  Gene Name: Williams Beuren syndrome chromosome region 22
  ENSP ID: ENSP00000391761
MIDIQTRMAGRALELLYLPENKPCYLLDIGCGTGLSGSYLSDEGHYWVGLDISPAMLDEAVDREIEGDLLLGDMGQGIPFKPGTFDGCI

SEQ ID NO: 97659 - protein, 193 aa, Homo sapiens
  Payload ID: 19474
  Gene Name: Williams Beuren syndrome chromosome region 22
  ENSP ID: ENSP00000392039
MADPQSCFMTRQKPGNTFASEGSLNTAGRPGVGKRQVAPVAGVARKGRRIWGSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQ

SEQ ID NO: 97660 - protein, 65 aa, Homo sapiens
  Payload ID: 19474
  Gene Name: Williams Beuren syndrome chromosome region 22
  ENSP ID: ENSP00000394852
  MOD_RES (1)..(1): Any amino acid
XSGDPELSCSCTLRTQSRFPLRMSRRGMVRKSRAWVLEKKERHRRQGREVRPDTQYTGRKRKPRF

SEQ ID NO: 97661 - protein, 67 aa, Homo sapiens
  Payload ID: 19474
  Gene Name: Williams Beuren syndrome chromosome region 22
  ENSP ID: ENSP00000398314
MADPQSCFMTRQKPGNTFASEGSLNTAGRPGVGKRQVAPVAGVARKGRRIWGCGKGRTRVGADFCLW

SEQ ID NO: 97662 - protein, 128 aa, Homo sapiens
  Payload ID: 19474
  Gene Name: Williams Beuren syndrome chromosome region 22
  ENSP ID: ENSP00000398732
  MOD_RES (1)..(1): Any amino acid
XISAVQWLCNANKKSENPAKRLYCFFASLFSVLVRGSRAVLQLYPENSEQLELITTQATKAGFSGGMVVDYPNSAKAKKFYLCLFSGPSTFIPEVPIKDVEAGNGEEESGMGAGEEGAAQAPGQGSQT

SEQ ID NO: 97663 - protein, 298 aa, Homo sapiens
  Payload ID: 19474
  Gene Name: Williams Beuren syndrome chromosome region 22
  Uniprot ID: O43709
  ENSP ID: ENSP00000401191
MASRGRRPEHGGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKFYLCLFSGPSTFIPEGLSENQDEVEPRESVFTNEREGGAFERRGIRGHQTRRFPLRMSRRGMVRKSRAWVLEKKERHRRQGREVRPDTQYTGRKRKPRF

SEQ ID NO: 97664 - protein, 100 aa, Homo sapiens
  Payload ID: 19474
  Gene Name: Williams Beuren syndrome chromosome region 22
  ENSP ID: ENSP00000404981
MASRGRRPEHGGPPELFYDETEARKYVRNSRMIDIQTRMAGRALELLYLPENKPCYLLDIGCGTGLSGSYLSDEGHYWVGLDISPAMLGPGIPSCPAAVP

SEQ ID NO: 97665 - protein, 39 aa, Homo sapiens
  Payload ID: 19474
  Gene Name: Williams Beuren syndrome chromosome region 22
  ENSP ID: ENSP00000415387
  MOD_RES (1)..(1): Any amino acid
XGTGLSGSYLSDEGHYWVGLDISPAMLGPGIPSCPAAVP

SEQ ID NO: 97666 - protein, 245 aa, Homo sapiens
  Payload ID: 19475
  Gene Name: Williams Beuren syndrome chromosome region 27
  Uniprot ID: Q8N6F8
  ENSP ID: ENSP00000297873
MAQEEGGSLPEVRARVRAAHGIPDLAQKLHFYDRWAPDYDQDVATLLYRAPRLAVDCLTQALPGPPHSALILDVACGTGLVAAELRAPGFLQLHGVDGSPGMLEQAQAPGLYQRLSLCTLGQEPLPSPEGTFDAVLIVGALSDGQVPCNAIPELHVTKPGGLVCLTTRTNSSNLQYKEALEATLDRLEQAGMWEGLVAWPVDRLWTAGSWLPPSWRWYPASLPRMASSPALSTCTESGRRPRLRK

SEQ ID NO: 97667 - protein, 90 aa, Homo sapiens
  Payload ID: 19475
  Gene Name: Williams Beuren syndrome chromosome region 27
  ENSP ID: ENSP00000398533
MAQEEGGSLPEVRARVRAAHGIPDLAQKLHFYDRWAPDYDQDVATLLYRAPRLAVDCLTQALPGPPHSALILDVACGTGLVAAEGPSTRC

SEQ ID NO: 97668 - protein, 153 aa, Homo sapiens
  Payload ID: 19476
  Gene Name: Williams-Beuren syndrome chromosome region 16
  ENSP ID: ENSP00000477558
MRRQQGIVHSSSLSLEDGLGRRGSRPERRRLQQGQISSAACGYGFTLLSSKTADVTKVWGMGLNKDSQLGFHRSRKDKTRGYEYVLEPSPVSLPLDRPQETRVLQVSCGRAHSLVLTDREGVFSMGNNSYGQCGRKVVENEIYSESHRVHRMQ

SEQ ID NO: 97669 - protein, 454 aa, Homo sapiens
  Payload ID: 19476
  Gene Name: Williams-Beuren syndrome chromosome region 16
  Uniprot ID: Q96I51
  ENSP ID: ENSP00000477659
MALVALVAGARLGRRLSGPGLGRGHWTAAGRSRSRREAAEAEAEVPVVQYVGERAARADRVFVWGFSFSGALGVPSFVVPSSGPGPRAGARPRRRIQPVPYRLELDQKISSAACGYGFTLLSSKTADVTKVWGMGLNKDSQLGFHRSRKDKTRGYEYVLEPSPVSLPLDRPQETRVLQVSCGRAHSLVLTDREGVFSMGNNSYGQCGRKVVENEIYSESHRVHRMQDFDGQVVQVACGQDHSLFLTDKGEVYSCGWGADGQTGLGHYNITSSPTKLGGDLAGVNVIQVATYGDCCLAVSADGGLFGWGNSEYLQLASVTDSTQVNVPRCLHFSGVGKVRQAACGGTGCAVLNGEGHVFVWGYGILGKGPNLVESAVPEMIPPTLFGLTEFNPEIQVSRIRCGLSHFAALTNKGELFVWGKNIRGCLGIGRLEDQYFPWRAPAPSASAKTTGPLL

SEQ ID NO: 97670 - protein, 464 aa, Homo sapiens
  Payload ID: 19476
  Gene Name: Williams-Beuren syndrome chromosome region 16
  Uniprot ID: Q96I51
  ENSP ID: ENSP00000480364
MALVALVAGARLGRRLSGPGLGRGHWTAAGRSRSRREAAEAEAEVPVVQYVGERAARADRVFVWGFSFSGALGVPSFVVPSSGPGPRAGARPRRRIQPVPYRLELDQKISSAACGYGFTLLSSKTADVTKVWGMGLNKDSQLGFHRSRKDKTRGYEYVLEPSPVSLPLDRPQETRVLQVSCGRAHSLVLTDREGVFSMGNNSYGQCGRKVVENEIYSESHRVHRMQDFDGQVVQVACGQDHSLFLTDKGEVYSCGWGADGQTGLGHYNITSSPTKLGGDLAGVNVIQVATYGDCCLAVSADGGLFGWGNSEYLQLASVTDSTQVNVPRCLHFSGVGKVRQAACGGTGCAVLNGEGHVFVWGYGILGKGPNLVESAVPEMIPPTLFGLTEFNPEIQVSRIRCGLSHFAALTNKGELFVWGKNIRGCLGIGRLEDQYFPWRVTMPGEPVDVACGVDHMVTLAKSFI

SEQ ID NO: 97671 - protein, 358 aa, Homo sapiens
  Payload ID: 19476
  Gene Name: Williams-Beuren syndrome chromosome region 16
  Uniprot ID: Q96I51
  ENSP ID: ENSP00000480781
MALVALVAGARLGRRLSGPGLGRGHWTAAGRSRSRREAAEAEAEVPVVQYVGERAARADRVFVWGFSFSGALGVPSFVVPSSGPGPRAGARPRRRIQPVPYRLELDQKISSAACGYGFTLLSSKTADVTKVWGMGLNKDSQLGFHRSRKDKTRGYEYVLEPSPVSLPLDRPQETRVLQVSCGRAHSLVLTDREGVFSMGNNSYGQCGRKVVENEIYSESHRVHRMQDFDGQVVQVACGQDHSLFLTDKGEVYSCGWGADGQTGLGHYNITSSPTKLGGDLAGVNVIQVATYGDCCLAVSADGGLFGWGNSEYLQLASVTDSTQVNVPRCLHFSGVGKVRQAACGGTGCAVLNDTWPQS

SEQ ID NO: 97672 - protein, 598 aa, Homo sapiens
  Payload ID: 19477
  Gene Name: Williams-Beuren syndrome chromosome region 17
  Uniprot ID: Q6IS24
  ENSP ID: ENSP00000329654
MASLRRVKVLLVLNLIAVAGFVLFLAKCRPIAVRSGDAFHEIRPRAEVANLSAHSASPIQDAVLKRLSLLEDIVYRQLNGLSKSLGLIEGYGGRGKGGLPATLSPAEEEKAKGPHEKYGYNSYLSEKISLDRSIPDYRPTKCKELKYSKDLPQISIIFIFVNEALSVILRSVHSAVNHTPTHLLKEIILVDDNSDEEELKVPLEEYVHKRYPGLVKVVRNQKREGLIRARIEGWKVATGQVTGFFDAHVEFTAGWAEPVLSRIQENRKRVILPSIDNIKQDNFEVQRYENSAHGYSWELWCMYISPPKDWWDAGDPSLPIRTPAMIGCSFVVNRKFFGEIGLLDPGMDVYGGENIELGIKVWLCGGSMEVLPCSRVAHIERKKKPYNSNIGFYTKRNALRVAEVWMDDYKSHVYIAWNLPLENPGIDIGDVSERRALRKSLKCKNFQWYLDHVYPEMRRYNNTVAYGELRNNKAKDVCLDQGPLENHTAILYPCHGWGPQLARYTKEGFLHLGALGTTTLLPDTRCLVDNSKSRLPQLLDCDKVKSSLYKRWNFIQNGAIMNKGTGRCLEVENRGLAGIDLILRSCTGQRWTIKNSIK

SEQ ID NO: 97673 - protein, 188 aa, Homo sapiens
  Payload ID: 19477
  Gene Name: Williams-Beuren syndrome chromosome region 17
  ENSP ID: ENSP00000392019
LLDFKTKTTPPLGVLADTERGLSVFPPVSLSATAEMADLFRITDWGMFMSLDRITNGGLSKSLGLIEGYGGRGKGGLPATLSPAEEEKAKGPHEKYGYNSYLSEKISLDRSIPDYRPTKCKELKYSKDLPQISIIFIFVNEALSVILRSVHSAVNHTPTHLLKEIILVDDNSDEEELKVPLEEYVHKR

SEQ ID NO: 97674 - protein, 519 aa, Homo sapiens
  Payload ID: 19477
  Gene Name: Williams-Beuren syndrome chromosome region 17
  ENSP ID: ENSP00000479090
GLSKSLGLIEGYGGRGKGGLPATLSPAEEEKAKGPHEKYGYNSYLSEKISLDRSIPDYRPTKCKELKYSKDLPQISIIFIFVNEALSVILRSVHSAVNHTPTHLLKEIILVDDNSDEEELKVPLEEYVHKRYPGLVKVVRNQKREGLIRARIEGWKVATGQVTGFFDAHVEFTAGWAEPVLSRIQENRKRVILPSIDNIKQDNFEVQRYENSAHGYSWELWCMYISPPKDWWDAGDPSLPIRTPAMIGCSFVVNRKFFGEIGLLDPGMDVYGGENIELGIKVWLCGGSMEVLPCSRVAHIERKKKPYNSNIGFYTKRNALRVAEVWMDDYKSHVYIAWNLPLENPGIDIGDVSERRALRKSLKCKNFQWYLDHVYPEMRRYNNTVAYGELRNNKAKDVCLDQGPLENHTAILYPCHGWGPQLARYTKEGFLHLGALGTTTLLPDTRCLVDNSKSRLPQLLDCDKVKSSLYKRWNFIQNGAIMNKGTGRCLEVENRGLAGIDLILRSCTGQRWTIKNSIK

SEQ ID NO: 97675 - protein, 265 aa, Homo sapiens
  Payload ID: 19478
  Gene Name: Williams-Beuren syndrome chromosome region 28
  Uniprot ID: Q6UE05
  ENSP ID: ENSP00000316775
MEALPPVRSSLLGILLQVTRLSVLLVQNRDHLYNFLLLKINLFNHWVSGLAQEARGSCNWQAHLPLGAAACPLGQALWAGLALIQVPVWLVLQGPRLMWAGMWGSTKGLGLALLSAWEQLGLSVAIWTDLFLSCLHGLMLVALLLVVVTWRVCQKSHCFRLGRQLSKALQVNCVVRKLLVQLRRLYWWVETMTALTSWHLAYLITWTTCLASHLLQAAFEHTTQLAEAQEVEPQEVSGSSLLPSLSASSDSESGTVLPEQETPRE

SEQ ID NO: 97676 - protein, 60 aa, Homo sapiens
  Payload ID: 19478
  Gene Name: Williams-Beuren syndrome chromosome region 28
  Uniprot ID: Q6UE05
  ENSP ID: ENSP00000403621
MEALPPVRSSLLGILLQVTRLSVLRQGLALSPSLERSGAGSARCSLQLPVSSNPPPSASK

SEQ ID NO: 97677 - protein, 517 aa, Homo sapiens
  Payload ID: 19479
  Gene Name: Wilms tumor 1
  ENSP ID: ENSP00000331327
LQDPASTCVPEPASQHTLRSGPGCLQQPEQQGVRDPGGIWAKLGAAEASAERLQGRRSRGASGSEPQQMGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGVAAGSSSSVKWTEGQSNHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGKTSEKPFSCRWPSCQKKFARSDELVRHHNMHQRNMTKLQLAL

SEQ ID NO: 97678 - protein, 317 aa, Homo sapiens
  Payload ID: 19479
  Gene Name: Wilms tumor 1
  ENSP ID: ENSP00000368368
LQDPASTCVPEPASQHTLRSGPGCLQQPEQQGVRDPGGIWAKLGAAEASAERLQGRRSRGASGSEPQQMGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKG

SEQ ID NO: 97679 - protein, 302 aa, Homo sapiens
  Payload ID: 19479
  Gene Name: Wilms tumor 1
  Uniprot ID: P19544
  ENSP ID: ENSP00000368370
MEKGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGVAAGSSSSVKWTEGQSNHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGEKPFSCRWPSCQKKFARSDELVRHHNMHQRNMTKLQLAL

SEQ ID NO: 97680 - protein, 514 aa, Homo sapiens
  Payload ID: 19479
  Gene Name: Wilms tumor 1
  ENSP ID: ENSP00000413452
LQDPASTCVPEPASQHTLRSGPGCLQQPEQQGVRDPGGIWAKLGAAEASAERLQGRRSRGASGSEPQQMGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGVAAGSSSSVKWTEGQSNHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGEKPFSCRWPSCQKKFARSDELVRHHNMHQRNMTKLQLAL

SEQ ID NO: 97681 - protein, 497 aa, Homo sapiens
  Payload ID: 19479
  Gene Name: Wilms tumor 1
  ENSP ID: ENSP00000415516
LQDPASTCVPEPASQHTLRSGPGCLQQPEQQGVRDPGGIWAKLGAAEASAERLQGRRSRGASGSEPQQMGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGEKPFSCRWPSCQKKFARSDELVRHHNMHQRNMTKLQLAL

SEQ ID NO: 97682 - protein, 288 aa, Homo sapiens
  Payload ID: 19479
  Gene Name: Wilms tumor 1
  Uniprot ID: P19544
  ENSP ID: ENSP00000435307
MEKGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGKTSEKPFSCRWPSCQKKFARSDELVRHHNMHQRNMTKLQLAL

SEQ ID NO: 97683 - protein, 131 aa, Homo sapiens
  Payload ID: 19479
  Gene Name: Wilms tumor 1
  ENSP ID: ENSP00000435351
MGQQGSLGEQQYSVPPPVYGCHTPTDSCTGSQALLLRTPYSSDNLYQMTSQLECMTWNQMNLGATLKGVAAGSSSSVKWTEGQSNHSTGYESDNHTTPILCGAQYRIHTHGVFRGIQDVRRVPGVAPTLVR

SEQ ID NO: 97684 - protein, 178 aa, Homo sapiens
  Payload ID: 19479
  Gene Name: Wilms tumor 1
  ENSP ID: ENSP00000435624
  MOD_RES (1)..(1): Any amino acid
XLGATLKGVAAGSSSSVKWTEGQSNHSTGYESDNHTTPILCGAQYRIHTHGVFRGIQDVRRVPGVAPTLVRSASETSEKRPFMCAYPGCNKRYFKLSHLQMHSRKHTGVKPFQCKTCQRKFSRSDHLKTHTRTHTGKTSEKPFSCRWPSCQKKFARSDELVRHHNMHQRNMTKLQLAL

SEQ ID NO: 97685 - protein, 25 aa, Homo sapiens
  Payload ID: 19479
  Gene Name: Wilms tumor 1
  ENSP ID: ENSP00000436292
MCAYPGCNKRYFKLSHLQMHSRKHT

SEQ ID NO: 97686 - protein, 151 aa, Homo sapiens
  Payload ID: 19480
  Gene Name: Wilms tumor 1 associated protein
  Uniprot ID: Q15007
  ENSP ID: ENSP00000336911
MTNEEPLPKKVRLSETDFKVMARDELILRWKQYEAYVQALEGKYTDLNSNDVTGLRESEEKLKQQQQESARRENILVMRLATKEQEMQECTTQIQYLKQVQQPSVAQLRSTMVDPAINLFFLKMKGELEQTKDKLEQAQNELSAWKFTPDR

SEQ ID NO: 97687 - protein, 396 aa, Homo sapiens
  Payload ID: 19480
  Gene Name: Wilms tumor 1 associated protein
  Uniprot ID: Q15007
  ENSP ID: ENSP00000351141
MTNEEPLPKKVRLSETDFKVMARDELILRWKQYEAYVQALEGKYTDLNSNDVTGLRESEEKLKQQQQESARRENILVMRLATKEQEMQECTTQIQYLKQVQQPSVAQLRSTMVDPAINLFFLKMKGELEQTKDKLEQAQNELSAWKFTPDSQTGKKLMAKCRMLIQENQELGRQLSQGRIAQLEAELALQKKYSEELKSSQDELNDFIIQLDEEVEGMQSTILVLQQQLKETRQQLAQYQQQQSQASAPSTSRTTASEPVEQSEATSKDCSRLTNGPSNGSSSRQRTSGSGFHREGNTTEDDFPSSPGNGNKSSNSSEERTGRGGSGYVNQLSAGYESVDSPTGSENSLTHQSNDTDSSHDPQEEKAVSGKGNRTVGSRHVQNGLDSSVNVQGSVL

SEQ ID NO: 97688 - protein, 396 aa, Homo sapiens; identical to SEQ ID NO: 97687
  Payload ID: 19480
  Gene Name: Wilms tumor 1 associated protein
  Uniprot ID: Q15007
  ENSP ID: ENSP00000479438

SEQ ID NO: 97689 - protein, 170 aa, Homo sapiens
  Payload ID: 19480
  Gene Name: Wilms tumor 1 associated protein
  ENSP ID: ENSP00000484404
MTNEEPLPKKVRLSETDFKVMARDELILRWKQYEAYVQALEGKYTDLNSNDVTGLRESEEKLKQQQQESARRENILVMRLATKEQEMQECTTQIQYLKQVQQPSVAQLRSTMVDPAINLFFLKMKGELEQTKDKLEQAQNELSAWKFTPDRGLMASDYSEEVATSEKFPF

SEQ ID NO: 97690 - protein, 170 aa, Homo sapiens; identical to SEQ ID NO: 97689
  Payload ID: 19480
  Gene Name: Wilms tumor 1 associated protein
  ENSP ID: ENSP00000487338

SEQ ID NO: 97691 - protein, 200 aa, Homo sapiens
  Payload ID: 19481
  Gene Name: Wilms tumor 1 interacting protein
  ENSP ID: ENSP00000465683
  MOD_RES (1)..(1): Any amino acid
XPLPPGREGGPSAAERRLEALTRELERALEARTARDYFGICIKCGLGIYGAQQACQAMGSLYHTDCFTCDSCGRRLRGKAFYNVGEKVYCQEDFLYSGFQQTADKCSVCGHLIMEMILQALGKSYHPGCFRCSVCNECLDGVPFTVDVENNIYCVRDYHTVFAPKCASCARPILPAQGCETTIRVVSMDRDYHVACYHCE

SEQ ID NO: 97692 - protein, 430 aa, Homo sapiens
  Payload ID: 19481
  Gene Name: Wilms tumor 1 interacting protein
  Uniprot ID: A6NIX2
  ENSP ID: ENSP00000466953
MQRSRAGADEAALLLAGLALRELEPGCGSPGRGRRGPRPGPGDEAAPALGRRGKGSGGPEAGADGLSRGERGPRRAAVPELSAQPAGSPRASLAGSDGGGGGGSARSSGISLGYDQRHGSPRSGRSDPRPGPGPPSVGSARSSVSSLGSRGSAGAYADFLPPGACPAPARSPEPAGPAPFPLPALPLPPGREGGPSAAERRLEALTRELERALEARTARDYFGICIKCGLGIYGAQQACQAMGSLYHTDCFTCDSCGRRLRGKAFYNVGEKVYCQEDFLYSGFQQTADKCSVCGHLIMEMILQALGKSYHPGCFRCSVCNECLDGVPFTVDVENNIYCVRDYHTVFAPKCASCARPILPAQGCETTIRVVSMDRDYHVACYHCEDCGLQLSGEEGRRCYPLAGHLLCRRCHLRRLQPGPLPSPTVHVTEL

SEQ ID NO: 97693 - protein, 360 aa, Homo sapiens
  Payload ID: 19482
  Gene Name: wingless-type MMTV integration site family member 2
  Uniprot ID: P09544
  ENSP ID: ENSP00000265441
MNAPLGGIWLWLPLLLTWLTPEVNSSWWYMRATGGSSRVMCDNVPGLVSSQRQLCHRHPDVMRAISQGVAEWTAECQHQFRQHRWNCNTLDRDHSLFGRVLLRSSRESAFVYAISSAGVVFAITRACSQGEVKSCSCDPKKMGSAKDSKGIFDWGGCSDNIDYGIKFARAFVDAKERKGKDARALMNLHNNRAGRKAVKRFLKQECKCHGVSGSCTLRTCWLAMADFRKTGDYLWRKYNGAIQVVMNQDGTGFTVANERFKKPTKNDLVYFENSPDYCIRDREAGSLGTAGRVCNLTSRGMDSCEVMCCGRGYDTSHVTRMTKCGCKFHWCCAVRCQDCLEALDVHTCKAPKNADWTTAT

SEQ ID NO: 97694 - protein, 110 aa, Homo sapiens
  Payload ID: 19482
  Gene Name: wingless-type MMTV integration site family member 2
  ENSP ID: ENSP00000389643
MNAPLGGIWLWLPLLLTWLTPEVNSSWWYMRATGGSSRVMCDNVPGLVSSQRQLCHRHPDVMRAISQGVAEWTAECQHQFRQHRWNCNTLDRDHSLFGRVLLRRPVAKEK

SEQ ID NO: 97695 - protein, 153 aa, Homo sapiens
  Payload ID: 19482
  Gene Name: wingless-type MMTV integration site family member 2
  ENSP ID: ENSP00000419466
MNAPLGGIWLWLPLLLTWLTPEVNSSWWYMRATGGSSRVMCDNVPGLVSSQRQLCHRHPDVMRAISQGVAEWTAECQHQFRQHRWNCNTLDRDHSLFGRVLLRSCKAVLETRVQVPRGERLMYSQDMLAGHGRLQENGRLSLEEVQWGHPGGH

SEQ ID NO: 97696 - protein, 370 aa, Homo sapiens
  Payload ID: 19483
  Gene Name: wingless-type MMTV integration site family, member 1
  Uniprot ID: P04628
  ENSP ID: ENSP00000293549
MGLWALLPGWVSATLLLALAALPAALAANSSGRWWGIVNVASSTNLLTDSKSLQLVLEPSLQLLSRKQRRLIRQNPGILHSVSGGLQSAVRECKWQFRNRRWNCPTAPGPHLFGKIVNRGCRETAFIFAITSAGVTHSVARSCSEGSIESCTCDYRRRGPGGPDWHWGGCSDNIDFGRLFGREFVDSGEKGRDLRFLMNLHNNEAGRTTVFSEMRQECKCHGMSGSCTVRTCWMRLPTLRAVGDVLRDRFDGASRVLYGNRGSNRASRAELLRLEPEDPAHKPPSPHDLVYFEKSPNFCTYSGRLGTAGTAGRACNSSSPALDGCELLCCGRGHRTRTQRVTERCNCTFHWCCHVSCRNCTHTRVLHECL

SEQ ID NO: 97697 - protein, 359 aa, Homo sapiens
  Payload ID: 19483
  Gene Name: wingless-type MMTV integration site family, member 1
  ENSP ID: ENSP00000481240
MGLWALLPGWVSATLLLALAALPAALAANSSGRWWGIVNVASSTNLLTDSKSLQLVLEPSLQLLSRKQRRLIRQNPGILHSVSGGLQSAVRECKWQFRNRRWNCPTAPGPHLFGKIVNRGCRETAFIFAITSAGVTHSVARSCSEGSIESCTCDYRRRGPGGPDWHWGGCSDNIDFGRLFGREFVDSGEKGRDLRFLMNLHNNEAGRTTVFSEMRQECKCHGMSGSCTVRTCWMRLPTLRAVGDVLRDRFDGASRVLYGNRGSNRASRAELLRLEPDLVYFEKSPNFCTYSGRLGTAGTAGRACNSSSPALDGCELLCCGRGHRTRTQRVTERCNCTFHWCCHVSCRNCTHTRVLHECL

SEQ ID NO: 97698 - protein, 417 aa, Homo sapiens
  Payload ID: 19484
  Gene Name: wingless-type MMTV integration site family, member 10A
  Uniprot ID: Q9GZT5
  ENSP ID: ENSP00000258411
MGSAHPRPWLRLRPQPQPRPALWVLLFFLLLLAAAMPRSAPNDILDLRLPPEPVLNANTVCLTLPGLSRRQMEVCVRHPDVAASAIQGIQIAIHECQHQFRDQRWNCSSLETRNKIPYESPIFSRGFRESAFAYAIAAAGVVHAVSNACALGKLKACGCDASRRGDEEAFRRKLHRLQLDALQRGKGLSHGVPEHPALPTASPGLQDSWEWGGCSPDMGFGERFSKDFLDSREPHRDIHARMRLHNNRVGRQAVMENMRRKCKCHGTSGSCQLKTCWQVTPEFRTVGALLRSRFHRATLIRPHNRNGGQLEPGPAGAPSPAPGAPGPRRRASPADLVYFEKSPDFCEREPRLDSAGTVGRLCNKSSAGSDGCGSMCCGRGHNILRQTRSERCHCRFHWCCFVVCEECRITEWVSVCK

SEQ ID NO: 97699 - protein, 212 aa, Homo sapiens
  Payload ID: 19484
  Gene Name: wingless-type MMTV integration site family, member 10A
  ENSP ID: ENSP00000388812
  MOD_RES (1)..(1): Any amino acid
XSAPNDILDLRLPPEPVLNANTVCLTLPGLSRRQMEVCVRHPDVAASAIQGIQIAIHECQHQFRDQRWNCSSLETRNKIPYESPIFSRGSDGEHAAEVQVPRHVRQLPAQDVLAGDARVPHRGGAAAQPLPPRHAHPAAQPQRRPAGAGPSGGTLAGSGRSRAAPTGQPRRPGLLRKVSRLLRARAAPGLGGHRGPPVQQEQRRLGWLRQHV

SEQ ID NO: 97700 - protein, 389 aa, Homo sapiens
  Payload ID: 19485
  Gene Name: wingless-type MMTV integration site family, member 10B
  Uniprot ID: O00744
  ENSP ID: ENSP00000301061
MLEEPRPRPPPSGLAGLLFLALCSRALSNEILGLKLPGEPPLTANTVCLTLSGLSKRQLGLCLRNPDVTASALQGLHIAVHECQHQLRDQRWNCSALEGGGRLPHHSAILKRGFRESAFSFSMLAAGVMHAVATACSLGKLVSCGCGWKGSGEQDRLRAKLLQLQALSRGKSFPHSLPSPGPGSSPSPGPQDTWEWGGCNHDMDFGEKFSRDFLDSREAPRDIQARMRIHNNRVGRQVVTENLKRKCKCHGTSGSCQFKTCWRAAPEFRAVGAALRERLGRAIFIDTHNRNSGAFQPRLRPRRLSGELVYFEKSPDFCERDPTMGSPGTRGRACNKTSRLLDGCGSLCCGRGHNVLRQTRVERCHCRFHWCCYVLCDECKVTEWVNVCK

SEQ ID NO: 97701 - protein, 191 aa, Homo sapiens
  Payload ID: 19485
  Gene Name: wingless-type MMTV integration site family, member 10B
  Uniprot ID: O00744
  ENSP ID: ENSP00000384691
MLEEPRPRPPPSGLAGLLFLALCSRALSNEILGLKLPGEPPLTANTVCLTLSGLSKRQLGLCLRNPDVTASALQGLHIAVHECQHQLRDQRWNCSALEGGGRLPHHSAILKRGFRESAFSFSMLAAGVMHAVATACSLGKLVSCGCGWKGSGEQDRLRAKLLQLQALSRGKLPGTSRHECESTTTGWGARW

SEQ ID NO: 97702 - protein, 173 aa, Homo sapiens
  Payload ID: 19485
  Gene Name: wingless-type MMTV integration site family, member 10B
  ENSP ID: ENSP00000385980
MLEEPRPRPPPSGLAGLLFLALCSRALSNEILGLKLPGEPPLTANTVCLTLSGLSKRQLGLCLRNPDVTASALQGLHIAVHECQHQLRDQRWNCSALEGGGRLPHHSAILKRGFRESAFSFSMLAAGVMHAVATACSLGKLVSCGCGWKGSGKLPGTSRHECESTTTGWGARW

SEQ ID NO: 97703 - protein, 132 aa, Homo sapiens
  Payload ID: 19485
  Gene Name: wingless-type MMTV integration site family, member 10B
  ENSP ID: ENSP00000398473
MLEEPRPRPPPSGLAGLLFLALCSRALSNEILGLKLPGEPPLTANTVCLTLSGLSKRQLGLCLRNPDVTASALQGLHIAVHECQHQLRDQRWNCSALEGGGRLPHHSAILKRGPGVGEGLDTQMVSEKVLFP

SEQ ID NO: 97704 - protein, 102 aa, Homo sapiens
  Payload ID: 19485
  Gene Name: wingless-type MMTV integration site family, member 10B
  ENSP ID: ENSP00000404896
MLEEPRPRPPPSGLAGLLFLALCSRALSNEILGLKLPGEPPLTANTVCLTLSGLSKRQLGLCLRNPDVTASALQGLHIAVHECQHQLRDQRWNCSALEGGGR

SEQ ID NO: 97705 - protein, 354 aa, Homo sapiens
  Payload ID: 19486
  Gene Name: wingless-type MMTV integration site family, member 11
  Uniprot ID: O96014
  ENSP ID: ENSP00000325526
MRARPQVCEALLFALALQTGVCYGIKWLALSKTPSALALNQTQHCKQLEGLVSAQVQLCRSNLELMHTVVHAAREVMKACRRAFADMRWNCSSIELAPNYLLDLERGTRESAFVYALSAAAISHAIARACTSGDLPGCSCGPVPGEPPGPGNRWGGCADNLSYGLLMGAKFSDAPMKVKKTGSQANKLMRLHNSEVGRQALRASLEMKCKCHGVSGSCSIRTCWKGLQELQDVAADLKTRYLSATKVVHRPMGTRKHLVPKDLDIRPVKDSELVYLQSSPDFCMKNEKVGSHGTQDRQCNKTSNGSDSCDLMCCGRGYNPYTDRVVERCHCKYHWCCYVTCRRCERTVERYVCK

SEQ ID NO: 97706 - protein, 5 aa, Homo sapiens
  Payload ID: 19486
  Gene Name: wingless-type MMTV integration site family, member 11
  ENSP ID: ENSP00000436140
MRARP

SEQ ID NO: 97707 - protein, 262 aa, Homo sapiens
  Payload ID: 19486
  Gene Name: wingless-type MMTV integration site family, member 11
  ENSP ID: ENSP00000483229
MRARPQVCEALLFALALQTGVCYGIKWLALSKTPSALALNQTQHCKQLEGLVSAQVQLCRSNLELMHTVVHAAREVMKACRRAFADMRWNCSSIELAPNYLLDLERGTRESAFVYALSAAAISHAIARACTSGDLQELQDVAADLKTRYLSATKVVHRPMGTRKHLVPKDLDIRPVKDSELVYLQSSPDFCMKNEKVGSHGTQDRQCNKTSNGSDSCDLMCCGRGYNPYTDRVVERCHCKYHWCCYVTCRRCERTVERYVCK

SEQ ID NO: 97708 - protein, 365 aa, Homo sapiens
  Payload ID: 19487
  Gene Name: wingless-type MMTV integration site family, member 16
  Uniprot ID: Q9UBV4
  ENSP ID: ENSP00000222462
MDRAALLGLARLCALWAALLVLFPYGAQGNWMWLGIASFGVPEKLGCANLPLNSRQKELCKRKPYLLPSIREGARLGIQECGSQFRHERWNCMITAAATTAPMGASPLFGYELSSGTKETAFIYAVMAAGLVHSVTRSCSAGNMTECSCDTTLQNGGSASEGWHWGGCSDDVQYGMWFSRKFLDFPIGNTTGKENKVLLAMNLHNNEAGRQAVAKLMSVDCRCHGVSGSCAVKTCWKTMSSFEKIGHLLKDKYENSIQISDKTKRKMRRREKDQRKIPIHKDDLLYVNKSPNYCVEDKKLGIPGTQGRECNRTSEGADGCNLLCCGRGYNTHVVRHVERCECKFIWCCYVRCRRCESMTDVHTCK

SEQ ID NO: 97709 - protein, 355 aa, Homo sapiens
  Payload ID: 19487
  Gene Name: wingless-type MMTV integration site family, member 16
  ENSP ID: ENSP00000355065
MQLTTCLRETLFTGASQKTSLWWLGIASFGVPEKLGCANLPLNSRQKELCKRKPYLLPSIREGARLGIQECGSQFRHERWNCMITAAATTAPMGASPLFGYELSSGTKETAFIYAVMAAGLVHSVTRSCSAGNMTECSCDTTLQNGGSASEGWHWGGCSDDVQYGMWFSRKFLDFPIGNTTGKENKVLLAMNLHNNEAGRQAVAKLMSVDCRCHGVSGSCAVKTCWKTMSSFEKIGHLLKDKYENSIQISDKTKRKMRRREKDQRKIPIHKDDLLYVNKSPNYCVEDKKLGIPGTQGRECNRTSEGADGCNLLCCGRGYNTHVVRHVERCECKFIWCCYVRCRRCESMTDVHTCK

SEQ ID NO: 97710 - protein, 299 aa, Homo sapiens
  Payload ID: 19488
  Gene Name: wingless-type MMTV integration site family, member 2B
  ENSP ID: ENSP00000256640
MRSVGEGAREWIRECQHQFRHHRWNCTTLDRDHTVFGRVMLRSSREAAFVYAISSAGVVHAITRACSQGELSVCSCDPYTRGRHHDQRGDFDWGGCSDNIHYGVRFAKAFVDAKEKRLKDARALMNLHNNRCGRTAVRRFLKLECKCHGVSGSCTLRTCWRALSDFRRTGDYLRRRYDGAVQVMATQDGANFTAARQGYRRATRTDLVYFDNSPDYCVLDKAAGSLGTAGRVCSKTSKGTDGCEIMCCGRGYDTTRVTRVTQCECKFHWCCAVRCKECRNTVDVHTCKAPKKAEWLDQT

SEQ ID NO: 97711 - protein, 391 aa, Homo sapiens
  Payload ID: 19488
  Gene Name: wingless-type MMTV integration site family, member 2B
  Uniprot ID: Q93097
  ENSP ID: ENSP00000358698
MLRPGGAEEAAQLPLRRASAPVPVPSPAAPDGSRASARLGLACLLLLLLLTLPARVDTSWWYIGALGARVICDNIPGLVSRQRQLCQRYPDIMRSVGEGAREWIRECQHQFRHHRWNCTTLDRDHTVFGRVMLRSSREAAFVYAISSAGVVHAITRACSQGELSVCSCDPYTRGRHHDQRGDFDWGGCSDNIHYGVRFAKAFVDAKEKRLKDARALMNLHNNRCGRTAVRRFLKLECKCHGVSGSCTLRTCWRALSDFRRTGDYLRRRYDGAVQVMATQDGANFTAARQGYRRATRTDLVYFDNSPDYCVLDKAAGSLGTAGRVCSKTSKGTDGCEIMCCGRGYDTTRVTRVTQCECKFHWCCAVRCKECRNTVDVHTCKAPKKAEWLDQT

SEQ ID NO: 97712 - protein, 372 aa, Homo sapiens
  Payload ID: 19488
  Gene Name: wingless-type MMTV integration site family, member 2B
  Uniprot ID: Q93097
  ENSP ID: ENSP00000358700
MLDGLGVVAISIFGIQLKTEGSLRTAVPGIPTQSAFNKCLQRYIGALGARVICDNIPGLVSRQRQLCQRYPDIMRSVGEGAREWIRECQHQFRHHRWNCTTLDRDHTVFGRVMLRSSREAAFVYAISSAGVVHAITRACSQGELSVCSCDPYTRGRHHDQRGDFDWGGCSDNIHYGVRFAKAFVDAKEKRLKDARALMNLHNNRCGRTAVRRFLKLECKCHGVSGSCTLRTCWRALSDFRRTGDYLRRRYDGAVQVMATQDGANFTAARQGYRRATRTDLVYFDNSPDYCVLDKAAGSLGTAGRVCSKTSKGTDGCEIMCCGRGYDTTRVTRVTQCECKFHWCCAVRCKECRNTVDVHTCKAPKKAEWLDQT

SEQ ID NO: 97713 - protein, 355 aa, Homo sapiens
  Payload ID: 19489
  Gene Name: wingless-type MMTV integration site family, member 3
  Uniprot ID: P56703
  ENSP ID: ENSP00000225512
MEPHLLGLLLGLLLGGTRVLAGYPIWWSLALGQQYTSLGSQPLLCGSIPGLVPKQLRFCRNYIEIMPSVAEGVKLGIQECQHQFRGRRWNCTTIDDSLAIFGPVLDKATRESAFVHAIASAGVAFAVTRSCAEGTSTICGCDSHHKGPPGEGWKWGGCSEDADFGVLVSREFADARENRPDARSAMNKHNNEAGRTTILDHMHLKCKCHGLSGSCEVKTCWWAQPDFRAIGDFLKDKYDSASEMVVEKHRESRGWVETLRAKYSLFKPPTERDLVYYENSPNFCEPNPETGSFGTRDRTCNVTSHGIDGCDLLCCGRGHNTRTEKRKEKCHCIFHWCCYVSCQECIRIYDVHTCK

SEQ ID NO: 97714 - protein, 355 aa, Homo sapiens; identical to SEQ ID NO: 97713
  Payload ID: 19489
  Gene Name: wingless-type MMTV integration site family, member 3
  ENSP ID: ENSP00000478327

SEQ ID NO: 97715 - protein, 355 aa, Homo sapiens; identical to SEQ ID NO: 97713
  Payload ID: 19489
  Gene Name: wingless-type MMTV integration site family, member 3
  Uniprot ID: P56703
  ENSP ID: ENSP00000480990

SEQ ID NO: 97716 - protein, 352 aa, Homo sapiens
  Payload ID: 19490
  Gene Name: wingless-type MMTV integration site family, member 3A
  Uniprot ID: P56704
  ENSP ID: ENSP00000284523
MAPLGYFLLLCSLKQALGSYPIWWSLAVGPQYSSLGSQPILCASIPGLVPKQLRFCRNYVEIMPSVAEGIKIGIQECQHQFRGRRWNCTTVHDSLAIFGPVLDKATRESAFVHAIASAGVAFAVTRSCAEGTAAICGCSSRHQGSPGKGWKWGGCSEDIEFGGMVSREFADARENRPDARSAMNRHNNEAGRQAIASHMHLKCKCHGLSGSCEVKTCWWSQPDFRAIGDFLKDKYDSASEMVVEKHRESRGWVETLRPRYTYFKVPTERDLVYYEASPNFCEPNPETGSFGTRDRTCNVSSHGIDGCDLLCCGRGHNARAERRREKCRCVFHWCCYVSCQECTRVYDVHTCK

SEQ ID NO: 97717 - protein, 351 aa, Homo sapiens
  Payload ID: 19491
  Gene Name: wingless-type MMTV integration site family, member 4
  Uniprot ID: P56705
  ENSP ID: ENSP00000290167
MSPRSCLRSLRLLVFAVFSAAASNWLYLAKLSSVGSISEEETCEKLKGLIQRQVQMCKRNLEVMDSVRRGAQLAIEECQYQFRNRRWNCSTLDSLPVFGKVVTQGTREAAFVYAISSAGVAFAVTRACSSGELEKCGCDRTVHGVSPQGFQWSGCSDNIAYGVAFSQSFVDVRERSKGASSSRALMNLHNNEAGRKAILTHMRVECKCHGVSGSCEVKTCWRAVPPFRQVGHALKEKFDGATEVEPRRVGSSRALVPRNAQFKPHTDEDLVYLEPSPDFCEQDMRSGVLGTRGRTCNKTSKAIDGCELLCCGRGFHTAQVELAERCSCKFHWCCFVKCRQCQRLVELHTCR

SEQ ID NO: 97718 - protein, 52 aa, Homo sapiens
  Payload ID: 19491
  Gene Name: wingless-type MMTV integration site family, member 4
  ENSP ID: ENSP00000388925
MCKRNLEVMDSVRRGAQLAIEECQYQFRNRRWNCSTLDSLPVFGKVVTQGGK

SEQ ID NO: 97719 - protein, 150 aa, Homo sapiens
  Payload ID: 19491
  Gene Name: wingless-type MMTV integration site family, member 4
  ENSP ID: ENSP00000403334
  MOD_RES (1)..(1): Any amino acid
XYLAKLSSVGSISEEETCEKLKGLIQRQVQMCKRNLEVMDSVRRGAQLAIEECQYQFRNRRWNCSTLDSLPVFGKVVTQGGKAWHGGDSGCHLLTESRSGERTQRRKEGGSLGQCWPEAIVGTQDPMRSPPYLWGRNQGGTHTGSASEGH

SEQ ID NO: 97720 - protein, 380 aa, Homo sapiens
  Payload ID: 19492
  Gene Name: wingless-type MMTV integration site family, member 5A
  Uniprot ID: P41221
  ENSP ID: ENSP00000264634
MKKSIGILSPGVALGMAGSAMSSKFFLVALAIFFSFAQVVIEANSWWSLGMNNPVQMSEVYIIGAQPLCSQLAGLSQGQKKLCHLYQDHMQYIGEGAKTGIKECQYQFRHRRWNCSTVDNTSVFGRVMQIGSRETAFTYAVSAAGVVNAMSRACREGELSTCGCSRAARPKDLPRDWLWGGCGDNIDYGYRFAKEFVDARERERIHAKGSYESARILMNLHNNEAGRRTVYNLADVACKCHGVSGSCSLKTCWLQLADFRKVGDALKEKYDSAAAMRLNSRGKLVQVNSRFNSPTTQDLVYIDPSPDYCVRNESTGSLGTQGRLCNKTSEGMDGCELMCCGRGYDQFKTVQTERCHCKFHWCCYVKCKKCTEIVDQFVCK

SEQ ID NO: 97721 - protein, 380 aa, Homo sapiens; identical to SEQ ID NO: 97720
  Payload ID: 19492
  Gene Name: wingless-type MMTV integration site family, member 5A
  Uniprot ID: P41221
  ENSP ID: ENSP00000417310

SEQ ID NO: 97722 - protein, 214 aa, Homo sapiens
  Payload ID: 19492
  Gene Name: wingless-type MMTV integration site family, member 5A
  ENSP ID: ENSP00000418184
MAGSAMSSKFFLVALAIFFSFAQVVIEANSWWSLGMNNPVQMSEVYIIGAQPLCSQLAGLSQGQKKLCHLYQDHMQYIGEGAKTGIKECQYQFRHRRWNCSTVDNTSVFGRVMQIGSRETAFTYAVSAAGVVNAMSRACREGELSTCGCSRAARPKDLPRDWLWGGCGDNIDYGYRFAKEFVDARERERIHAKGSYESARILMNLHNNEAGRRV

SEQ ID NO: 97723 - protein, 365 aa, Homo sapiens
  Payload ID: 19492
  Gene Name: wingless-type MMTV integration site family, member 5A
  Uniprot ID: P41221
  ENSP ID: ENSP00000420104
MAGSAMSSKFFLVALAIFFSFAQVVIEANSWWSLGMNNPVQMSEVYIIGAQPLCSQLAGLSQGQKKLCHLYQDHMQYIGEGAKTGIKECQYQFRHRRWNCSTVDNTSVFGRVMQIGSRETAFTYAVSAAGVVNAMSRACREGELSTCGCSRAARPKDLPRDWLWGGCGDNIDYGYRFAKEFVDARERERIHAKGSYESARILMNLHNNEAGRRTVYNLADVACKCHGVSGSCSLKTCWLQLADFRKVGDALKEKYDSAAAMRLNSRGKLVQVNSRFNSPTTQDLVYIDPSPDYCVRNESTGSLGTQGRLCNKTSEGMDGCELMCCGRGYDQFKTVQTERCHCKFHWCCYVKCKKCTEIVDQFVCK

SEQ ID NO: 97724 - protein, 129 aa, Homo sapiens
  Payload ID: 19492
  Gene Name: wingless-type MMTV integration site family, member 5A
  ENSP ID: ENSP00000478784
LQKSIGILSPGVALGMAGSAMSSKFFLVALAIFFSFAQVVIEANSWWSLGMNNPVQMSEDVGGHGWLRAHVLRPWLRPVQDRADGALPLQVPLVLLRQVQEVHGDRGPVCVQVVGATQHSAPLPGPAYL

SEQ ID NO: 97725 - protein, 359 aa, Homo sapiens
  Payload ID: 19493
  Gene Name: wingless-type MMTV integration site family, member 5B
  Uniprot ID: Q9H1J7
  ENSP ID: ENSP00000308887
MPSLLLLFTAALLSSWAQLLTDANSWWSLALNPVQRPEMFIIGAQPVCSQLPGLSPGQRKLCQLYQEHMAYIGEGAKTGIKECQHQFRQRRWNCSTADNASVFGRVMQIGSRETAFTHAVSAAGVVNAISRACREGELSTCGCSRTARPKDLPRDWLWGGCGDNVEYGYRFAKEFVDAREREKNFAKGSEEQGRVLMNLQNNEAGRRAVYKMADVACKCHGVSGSCSLKTCWLQLAEFRKVGDRLKEKYDSAAAMRVTRKGRLELVNSRFTQPTPEDLVYVDPSPDYCLRNESTGSLGTQGRLCNKTSEGMDGCELMCCGRGYNQFKSVQVERCHCKFHWCCFVRCKKCTEIVDQYICK

SEQ ID NO: 97726 - protein, 359 aa, Homo sapiens; identical to SEQ ID NO: 97725
  Payload ID: 19493
  Gene Name: wingless-type MMTV integration site family, member 5B
  Uniprot ID: Q9H1J7
  ENSP ID: ENSP00000380379

SEQ ID NO: 97727 - protein, 118 aa, Homo sapiens
  Payload ID: 19493
  Gene Name: wingless-type MMTV integration site family, member 5B
  ENSP ID: ENSP00000438414
MPSLLLLFTAALLSSWAQLLTDANSWWSLALNPVQRPEMFIIGAQPVCSQLPGLSPGQRKLCQLYQEHMAYIGEGAKTGIKECQHQFRQRRWNCSTADNASVFGRVMQIGSRETAFTH

SEQ ID NO: 97728 - protein, 359 aa, Homo sapiens; identical to SEQ ID NO: 97725
  Payload ID: 19493
  Gene Name: wingless-type MMTV integration site family, member 5B
  Uniprot ID: Q9H1J7
  ENSP ID: ENSP00000439312

SEQ ID NO: 97729 - protein, 112 aa, Homo sapiens
  Payload ID: 19493
  Gene Name: wingless-type MMTV integration site family, member 5B
  ENSP ID: ENSP00000440600
MPSLLLLFTAALLSSWAQLLTDANSWWSLALNPVQRPEMFIIGAQPVCSQLPGLSPGQRKLCQLYQEHMAYIGEGAKTGIKECQHQFRQRRWNCSTADNASVFGRVMQIGCV

SEQ ID NO: 97730 - protein, 253 aa, Homo sapiens
  Payload ID: 19493
  Gene Name: wingless-type MMTV integration site family, member 5B
  ENSP ID: ENSP00000442348
MPSLLLLFTAALLSSWAQLLTDANSWWSLALNPVQRPEMFIIGAQPVCSQLPGLSPGQRKLCQLYQEHMAYIGEGAKTGIKECQHQFRQRRWNCSTADNASVFGRVMQIGSRETAFTHAVSAAGVVNAISRACREGELSTCGCSRTARPKDLPRDWLWGGCGDNVEYGYRFAKEFVDAREREKNFAKGSEEQGRVLMNLQNNEAGRRAVYKMADVACKCHGVSGSCSLKTCWLQLAEFRKVGDRLKEKYDSAA

SEQ ID NO: 97731 - protein, 157 aa, Homo sapiens
  Payload ID: 19493
  Gene Name: wingless-type MMTV integration site family, member 5B
  ENSP ID: ENSP00000445395
MPSLLLLFTAALLSSWAQLLTDANSWWSLALNPVQRPEMFIIGAQPVCSQLPGLSPGQRKLCQLYQEHMAYIGEGAKTGIKECQHQFRQRRWNCSTADNASVFGRVMQIGSRETAFTHAVSAAGVVNAISRACREGELSTCGCSRTARPKDLPRDWL

SEQ ID NO: 97732 - protein, 365 aa, Homo sapiens
  Payload ID: 19494
  Gene Name: wingless-type MMTV integration site family, member 6
  Uniprot ID: Q9Y6F9
  ENSP ID: ENSP00000233948
MLPPLPSRLGLLLLLLLCPAHVGGLWWAVGSPLVMDPTSICRKARRLAGRQAELCQAEPEVVAELARGARLGVRECQFQFRFRRWNCSSHSKAFGRILQQDIRETAFVFAITAAGASHAVTQACSMGELLQCGCQAPRGRAPPRPSGLPGTPGPPGPAGSPEGSAAWEWGGCGDDVDFGDEKSRLFMDARHKRGRGDIRALVQLHNNEAGRLAVRSHTRTECKCHGLSGSCALRTCWQKLPPFREVGARLLERFHGASRVMGTNDGKALLPAVRTLKPPGRADLLYAADSPDFCAPNRRTGSPGTRGRACNSSAPDLSGCDLLCCGRGHRQESVQLEENCLCRFHWCCVVQCHRCRVRKELSLCL

SEQ ID NO: 97733 - protein, 349 aa, Homo sapiens
  Payload ID: 19495
  Gene Name: wingless-type MMTV integration site family, member 7A
  Uniprot ID: O00755
  ENSP ID: ENSP00000285018
MNRKARRCLGHLFLSLGMVYLRIGGFSSVVALGASIICNKIPGLAPRQRAICQSRPDAIIVIGEGSQMGLDECQFQFRNGRWNCSALGERTVFGKELKVGSREAAFTYAIIAAGVAHAITAACTQGNLSDCGCDKEKQGQYHRDEGWKWGGCSADIRYGIGFAKVFVDAREIKQNARTLMNLHNNEAGRKILEENMKLECKCHGVSGSCTTKTCWTTLPQFRELGYVLKDKYNEAVHVEPVRASRNKRPTFLKIKKPLSYRKPMDTDLVYIEKSPNYCEEDPVTGSVGTQGRACNKTAPQASGCDLMCCGRGYNTHQYARVWQCNCKFHWCCYVKCNTCSERTEMYTCK

SEQ ID NO: 97734 - protein, 349 aa, Homo sapiens
  Payload ID: 19496
  Gene Name: wingless-type MMTV integration site family, member 7B
  Uniprot ID: P56706
  ENSP ID: ENSP00000341032
MHRNFRKWIFYVFLCFGVLYVKLGALSSVVALGANIICNKIPGLAPRQRAICQSRPDAIIVIGEGAQMGINECQYQFRFGRWNCSALGEKTVFGQELRVGSREAAFTYAITAAGVAHAVTAACSQGNLSNCGCDREKQGYYNQAEGWKWGGCSADVRYGIDFSRRFVDAREIKKNARRLMNLHNNEAGRKVLEDRMQLECKCHGVSGSCTTKTCWTTLPKFREVGHLLKEKYNAAVQVEVVRASRLRQPTFLRIKQLRSYQKPMETDLVYIEKSPNYCEEDAATGSVGTQGRLCNRTSPGADGCDTMCCGRGYNTHQYTKVWQCNCKFHWCCFVKCNTCSERTEVFTCK

SEQ ID NO: 97735 - protein, 353 aa, Homo sapiens
  Payload ID: 19496
  Gene Name: wingless-type MMTV integration site family, member 7B
  ENSP ID: ENSP00000386546
MLLLSPRSALVSVYCPQIFLLLSSGSYLALSSVVALGANIICNKIPGLAPRQRAICQSRPDAIIVIGEGAQMGINECQYQFRFGRWNCSALGEKTVFGQELRVGSREAAFTYAITAAGVAHAVTAACSQGNLSNCGCDREKQGYYNQAEGWKWGGCSADVRYGIDFSRRFVDAREIKKNARRLMNLHNNEAGRKVLEDRMQLECKCHGVSGSCTTKTCWTTLPKFREVGHLLKEKYNAAVQVEVVRASRLRQPTFLRIKQLRSYQKPMETDLVYIEKSPNYCEEDAATGSVGTQGRLCNRTSPGADGCDTMCCGRGYNTHQYTKVWQCNCKFHWCCFVKCNTCSERTEVFTCK

SEQ ID NO: 97736 - protein, 333 aa, Homo sapiens
  Payload ID: 19496
  Gene Name: wingless-type MMTV integration site family, member 7B
  ENSP ID: ENSP00000386781
MSAPPFYRALSSVVALGANIICNKIPGLAPRQRAICQSRPDAIIVIGEGAQMGINECQYQFRFGRWNCSALGEKTVFGQELRVGSREAAFTYAITAAGVAHAVTAACSQGNLSNCGCDREKQGYYNQAEGWKWGGCSADVRYGIDFSRRFVDAREIKKNARRLMNLHNNEAGRKVLEDRMQLECKCHGVSGSCTTKTCWTTLPKFREVGHLLKEKYNAAVQVEVVRASRLRQPTFLRIKQLRSYQKPMETDLVYIEKSPNYCEEDAATGSVGTQGRLCNRTSPGADGCDTMCCGRGYNTHQYTKVWQCNCKFHWCCFVKCNTCSERTEVFTCK

SEQ ID NO: 97737 - protein, 205 aa, Homo sapiens
  Payload ID: 19496
  Gene Name: wingless-type MMTV integration site family, member 7B
  ENSP ID: ENSP00000387217
MHRNFRKWIFYVFLCFGVLYVKLGALSSVVALGANIICNKIPGLAPRQRAICQSRPDAIIVIGEGAQMGINECQYQFRFGRWNCSALGEKTVFGQELRVGSREAAFTYAITAAGVAHAVTAACSQGNLSNCGCDREKQGYYNQAEGWKWGGCSADVRYGIDFSRRFVDAREIKKNARRLMNLHNNEAGRKGLLGQPRVTSSPLFP

SEQ ID NO: 97738 - protein, 57 aa, Homo sapiens
  Payload ID: 19496
  Gene Name: wingless-type MMTV integration site family, member 7B
  ENSP ID: ENSP00000392750
MGINECQYQFRFGRWNCSALGEKTVFGQELRVGSREAAFTYAITAAGVAHAVTAACS

SEQ ID NO: 97739 - protein, 355 aa, Homo sapiens
  Payload ID: 19497
  Gene Name: wingless-type MMTV integration site family, member 8A
  Uniprot ID: Q9H1J5
  ENSP ID: ENSP00000354726
MGNLFMLWAALGICCAAFSASAWSVNNFLITGPKAYLTYTTSVALGAQSGIEECKFQFAWERWNCPENALQLSTHNRLRSATRETSFIHAISSAGVMYIITKNCSMGDFENCGCDGSNNGKTGGHGWIWGGCSDNVEFGERISKLFVDSLEKGKDARALMNLHNNRAGRLAVRATMKRTCKCHGISGSCSIQTCWLQLAEFREMGDYLKAKYDQALKIEMDKRQLRAGNSAEGHWVPAEAFLPSAEAELIFLEESPDYCTCNSSLGIYGTEGRECLQNSHNTSRWERRSCGRLCTECGLQVEERKTEVISSCNCKFQWCCTVKCDQCRHVVSKYYCARSPGSAQSLGRVWFGVYI

SEQ ID NO: 97740 - protein, 351 aa, Homo sapiens
  Payload ID: 19497
  Gene Name: wingless-type MMTV integration site family, member 8A
  Uniprot ID: Q9H1J5
  ENSP ID: ENSP00000381739
MGNLFMLWAALGICCAAFSASAWSVNNFLITGPKAYLTYTTSVALGAQSGIEECKFQFAWERWNCPENALQLSTHNRLRSATRETSFIHAISSAGVMYIITKNCSMGDFENCGCDGSNNGKTGGHGWIWGGCSDNVEFGERISKLFVDSLEKGKDARALMNLHNNRAGRLAVRATMKRTCKCHGISGSCSIQTCWLQLAEFREMGDYLKAKYDQALKIEMDKRQLRAGNSAEGHWVPAEAFLPSAEAELIFLEESPDYCTCNSSLGIYGTEGRECLQNSHNTSRWERRSCGRLCTECGLQVEERKTEVISSCNCKFQWCCTVKCDQCRHVVSKYYCARSPGSAQSLGKGSA

SEQ ID NO: 97741 - protein, 360 aa, Homo sapiens
  Payload ID: 19497
  Gene Name: wingless-type MMTV integration site family, member 8A
  ENSP ID: ENSP00000424809
MLCCIQCLCLVSPFPTLTPCQGGPHCLIPIHLCLTFSLFGRSVNNFLITGPKAYLTYTTSVALGAQSGIEECKFQFAWERWNCPENALQLSTHNRLRSATRETSFIHAISSAGVMYIITKNCSMGDFENCGCDGSNNGKTGGHGWIWGGCSDNVEFGERISKLFVDSLEKGKDARALMNLHNNRAGRLAVRATMKRTCKCHGISGSCSIQTCWLQLAEFREMGDYLKAKYDQALKIEMDKRQLRAGNSAEGHWVPAEAFLPSAEAELIFLEESPDYCTCNSSLGIYGTEGRECLQNSHNTSRWERRSCGRLCTECGLQVEERKTEVISSCNCKFQWCCTVKCDQCRHVTMSNPAVLLGIR

SEQ ID NO: 97742 - protein, 369 aa, Homo sapiens
  Payload ID: 19497
  Gene Name: wingless-type MMTV integration site family, member 8A
  ENSP ID: ENSP00000426653
MLCCIQCLCLVSPFPTLTPCQGGPHCLIPIHLCLTFSLFGRSVNNFLITGPKAYLTYTTSVALGAQSGIEECKFQFAWERWNCPENALQLSTHNRLRSATRETSFIHAISSAGVMYIITKNCSMGDFENCGCDGSNNGKTGGHGWIWGGCSDNVEFGERISKLFVDSLEKGKDARALMNLHNNRAGRLAVRATMKRTCKCHGISGSCSIQTCWLQLAEFREMGDYLKAKYDQALKIEMDKRQLRAGNSAEGHWVPAEAFLPSAEAELIFLEESPDYCTCNSSLGIYGTEGRECLQNSHNTSRWERRSCGRLCTECGLQVEERKTEVISSCNCKFQWCCTVKCDQCRHVVSKYYCARSPGSAQSLGKGSA

SEQ ID NO: 97743 - protein, 351 aa, Homo sapiens
  Payload ID: 19498
  Gene Name: wingless-type MMTV integration site family, member 8B
  Uniprot ID: Q93098
  ENSP ID: ENSP00000340677
MFLSKPSVYICLFTCVLQLSHSWSVNNFLMTGPKAYLIYSSSVAAGAQSGIEECKYQFAWDRWNCPERALQLSSHGGLRSANRETAFVHAISSAGVMYTLTRNCSLGDFDNCGCDDSRNGQLGGQGWLWGGCSDNVGFGEAISKQFVDALETGQDARAAMNLHNNEAGRKAVKGTMKRTCKCHGVSGSCTTQTCWLQLPEFREVGAHLKEKYHAALKVDLLQGAGNSAAGRGAIADTFRSISTRELVHLEDSPDYCLENKTLGLLGTEGRECLRRGRALGRWERRSCRRLCGDCGLAVEERRAETVSSCNCKFHWCCAVRCEQCRRRVTKYFCSRAERPRGGAAHKPGRKP

SEQ ID NO: 97744 - protein, 365 aa, Homo sapiens
  Payload ID: 19499
  Gene Name: wingless-type MMTV integration site family, member 9A
  Uniprot ID: O14904
  ENSP ID: ENSP00000272164
MLDGSPLARWLAAAFGLTLLLAALRPSAAYFGLTGSEPLTILPLTLEPEAAAQAHYKACDRLKLERKQRRMCRRDPGVAETLVEAVSMSALECQFQFRFERWNCTLEGRYRASLLKRGFKETAFLYAISSAGLTHALAKACSAGRMERCTCDEAPDLENREAWQWGGCGDNLKYSSKFVKEFLGRRSSKDLRARVDFHNNLVGVKVIKAGVETTCKCHGVSGSCTVRTCWRQLAPFHEVGKHLKHKYETALKVGSTTNEAAGEAGAISPPRGRASGAGGSDPLPRTPELVHLDDSPSFCLAGRFSPGTAGRRCHREKNCESICCGRGHNTQSRVVTRPCQCQVRWCCYVECRQCTQREEVYTCKG

SEQ ID NO: 97745 - protein, 357 aa, Homo sapiens
  Payload ID: 19500
  Gene Name: wingless-type MMTV integration site family, member 9B
  Uniprot ID: O14905
  ENSP ID: ENSP00000290015
MRPPPALALAGLCLLALPAAAASYFGLTGREVLTPFPGLGTAAAPAQGGAHLKQCDLLKLSRRQKQLCRREPGLAETLRDAAHLGLLECQFQFRHERWNCSLEGRMGLLKRGFKETAFLYAVSSAALTHTLARACSAGRMERCTCDDSPGLESRQAWQWGVCGDNLKYSTKFLSNFLGSKRGNKDLRARADAHNTHVGIKAVKSGLRTTCKCHGVSGSCAVRTCWKQLSPFRETGQVLKLRYDSAVKVSSATNEALGRLELWAPARQGSLTKGLAPRSGDLVYMEDSPSFCRPSKYSPGTAGRVCSREASCSSLCCGRGYDTQSRLVAFSCHCQVQWCCYVECQQCVQEELVYTCKH

SEQ ID NO: 97746 - protein, 329 aa, Homo sapiens
  Payload ID: 19500
  Gene Name: wingless-type MMTV integration site family, member 9B
  ENSP ID: ENSP00000377105
MRPPPALALAGLCLLALPAAAASYFGLTGREVLTPFPGLGTAAAPAQGGAHLKQCDLLKLSRRQKQLCRREPGLAETLRDAAHLGLLECQFQFRHERWNCSLEGRMGLLKRGFKETAFLYAVSSAALTHTLARACSAGRMERCTCDDSPGLESRQAWQWGVCGDNLKYSTKFLSNFLGSKRGNKDLRARADAHNTHVGIKAVKSGLRTTCKCHGVSGSCAVRTCWKQLSPFRETGQVLKLRYDSAVKVSSATNEALGRLELWAPARQGSLTKGLAPRSGDLVYMEDSPSFCRPSKYSPGTAGWSAVARSQLITTSTSRIQAILPSQLPE

SEQ ID NO: 97747 - protein, 132 aa, Homo sapiens
  Payload ID: 19500
  Gene Name: wingless-type MMTV integration site family, member 9B
  ENSP ID: ENSP00000458192
MKGRAVSFDPLACQGLNASPGSLTSPLRRIRSLTGREVLTPFPGLGTAAAPAQGGAHLKQCDLLKLSRRQKQLCRREPGLAETLRDAAHLGLLECQFQFRHERWNCSLEGRMGLLKRGFKETAFLYAVSSAA

SEQ ID NO: 97748 - protein, 357 aa, Homo sapiens; identical to SEQ ID NO: 97745
  Payload ID: 19500
  Gene Name: wingless-type MMTV integration site family, member 9B
  Uniprot ID: O14905
  ENSP ID: ENSP00000482127

SEQ ID NO: 97749 - protein, 132 aa, Homo sapiens; identical to SEQ ID NO: 97747
  Payload ID: 19500
  Gene Name: wingless-type MMTV integration site family, member 9B
  ENSP ID: ENSP00000487979

SEQ ID NO: 97750 - protein, 329 aa, Homo sapiens; identical to SEQ ID NO: 97746
  Payload ID: 19500
  Gene Name: wingless-type MMTV integration site family, member 9B
  ENSP ID: ENSP00000488518

SEQ ID NO: 97751 - protein, 502 aa, Homo sapiens
  Payload ID: 19501
  Gene Name: Wiskott-Aldrich syndrome
  Uniprot ID: P42768
  ENSP ID: ENSP00000365891
MSGGPMGGRPGGRGAPAVQQNIPSTLLQDHENQRLFEMLGRKCLTLATAVVQLYLALPPGAEHWTKEHCGAVCFVKDNPQKSYFIRLYGLQAGRLLWEQELYSQLVYSTPTPFFHTFAGDDCQAGLNFADEDEAQAFRALVQEKIQKRNQRQSGDRRQLPPPPTPANEERRGGLPPLPLHPGGDQGGPPVGPLSLGLATVDIQNPDITSSRYRGLPAPGPSPADKKRSGKKKISKADIGAPSGFKHVSHVGWDPQNGFDVNNLDPDLRSLFSRAGISEAQLTDAETSKLIYDFIEDQGGLEAVRQEMRRQEPLPPPPPPSRGGNQLPRPPIVGGNKGRSGPLPPVPLGIAPPPPTPRGPPPPGRGGPPPPPPPATGRSGPLPPPPPGAGGPPMPPPPPPPPPPPSSGNGPAPPPLPPALVPAGGLAPGGGRGALLDQIRQGIQLNKTPGAPESSALQPPPQSSEGLVGALMHVMQKRSRAIHSSDEGEDQAGDEDEDDEWDD

SEQ ID NO: 97752 - protein, 216 aa, Homo sapiens
  Payload ID: 19501
  Gene Name: Wiskott-Aldrich syndrome
  ENSP ID: ENSP00000410537
MSGGPMGGRPGGRGAPAVQQNIPSTLLQDHENQRLFEMLGRKCLTLATAVVQLYLALPPGAEHWTKEHCGAVCFVKDNPQKSYFIRLYGLQAGRLLWEQELYSQLVYSTPTPFFHTFAGDDCQAGLNFADEDEAQAFRALVQEKIQKRNQRQSGDRRQLPPPPTPANEERRGGLPPLPLHPGGDQGGPPVGPLSLGLATVDIQNPDITSSRYRGLP

SEQ ID NO: 97753 - protein, 505 aa, Homo sapiens
  Payload ID: 19502
  Gene Name: Wiskott-Aldrich syndrome-like
  Uniprot ID: O00401
  ENSP ID: ENSP00000223023
MSSVQQQPPPPRRVTNVGSLLLTPQENESLFTFLGKKCVTMSSAVVQLYAADRNCMWSKKCSGVACLVKDNPQRSYFLRIFDIKDGKLLWEQELYNNFVYNSPRGYFHTFAGDTCQVALNFANEEEAKKFRKAVTDLLGRRQRKSEKRRDPPNGPNLPMATVDIKNPEITTNRFYGPQVNNISHTKEKKKGKAKKKRLTKADIGTPSNFQHIGHVGWDPNTGFDLNNLDPELKNLFDMCGISEAQLKDRETSKVIYDFIEKTGGVEAVKNELRRQAPPPPPPSRGGPPPPPPPPHNSGPPPPPARGRGAPPPPPSRAPTAAPPPPPPSRPSVAVPPPPPNRMYPPPPPALPSSAPSGPPPPPPSVLGVGPVAPPPPPPPPPPPGPPPPPGLPSDGDHQVPTTAGNKAALLDQIREGAQLKKVEQNSRPVSCSGRDALLDQIRQGIQLKSVADGQESTPPTPAPTSGIVGALMEVMQKRSKAIHSSDEDEDEDDEEDFEDDDEWED

SEQ ID NO: 97754 - protein, 2382 aa, Homo sapiens
  Payload ID: 19503
  Gene Name: WNK lysine deficient protein kinase 1
  Uniprot ID: Q9H4A3
  ENSP ID: ENSP00000313059
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVAQGQSQGQPSSSSLTGVSSSQPIQHPQQQQGIQQTAPPQQTVQYSLSQTSTSSEATTAQPVSQPQAPQVLPQVSAGKQLPVSQPVPTIQGEPQIPVATQPSVVPVHSGAHFLPVGQPLPTPLLPQYPVSQIPISTPHVSTAQTGFSSLPITMAAGITQPLLTLASSATTAAIPGVSTVVPSQLPTLLQPVTQLPSQVHPQLLQPAVQSMGIPANLGQAAEVPLSSGDVLYQGFPPRLPPQYPGDSNIAPSSNVASVCIHSTVLSPPMPTEVLATPGYFPTVVQPYVESNLLVPMGGVGGQVQVSQPGGSLAQAPTTSSQQAVLESTQGVSQVAPAEPVAVAQTQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLCIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 97755 - protein, 2634 aa, Homo sapiens
  Payload ID: 19503
  Gene Name: WNK lysine deficient protein kinase 1
  Uniprot ID: Q9H4A3
  ENSP ID: ENSP00000341292
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVPRRGRSMSVCVPIFLLLPLCPASLPVLFHPTASTVCTSFSFPPPDCPEETFAEKLSKALESVLPMHSASQRKHRRSSLPSLFVSTPQSMAHPCGGTPTYPESQIFFPTIHERPVSFSPPPTCPPKVAISQRRKSTSFLEAQTHHFQPLLRTVGQSLLPPGGSPTNWTPEAVVMLGTTASRVTGESCEIQVHPMFEPSQVYSDYRPGLVLPEEAHYFIPQEAVYVAGVHYQARVAEQYEGIPYNSSVLSSPMKQIPEQKPVQGGPTSSSVFEFPSGQAFLVGHLQNLRLDSGLGPGSPLSSISAPISTDATRLKFHPVFVPHSAPAVLTHNNESRSNCVFEFHVHTPSSSSGEGGGILPQRVYRNRQVAVDLNQEELPPQSVGLHGYLQPVTEEKHNYHAPELTVSVVEPIGQNWPIGSPEYSSDSSQITSSDPSDFQSPPPTGGAAAPFGSDVSMPFIHLPQTVLQESPLFFCFPQGTTSQQVLTASFSSGGSALHPQAQGQSQGQPSSSSLTGVSSSQPIQHPQQQQGIQQTAPPQQTVQYSLSQTSTSSEATTAQPVSQPQAPQVLPQVSAGKQSTQGVSQVAPAEPVAVAQTQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLCIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 97756 - protein, 393 aa, Homo sapiens
  Payload ID: 19503
  Gene Name: WNK lysine deficient protein kinase 1
  ENSP ID: ENSP00000392542
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGMFQVYLGA

SEQ ID NO: 97757 - protein, 2833 aa, Homo sapiens
  Payload ID: 19503
  Gene Name: WNK lysine deficient protein kinase 1
  Uniprot ID: Q9H4A3
  ENSP ID: ENSP00000433548
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVPQSMAHPCGGTPTYPESQIFFPTIHERPVSFSPPPTCPPKVAISQRRKSTSFLEAQTHHFQPLLRTVGQSLLPPGGSPTNWTPEAVVMLGTTASRVTGESCEIQVHPMFEPSQVYSDYRPGLVLPEEAHYFIPQEAVYVAGVHYQARVAEQYEGIPYNSSVLSSPMKQIPEQKPVQGGPTSSSVFEFPSGQAFLVGHLQNLRLDSGLGPGSPLSSISAPISTDATRLKFHPVFVPHSAPAVLTHNNESRSNCVFEFHVHTPSSSSGEGGGILPQRVYRNRQVAVDLNQEELPPQSVGLHGYLQPVTEEKHNYHAPELTVSVVEPIGQNWPIGSPEYSSDSSQITSSDPSDFQSPPPTGGAAAPFGSDVSMPFIHLPQTVLQESPLFFCFPQGTTSQQVLTASFSSGGSALHPQAQGQSQGQPSSSSLTGVSSSQPIQHPQQQQGIQQTAPPQQTVQYSLSQTSTSSEATTAQPVSQPQAPQVLPQVSAGKQLPVSQPVPTIQGEPQIPVATQPSVVPVHSGAHFLPVGQPLPTPLLPQYPVSQIPISTPHVSTAQTGFSSLPITMAAGITQPLLTLASSATTAAIPGVSTVVPSQLPTLLQPVTQLPSQVHPQLLQPAVQSMGIPANLGQAAEVPLSSGDVLYQGFPPRLPPQYPGDSNIAPSSNVASVCIHSTVLSPPMPTEVLATPGYFPTVVQPYVESNLLVPMGGVGGQVQVSQPGGSLAQAPTTSSQQAVLESTQGVSQVAPAEPVAVAQTQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLCIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGCAKFNCASEQVTFKPGGRRTRFLRKMVKKVCPCNQLCRTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 97758 - protein, 76 aa, Homo sapiens
  Payload ID: 19503
  Gene Name: WNK lysine deficient protein kinase 1
  ENSP ID: ENSP00000437503
  MOD_RES (1)..(1): Any amino acid
XSDNLYSAFTSDGAISVPSLSAPGQGKMVKKVCPCNQLCRTSSTNTVGATVNSQAAQAQPPAMTSSRKGTFTDDLH

SEQ ID NO: 97759 - protein, 218 aa, Homo sapiens
  Payload ID: 19503
  Gene Name: WNK lysine deficient protein kinase 1
  ENSP ID: ENSP00000438313
  MOD_RES (1)..(1): Any amino acid
XADGTVDSGQGSSVFTESRVSSQQTVSYGSQHEQAHSTGTVPGHIPSTVQAQSQPHGVYPPSSVQQGIQQTAPPQQTVQYSLSQTSTSSEATTAQPVSQPQAPQVLPQVSAGKQSTQGVSQVAPAEPVAVAQTQATQPTTLASSVDSAHSDVASGMSDGNENVPSSSGRHEGRTTKRHYRKSVRSRSRHEKTSRPKLRILNVSNKGDRVVECQLETHN

SEQ ID NO: 97760 - protein, 67 aa, Homo sapiens
  Payload ID: 19503
  Gene Name: WNK lysine deficient protein kinase 1
  ENSP ID: ENSP00000438985
SDNLYSAFTSDGAISVPSLSAPGQGCAKFNCASEQVTFKPGGRRTRFLSTPCLALWKMVKKVCPCNQ

SEQ ID NO: 97761 - protein, 245 aa, Homo sapiens
  Payload ID: 19503
  Gene Name: WNK lysine deficient protein kinase 1
  ENSP ID: ENSP00000439552
SQPHGVYPPSSVQGIQQTAPPQQTVQYSLSQTSTSSEATTAQPVSQPQAPQVLPQVSAGKQLPVSQPVPTIQGEPQIPVATQPSVVPVHSGAHFLPVGQPLPTPLLPQYPVSQIPISTPHVSTAQTGFSSLPITMAAGITQPLLTLASSATTAAIPGVSTVVPSQLPTLLQPVTQLPSQVHPQLLQPAVQSMGIPANLGQAAEVPLSSGDVLYQGFPPRLPPQYPGDSNIAPSSNVASVCIHSTV

SEQ ID NO: 97762 - protein, 2134 aa, Homo sapiens
  Payload ID: 19503
  Gene Name: WNK lysine deficient protein kinase 1
  ENSP ID: ENSP00000441972
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVAQGQSQGQPSSSSLTGVSSSQPIQHPQQQGIQQTAPPQQTVQYSLSQTSTSSEATTAQPVSQPQAPQVLPQVSAGKQSTQGVSQVAPAEPVAVAQTQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLCIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 97763 - protein, 2642 aa, Homo sapiens
  Payload ID: 19503
  Gene Name: WNK lysine deficient protein kinase 1
  Uniprot ID: Q9H4A3
  ENSP ID: ENSP00000444465
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVPQSMAHPCGGTPTYPESQIFFPTIHERPVSFSPPPTCPPKVAISQRRKSTSFLEAQTHHFQPLLRTVGQSLLPPGGSPTNWTPEAVVMLGTTASRVTGESCEIQVHPMFEPSQVYSDYRPGLVLPEEAHYFIPQEAVYVAGVHYQARVAEQYEGIPYNSSVLSSPMKQIPEQKPVQGGPTSSSVFEFPSGQAFLVGHLQNLRLDSGLGPGSPLSSISAPISTDATRLKFHPVFVPHSAPAVLTHNNESRSNCVFEFHVHTPSSSSGEGGGILPQRVYRNRQVAVDLNQEELPPQSVGLHGYLQPVTEEKHNYHAPELTVSVVEPIGQNWPIGSPEYSSDSSQITSSDPSDFQSPPPTGGAAAPFGSDVSMPFIHLPQTVLQESPLFFCFPQGTTSQQVLTASFSSGGSALHPQAQGQSQGQPSSSSLTGVSSSQPIQHPQQQQGIQQTAPPQQTVQYSLSQTSTSSEATTAQPVSQPQAPQVLPQVSAGKQGFPPRLPPQYPGDSNIAPSSNVASVCIHSTVLSPPMPTEVLATPGYFPTVVQPYVESNLLVPMGGVGGQVQVSQPGGSLAQAPTTSSQQAVLESTQGVSQVAPAEPVAVAQTQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLCIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 97764 - protein, 194 aa, Homo sapiens
  Payload ID: 19503
  Gene Name: WNK lysine deficient protein kinase 1
  ENSP ID: ENSP00000446253
TTLASSVDSAHSDVASGMSDGNENVPSSSGRHEGRTTKRHYRKSVRSRSRHEKTSRPKLRILNVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNL

SEQ ID NO: 97765 - protein, 176 aa, Homo sapiens
  Payload ID: 19503
  Gene Name: WNK lysine deficient protein kinase 1
  ENSP ID: ENSP00000446462
  MOD_RES (1)..(1): Any amino acid
XEQAHSTGTVPGHIPSTVQAQSQPHGVYPPSSVAQGQSQGQPSSSSLTGVSSSQPIQHPQQQQGIQQTAPPQQTVQYSLSQTSTSSEATTAQPVSQPQAPQVLPQVSAGKQGFPPRLPPQYPGDSNIAPSSNVASVCIHSTVLSPPMPTEVLATPGYFPTVVQPYVESNLLVPMGG

SEQ ID NO: 97766 - protein, 240 aa, Homo sapiens
  Payload ID: 19503
  Gene Name: WNK lysine deficient protein kinase 1
  ENSP ID: ENSP00000459380
PHSAPAVLTHNNESRSNCVFEFHVHTPSSSSGEGGGILPQRVYRNRQVAVDLNQEELPPQSVGLHGYLQPVTEEKHNYHAPELTVSVVEPIGQNWPIGSPEYSSDSSQITSSDPSDFQSPPPTGGAAAPFGSDVSMPFIHLPQTVLQESPLFFCFPQGTTSQQVLTASFSSGGSALHPQAQGQSQGQPSSSSLTGVSSSQPIQHPQQQQGIQQTAPPQQTVQYSLSQTSTSSEATTAQPV

SEQ ID NO: 97767 - protein, 434 aa, Homo sapiens
  Payload ID: 19503
  Gene Name: WNK lysine deficient protein kinase 1
  ENSP ID: ENSP00000460651
MYELLVLFMLIQPQSMAHPCGGTPTYPESQIFFPTIHERPVSFSPPPTCPPKVAISQRRKSTSFLEAQTHHFQPLLRTVGQSLLPPGGSPTNWTPEAVVMLGTTASRVTGESCEIQVHPMFEPSQVYSDYRPGLVLPEEAHYFIPQEAVYVAGVHYQARVAEQYEGIPYNSSVLSSPMKQIPEQKPVQGGPTSSSVFEFPSGQAFLVGHLQNLRLDSGLGPGSPLSSISAPISTDATRLKFHPVFVPHSAPAVLTHNNESRSNCVFEFHVHTPSSSSGEGGGILPQRVYRNRQVAVDLNQEELPPQSVGLHGYLQPVTEEKHNYHAPELTVSVVEPIGQNWPIGSPEYSSDSSQITSSDPSDFQSPPPTGGAAAPFGSDVSMPFIHLPQTVLQESPLFFCFPQGTTSQQVLTASFSSGGSALHPQVIGKLPQLF

SEQ ID NO: 97768 - protein, 2297 aa, Homo sapiens
  Payload ID: 19504
  Gene Name: WNK lysine deficient protein kinase 2
  Uniprot ID: Q9Y3S1
  ENSP ID: ENSP00000297954
MDGDGGRRDVPGTLMEPGRGAGPAGMAEPRAKAARPGPQRFLRRSVVESDQEEPPGLEAAEAPGPQPPQPLQRRVLLLCKTRRLIAERARGRPAAPAPAALVAQPGAPGAPADAGPEPVGTQEPGPDPIAAAVETAPAPDGGPREEAAATVRKEDEGAAEAKPEPGRTRRDEPEEEEDDEDDLKAVATSLDGRFLKFDIELGRGSFKTVYKGLDTETWVEVAWCELQDRKLTKLERQRFKEEAEMLKGLQHPNIVRFYDFWESSAKGKRCIVLVTELMTSGTLKTYLKRFKVMKPKVLRSWCRQILKGLLFLHTRTPPIIHRDLKCDNIFITGPTGSVKIGDLGLATLKRASFAKSVIGTPEFMAPEMYEEHYDESVDVYAFGMCMLEMATSEYPYSECQNAAQIYRKVTCGIKPASFEKVHDPEIKEIIGECICKNKEERYEIKDLLSHAFFAEDTGVRVELAEEDHGRKSTIALRLWVEDPKKLKGKPKDNGAIEFTFDLEKETPDEVAQEMIESGFFHESDVKIVAKSIRDRVALIQWRRERIWPALQPKEQQDVGSPDKARGPPVPLQVQVTYHAQAGQPGPPEPEEPEADQHLLPPTLPTSATSLASDSTFDSGQGSTVYSDSQSSQQSVMLGSLADAAPSPAQCVCSPPVSEGPVLPQSLPSLGAYQQPTAAPGLPVGSVPAPACPPSLQQHFPDPAMSFAPVLPPPSTPMPTGPGQPAPPGQQPPPLAQPTPLPQVLAPQPVVPLQPVPPHLPPYLAPASQVGAPAQLKPLQMPQAPLQPLAQVPPQMPPIPVVPPITPLAGIDGLPPALPDLPTATVPPVPPPQYFSPAVILPSLAAPLPPASPALPLQAVKLPHPPGAPLAMPCRTIVPNAPATIPLLAVAPPGVAALSIHSAVAQLPGQPVYPAAFPQMAPTDVPPSPHHTVQNMRATPPQPALPPQPTLPPQPVLPPQPTLPPQPVLPPQPTRPPQPVLPPQPMLPPQPVLPPQPALPVRPEPLQPHLPEQAAPAATPGSQILLGHPAPYAVDVAAQVPTVPVPPAAVLSPPLPEVLLPAAPELLPQFPSSLATVSASVQSVPTQTATLLPPANPPLPGGPGIASPCPTVQLTVEPVQEEQASQDKPPGLPQSCESYGGSDVTSGKELSDSCEGAFGGGRLEGRAARKHHRRSTRARSRQERASRPRLTILNVCNTGDKMVECQLETHNHKMVTFKFDLDGDAPDEIATYMVEHDFILQAERETFIEQMKDVMDKAEDMLSEDTDADRGSDPGTSPPHLSTCGLGTGEESRQSQANAPVYQQNVLHTGKRWFIICPVAEHPAPEAPESSPPLPLSSLPPEASQGPCRGLTLPCLPWRRAACGAVFLSLFSAESAQSKQPPDSAPYKDQLSSKEQPSFLASQQLLSQAGPSNPPGAPPAPLAPSSPPVTALPQDGAAPATSTMPEPASGTASQAGGPGTPQGLTSELETSQPLAETHEAPLAVQPLVVGLAPCTPAPEAASTRDASAPREPLPPPAPEPSPHSGTPQPALGQPAPLLPAAVGAVSLATSQLPSPPLGPTVPPQPPSALESDGEGPPPRVGFVDSTIKSLDEKLRTLLYQEHVPTSSASAGTPVEVGDRDFTLEPLRGDQPRSEVCGGDLALPPVPKEAVSGRVQLPQPLVEKSELAPTRGAVMEQGTSSSMTAESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATAFLQRPSRAGSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGHLADSSRGPPAKDPAQASVGLTADSTGLSGKAVQTQQPCSVRASLSSDICSGLASDGGGARGQGWTVYHPTSERVTYKSSSKPRARFLSGPVSVSIWSALKRLCLGKEHSSRSSTSSLAPGPEPGPQPALHVQAQVNNSNNKKGTFTDDLHKLVDEWTSKTVGAAQLKPTLNQLKQTQKLQDMEAQAGWAAPGEARAMTAPRAGVGMPRLPPAPGPLSTTVIPGAAPTLSVPTPDGALGTARRNQVWFGLRVPPTACCGHSTQPRGGQRVGSKTASFAASDPVRS

SEQ ID NO: 97769 - protein, 2217 aa, Homo sapiens
  Payload ID: 19504
  Gene Name: WNK lysine deficient protein kinase 2
  ENSP ID: ENSP00000378860
MDGDGGRRDVPGTLMEPGRGAGPAGMAEPRAKAARPGPQRFLRRSVVESDQEEPPGLEAAEAPGPQPPQPLQRRVLLLCKTRRLIAERARGRPAAPAPAALVAQPGAPGAPADAGPEPVGTQEPGPDPIAAAVETAPAPDGGPREEAAATVRKEDEGAAEAKPEPGRTRRDEPEEEEDDEDDLKAVATSLDGRFLKFDIELGRGSFKTVYKGLDTETWVEVAWCELQDRKLTKLERQRFKEEAEMLKGLQHPNIVRFYDFWESSAKGKRCIVLVTELMTSGTLKTYLKRFKVMKPKVLRSWCRQILKGLLFLHTRTPPIIHRDLKCDNIFITGPTGSVKIGDLGLATLKRASFAKSVIGTPEFMAPEMYEEHYDESVDVYAFGMCMLEMATSEYPYSECQNAAQIYRKVTCGIKPASFEKVHDPEIKEIIGECICKNKEERYEIKDLLSHAFFAEDTGVRVELAEEDHGRKSTIALRLWVEDPKKLKGKPKDNGAIEFTFDLEKETPDEVAQEMIESGFFHESDVKIVAKSIRDRVALIQWRRERIWPALQPKEQQDVGSPDKARGPPVPLQVQVTYHAQAGQPGPPEPEEPEADQHLLPPTLPTSATSLASDSTFDSGQGSTVYSDSQSSQQSVMLGSLADAAPSPAQCVCSPPVSEGPVLPQSLPSLGAYQQPTAAPGLPVGSVPAPACPPSLQQHFPDPAMSFAPVLPPPSTPMPTGPGQPAPPGQQPPPLAQPTPLPQVLAPQPVVPLQPVPPHLPPYLAPASQVGAPAQLKPLQMPQAPLQPLAQVPPQMPPIPVVPPITPLAGIDGLPPALPDLPTATVPPVPPPQYFSPAVILPSLAAPLPPASPALPLQAVKLPHPPGAPLAMPCRTIVPNAPATIPLLAVAPPGVAALSIHSAVAQLPGQPVYPAAFPQMAPTDVPPSPHHTVQNMRATPPQPALPPQPTLPPQPVLPPQPTLPPQPVLPPQPTRPPQPVLPPQPMLPPQPVLPPQPALPVRPEPLQPHLPEQAAPAATPGSQILLGHPAPYAVDVAAQVPTVPVPPAAVLSPPLPEVLLPAAPELLPQFPSSLATVSASVQSVPTQTATLLPPANPPLPGGPGIASPCPTVQLTVEPVQEEQASQDKPPGLPQSCESYGGSDVTSGKELSDSCEGAFGGGRLEGRAARKHHRRSTRARSRQERASRPRLTILNVCNTGDKMVECQLETHNHKMVTFKFDLDGDAPDEIATYMVEHDFILQAERETFIEQMKDVMDKAEDMLSEDTDADRGSDPGTSPPHLSTCGLGTGEESRQSQANAPVYQQNVLHTGKRWFIICPVAEHPAPEAPESSPPLPLSSLPPEASQDSAPYKDQLSSKEQPSFLASQQLLSQAGPSNPPGAPPAPLAPSSPPVTALPQDGAAPATSTMPEPASGTASQAGGPGTPQGLTSELETSQPLAETHEAPLAVQPLVVGLAPCTPAPEAASTRDASAPREPLPPPAPEPSPHSGTPQPALGQPAPLLPAAVGAVSLATSQLPSPPLGPTVPPQPPSALESDGEGPPPRVGFVDSTIKSLDEKLRTLLYQEHVPTSSASAGTPVEVGDRDFTLEPLRGDQPRSEVCGGDLALPPVPKEAVSGRVQLPQPLVEKSELAPTRGAVMEQGTSSSMTAESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATAFLQRPSRAGSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGHLADSSRGPPAKDPAQASVGLTADSTGLSGKAVQTQQPCSVRASLSSDICSGLASDGGGARGQGWTVYHPTSERVTYKSSSKPRARFLSGPVSVSIWSALKRLCLGKEHSSRSSTSSLAPGPEPGPQPALHVQAQVNNSNNKKGTFTDDLHKLVDEWTSKTVGAAQLKPTLNQLKQTQKLQDMEAQAGWAAPGEARAMTAPRAGVGMPRLPPAPGPLSTTVIPGAAPTLSVPTPDPESEKPD

SEQ ID NO: 97770 - protein, 1014 aa, Homo sapiens
  Payload ID: 19504
  Gene Name: WNK lysine deficient protein kinase 2
  ENSP ID: ENSP00000390441
  MOD_RES (1)..(1): Any amino acid
XQLETHNHKMVTFKFDLDGDAPDEIATYMVEHDFILQAERETFIEQMKDVMDKAEDMLSEDTDADRGSDPGTSPPHLSTCGLGTGEESRQSQANAPVYQQNVLHTGKRWFIICPVAEHPAPEAPESSPPLPLSSLPPEASQDSAPYKDQLSSKEQPSFLASQQLLSQAGPSNPPGAPPAPLAPSSPPVTALPQDGAAPATSTMPEPASGTASQAGGPGTPQGLTSELETSQPLAETHEAPLAVQPLVVGLAPCTPAPEAASTRDASAPREPLPPPAPEPSPHSGTPQPALGQPAPLLPAAVGAVSLATSQLPSPPLGPTVPPQPPSALESDGEGPPPRVGFVDSTIKSLDEKLRTLLYQEHVPTSSASAGTPVEVGDRDFTLEPLRGDQPRSEVCGGDLALPPVPKEAVSGRVQLPQPLVEKSELAPTRGAVMEQGTSSSMTAESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATAFLQRPSRAGSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGHLADSSRGPPAKDPAQASVGLTADSTGLSGKAVQTQQPCSVRASLSSDICSGLASDGGGARGQGWTVYHPTSERVTYKSSSKPRARFLSGPVSVSIWSALKRLCLGKEHSSRSSTSSLAPGPEPGPQPALHVQAQVNNSNNKKGTFTDDLHKLVDEWTSKTVGAAQLKPTLNQLKQTQKLQDMEAQAGWAAPGEARAMTAPRAGVGMPRLPPAPGPLSTTVIPGAAPTLSVPTPDPESEKPD

SEQ ID NO: 97771 - protein, 363 aa, Homo sapiens
  Payload ID: 19504
  Gene Name: WNK lysine deficient protein kinase 2
  ENSP ID: ENSP00000411181
MEQGTSSSMTESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATSCRGLLGPSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGHLADSSRGPPAKDPKPVWGSLQTARA

SEQ ID NO: 97772 - protein, 790 aa, Homo sapiens
  Payload ID: 19504
  Gene Name: WNK lysine deficient protein kinase 2
  ENSP ID: ENSP00000412465
MDGDGGRRDVPGTLMEPGRGAGPAGMAEPRAKAARPGPQRFLRRSVVESDQEEPPGLEAAEAPGPQPPQPLQRRVLLLCKTRRLIAERARGRPAAPAPAALVAQPGAPGAPADAGPEPVGTQEPGPDPIAAAVETAPAPDGGPREEAAATVRKEDEGAAEAKPEPGRTRRDEPEEEEDDEDDLKAVATSLDGRFLKFDIELGRGSFKTVYKGLDTETWVEVAWCELQDRKLTKLERQRFKEEAEMLKGLQHPNIVRFYDFWESSAKGKRCIVLVTELMTSGTLKTYLKRFKVMKPKVLRSWCRQILKGLLFLHTRTPPIIHRDLKCDNIFITGPTGSVKIGDLGLATLKRASFAKSVIGTPEFMAPEMYEEHYDESVDVYAFGMCMLEMATSEYPYSECQNAAQIYRKVTCGIKPASFEKVHDPEIKEIIGECICKNKEERYEIKDLLSHAFFAEDTGVRVELAEEDHGRKSTIALRLWVEDPKKLKGKPKDNGAIEFTFDLEKETPDEVAQEMIESGFFHESDVKIVAKSIRDRVALIQWRRERIWPALQPKEQQDVGSPDKARGPPVPLQVQVTYHAQAGQPGPPEPEEPEADQHLLPPTLPTSATSLASDSTFDSGQGSTVYSDSQSSQQSVMLGSLADAAPSPAQCVCSPPVSEGPVLPQSLPSLGAYQQPTAAPPPLAQPTPLPQVLAPQPVVPLQPVPPHLPPYLAPASQVGAPAQLKPLQMPQAPLQPLAQVPPQMPPIPVVPPITPLAGIDGLPPALPDLPTATVPPVPPPQYFSPAVILPS

SEQ ID NO: 97773 - protein, 646 aa, Homo sapiens
  Payload ID: 19504
  Gene Name: WNK lysine deficient protein kinase 2
  ENSP ID: ENSP00000413325
  MOD_RES (1)..(1): Any amino acid
XAPEPSPHSGTPQPALGQPAPLLPAAVGAVSLATSQLPSPPLGPTVPPQPPSALESDGEGPPPRVGFVDSTIKSLDEKLRTLLYQEHVPTSSASAGTPVEVGDRDFTLEPLRGDQPRSEVCGGDLALPPVPKEAVSGRVQLPQPLVEKSELAPTRGAVMEQGTSSSMTESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATAFLQRPSRAGSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGHLADSSRGPPAKDPAQASVGLTADSTGLSGKAVQTQQPCSVRASLSSDICSGLASDGGGARGQGSSTSSLAPGPEPGPQPALHVQAQVNNSNNKKGTFTDDLHKLVDEWTSKTVGAAQLKPTLNQLKQTQKLQDMEAQAGWAAPGEARA

SEQ ID NO: 97774 - protein, 1773 aa, Homo sapiens
  Payload ID: 19504
  Gene Name: WNK lysine deficient protein kinase 2
  ENSP ID: ENSP00000414622
  MOD_RES (1)..(1): Any amino acid
XECQNAAQIYRKVTCGIKPASFEKVHDPEIKEIIGECICKNKEERYEIKDLLSHAFFAEDTGVRVELAEEDHGRKSTIALRLWVEDPKKLKGKPKDNGAIEFTFDLEKETPDEVAQEMIESGFFHESDVKIVAKSIRDRVALIQWRRERIWPALQPKEQQDVGSPDKARGPPVPLQVQVTYHAQAGQPGPPEPEEPEADQHLLPPTLPTSATSLASDSTFDSGQGSTVYSDSQSSQQSVMLGSLADAAPSPAQCVCSPPVSEGPVLPQSLPSLGAYQQPTAAPGLPVGSVPAPACPPSLQQHFPDPAMSFAPVLPPPSTPMPTGPGQPAPPGQQPPPLAQPTPLPQVLAPQPVVPLQPVPPHLPPYLAPASQVGAPAQLKPLQMPQAPLQPLAQVPPQMPPIPVVPPITPLAGIDGLPPALPDLPTATVPPVPPPQYFSPAVILPSLAAPLPPASPALPLQAVKLPHPPGAPLAMPCRTIVPNAPATIPLLAVAPPGVAALSIHSAVAQLPGQPVYPAAFPQMAPTDVPPSPHHTVQNMRATPPQPALPPQPTLPPQPVLPPQPTLPPQPVLPPQPTRPPQPVLPPQPMLPPQPVLPPQPALPVRPEPLQPHLPEQAAPAATPGSQILLGHPAPYAVDVAAQVPTVPVPPAAVLSPPLPEVLLPAAPELLPQFPSSLATVSASVQSVPTQTATLLPPANPPLPGGPGIASPCPTVQLTVEPVQEEQASQDKPPGLPQSCESYGGSDVTSGKELSDSCEGAFGGGRLEGRAARKHHRRSTRARSRQERASRPRLTILNVCNTGDKMVECQLETHNHKMVTFKFDLDGDAPDEIATYMVEHDFILQAERETFIEQMKDVMDKAEDMLSEDTDADRGSDPGTSPPHLSTCGLGTGEESRQSQANAPVYQQNVLHTGKRWFIICPVAEHPAPEAPESSPPLPLSSLPPEASQDSAPYKDQLSSKEQPSFLASQQLLSQAGPSNPPGAPPAPLAPSSPPVTALPQDGAAPATSTMPEPASGTASQAGGPGTPQGLTSELETSQPLAETHEAPLAVQPLVVGLAPCTPAPEAASTRDASAPREPLPPPAPEPSPHSGTPQPALGQPAPLLPAAVGAVSLATSQLPSPPLGPTVPPQPPSALESDGEGPPPRVGFVDSTIKSLDEKLRTLLYQEHVPTSSASAGTPVEVGDRDFTLEPLRGDQPRSEVCGGDLALPPVPKEAVSGRVQLPQPLVEKSELAPTRGAVMEQGTSSSMTAESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATAFLQRPSRAGSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGSSTSSLAPGPEPGPQPALHVQAQVNNSNNKKGTFTDDLHKLVDEWTSKTVGAAQLKPTLNQLKQTQKLQDMEAQAGWAAPGEARAMTAPRAGVGMPRLPPAPGPLSTTVIPGAAPTLSVPTPGTALSNLPTPPCALPLGQYRGLLPAPVSWGPWAGQVGQLGAQGSWNTPQVPVLPVFLQPPVVSMPGPRLRIT

SEQ ID NO: 97775 - protein, 2220 aa, Homo sapiens
  Payload ID: 19504
  Gene Name: WNK lysine deficient protein kinase 2
  ENSP ID: ENSP00000415038
  MOD_RES (1)..(1): Any amino acid
XGRRDVPGTLMEPGRGAGPAGMAEPRAKAARPGPQRFLRRSVVESDQEEPPGLEAAEAPGPQPPQPLQRRVLLLCKTRRLIAERARGRPAAPAPAALVAQPGAPGAPADAGPEPVGTQEPGPDPIAAAVETAPAPDGGPREEAAATVRKEDEGAAEAKPEPGRTRRDEPEEEEDDEDDLKAVATSLDGRFLKFDIELGRGSFKTVYKGLDTETWVEVAWCELQDRKLTKLERQRFKEEAEMLKGLQHPNIVRFYDFWESSAKGKRCIVLVTELMTSGTLKTYLKRFKVMKPKVLRSWCRQILKGLLFLHTRTPPIIHRDLKCDNIFITGPTGSVKIGDLGLATLKRASFAKSVIGTPEFMAPEMYEEHYDESVDVYAFGMCMLEMATSEYPYSECQNAAQIYRKVTCGIKPASFEKVHDPEIKEIIGECICKNKEERYEIKDLLSHAFFAEDTGVRVELAEEDHGRKSTIALRLWVEDPKKLKGKPKDNGAIEFTFDLEKETPDEVAQEMIESGFFHESDVKIVAKSIRDRVALIQWRRERIWPALQPKEQQDVGSPDKARGPPVPLQVQVTYHAQAGQPGPPEPEEPEADQHLLPPTLPTSATSLASDSTFDSGQGSTVYSDSQSSQQSVMLGSLADAAPSPAQCVCSPPVSEGPVLPQSLPSLGAYQQPTAAPGLPVGSVPAPACPPSLQQHFPDPAMSFAPVLPPPSTPMPTGPGQPAPPGQQPPPLAQPTPLPQVLAPQPVVPLQPVPPHLPPYLAPASQVGAPAQLKPLQMPQAPLQPLAQVPPQMPPIPVVPPITPLAGIDGLPPALPDLPTATVPPVPPPQYFSPAVILPSLAAPLPPASPALPLQAVKLPHPPGAPLAMPCRTIVPNAPATIPLLAVAPPGVAALSIHSAVAQLPGQPVYPAAFPQMAPTDVPPSPHHTVQNMRATPPQPALPPQPTLPPQPVLPPQPTLPPQPVLPPQPTRPPQPVLPPQPMLPPQPVLPPQPALPVRPEPLQPHLPEQAAPAATPGSQILLGHPAPYAVDVAAQVPTVPVPPAAVLSPPLPEVLLPAAPELLPQFPSSLATVSASVQSVPTQTATLLPPANPPLPGGPGIASPCPTVQLTVEPVQEEQASQDKPPGLPQSCESYGGSDVTSGKELSDSCEGAFGGGRLEGRAARKHHRRSTRARSRQERASRPRLTILNVCNTGDKMVECQLETHNHKMVTFKFDLDGDAPDEIATYMVEHDFILQAERETFIEQMKDVMDKAEDMLSEDTDADRGSDPGTSPPHLSTCGLGTGEESRQSQANAPVYQQNVLHTGKRWFIICPVAEHPAPEAPESSPPLPLSSLPPEASQDSAPYKDQLSSKEQPSFLASQQLLSQAGPSNPPGAPPAPLAPSSPPVTALPQDGAAPATSTMPEPASGTASQAGGPGTPQGLTSELETSQPLAETHEAPLAVQPLVVGLAPCTPAPEAASTRDASAPREPLPPPAPEPSPHSGTPQPALGQPAPLLPAAVGAVSLATSQLPSPPLGPTVPPQPPSALESDGEGPPPRVGFVDSTIKSLDEKLRTLLYQEHVPTSSASAGTPVEVGDRDFTLEPLRGDQPRSEVCGGDLALPPVPKEAVSGRVQLPQPLVEKSELAPTRGAVMEQGTSSSMTAESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATAFLQRPSRAGSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGHLADSSRGPPAKDPAQASVGLTADSTGLSGKAVQTQQPCSVRASLSSDICSGLASDGGGARGQGWTVYHPTSERVTYKSSSKPRARFLSGPVSVSIWSALKRLCLGKEHSSRSSTSSLAPGPEPGPQPALHVQAQVNNSNNKKGTFTDDLHKLVDEWTSKTVGAAQLKPTLNQLKQTQKLQDMEAQAGWAAPGEARAMTAPRAGVGMPRLPPAPGPLSTTVIPGAAPTLSVPTPGSCGPRAVSTPTSYT

SEQ ID NO: 97776 - protein, 1800 aa, Homo sapiens
  Payload ID: 19505
  Gene Name: WNK lysine deficient protein kinase 3
  Uniprot ID: Q9BYP7
  ENSP ID: ENSP00000346667
MATDSGDPASTEDSEKPDGISFENRVPQVAATLTVEARLKEKNSTFSASGETVERKRFFRKSVEMTEDDKVAESSPKDERIKAAMNIPRVDKLPSNVLRGGQEVKYEQCSKSTSEISKDCFKEKNEKEMEEEAEMKAVATSPSGRFLKFDIELGRGAFKTVYKGLDTETWVEVAWCELQDRKLTKAEQQRFKEEAEMLKGLQHPNIVRFYDSWESILKGKKCIVLVTELMTSGTLKTYLKRFKVMKPKVLRSWCRQILKGLQFLHTRTPPIIHRDLKCDNIFITGPTGSVKIGDLGLATLMRTSFAKSVIGTPEFMAPEMYEEHYDESVDVYAFGMCMLEMATSEYPYSECQNAAQIYRKVTSGIKPASFNKVTDPEVKEIIEGCIRQNKSERLSIRDLLNHAFFAEDTGLRVELAEEDDCSNSSLALRLWVEDPKKLKGKHKDNEAIEFSFNLETDTPEEVAYEMVKSGFFHESDSKAVAKSIRDRVTPIKKTREKKPAGCLEERRDSQCKSMGNVFPQPQNTTLPLAPAQQTGAECEETEVDQHVRQQLLQRKPQQHCSSVTGDNLSEAGAASVIHSDTSSQPSVAYSSNQTMGSQMVSNIPQAEVNVPGQIYSSQQLVGHYQQVSGLQKHSKLTQPQILPLVQGQSTVLPVHVLGPTVVSQPQVSPLTVQKVPQIKPVSQPVGAEQQAALLKPDLVRSLNQDVATTKENVSSPDNPSGNGKQDRIKQRRASCPRPEKGTKFQLTVLQVSTSGDNMVECQLETHNNKMVTFKFDVDGDAPEDIADYMVEDNFVLESEKEKFVEELRAIVGQAQEILHVHFATERATGVDSITVDSNSSQTGSSEQVQINSTSTQTSNESAPQSSPVGRWRFCINQTIRNRETQSPPSLQHSMSAVPGRHPLPSPKNTSNKEISRDTLLTIENNPCHRALFTSKSEHKDVVDGKISECASVETKQPAILYQVEDNRQIMAPVTNSSSYSTTSVRAVPAECEGLTKQASIFIPVYPCHQTASQADALMSHPGESTQTSGNSLTTLAFDQKPQTLSVQQPAMDAEFISQEGETTVNTEASSPKTVIPTQTPGLEPTTLQPTTVLESDGERPPKLEFADNRIKTLDEKLRNLLYQEHSISSIYPESQKDTQSIDSPFSSSAEDTLSCPVTEVIAISHCGIKDSPVQSPNFQQTGSKLLSNVAASQPANISVFKRDLNVITSVPSELCLHEMSSDASLPGDPEAYPAAVSSGGAIHLQTGGGYFGLSFTCPSLKNPISKKSWTRKLKSWAYRLRQSTSFFKRSKVRQVETEEMRSAIAPDPIPLTRESTADTRALNRCKAMSGSFQRGRFQVITIPQQQSAKMTSFGIEHISVFSETNHSSEEAFIKTAKSQLVEIEPATQNPKTSFSYEKLQALQETCKENKGVPKQGDNFLSFSAACETDVSSVTPEKEFEETSATGSSMQSGSELLLKEREILTAGKQPSSDSEFSASLAGSGKSVAKTGPESNQCLPHHEEQAYAQTQSSLFYSPSSPMSSDDESEIEDEDLKVELQRLREKHIQEVVNLQTQQNKELQELYERLRSIKDSKTQSTEIPLPPASPRRPRSFKSKLRSRPQSLTHVDNGIVATGKSCLINELENPLCVESNAASCQQSPASKKGMFTDDLHKLVDDWTKEAVGNSLIKPSLNQLKQSQHKLETENWNKVSENTPSTMGYTSTWISSLSQIRGAVPTSLPQGLSLPSFPGPLSSYGMPHVCQYNAVAGAGYPVQWVGISGTTQQSVVIPAQSGGPFQPGMNMQAFPTSSVQNPATIPPGPK

SEQ ID NO: 97777 - protein, 1800 aa, Homo sapiens; identical to SEQ ID NO: 97776
  Payload ID: 19505
  Gene Name: WNK lysine deficient protein kinase 3
  Uniprot ID: Q9BYP7
  ENSP ID: ENSP00000364301

SEQ ID NO: 97778 - protein, 1743 aa, Homo sapiens
  Payload ID: 19505
  Gene Name: WNK lysine deficient protein kinase 3
  Uniprot ID: Q9BYP7
  ENSP ID: ENSP00000364312
MATDSGDPASTEDSEKPDGISFENRVPQVAATLTVEARLKEKNSTFSASGETVERKRFFRKSVEMTEDDKVAESSPKDERIKAAMNIPRVDKLPSNVLRGGQEVKYEQCSKSTSEISKDCFKEKNEKEMEEEAEMKAVATSPSGRFLKFDIELGRGAFKTVYKGLDTETWVEVAWCELQDRKLTKAEQQRFKEEAEMLKGLQHPNIVRFYDSWESILKGKKCIVLVTELMTSGTLKTYLKRFKVMKPKVLRSWCRQILKGLQFLHTRTPPIIHRDLKCDNIFITGPTGSVKIGDLGLATLMRTSFAKSVIGTPEFMAPEMYEEHYDESVDVYAFGMCMLEMATSEYPYSECQNAAQIYRKVTSGIKPASFNKVTDPEVKEIIEGCIRQNKSERLSIRDLLNHAFFAEDTGLRVELAEEDDCSNSSLALRLWVEDPKKLKGKHKDNEAIEFSFNLETDTPEEVAYEMVKSGFFHESDSKAVAKSIRDRVTPIKKTREKKPAGCLEERRDSQCKSMGNVFPQPQNTTLPLAPAQQTGAECEETEVDQHVRQQLLQRKPQQHCSSVTGDNLSEAGAASVIHSDTSSQPSVAYSSNQTMGSQMVSNIPQAEVNVPGQIYSSQQLVGHYQQVSGLQKHSKLTQPQILPLVQGQSTVLPVHVLGPTVVSQPQVSPLTVQKVPQIKPVSQPVGAEQQAALLKPDLVRSLNQDVATTKENVSSPDNPSGNGKQDRIKQRRASCPRPEKGTKFQLTVLQVSTSGDNMVECQLETHNNKMVTFKFDVDGDAPEDIADYMVEDNFVLESEKEKFVEELRAIVGQAQEILHVHFATERATGVDSITVDSNSSQTGSSEQVQINSTSTQTSNESAPQSSPVGRWRFCINQTIRNRETQSPPSLQHSMSAVPGRHPLPSPKNTSNKEISRDTLLTIENNPCHRALFTSKSEHKDVVDGKISECASVETKQPAILYQVEDNRQIMAPVTNSSSYSTTSVRAVPAECEGLTKQASIFIPVYPCHQTASQADALMSHPGESTQTSGNSLTTLAFDQKPQTLSVQQPAMDAEFISQEGETTVNTEASSPKTVIPTQTPGLEPTTLQPTTVLESDGERPPKLEFADNRIKTLDEKLRNLLYQEHSISSIYPESQKDTQSIDSPFSSSAEDTLSCPVTEVIAISHCGIKDSPVQSPNFQQTGSKLLSNVAASQPANISVFKRDLNVITSVPSELCLHEMSSDASLPGDPEAYPAAVSSGGAIHLQTGVETEEMRSAIAPDPIPLTRESTADTRALNRCKAMSGSFQRGRFQVITIPQQQSAKMTSFGIEHISVFSETNHSSEEAFIKTAKSQLVEIEPATQNPKTSFSYEKLQALQETCKENKGVPKQGDNFLSFSAACETDVSSVTPEKEFEETSATGSSMQSGSELLLKEREILTAGKQPSSDSEFSASLAGSGKSVAKTGPESNQCLPHHEEQAYAQTQSSLFYSPSSPMSSDDESEIEDEDLKVELQRLREKHIQEVVNLQTQQNKELQELYERLRSIKDSKTQSTEIPLPPASPRRPRSFKSKLRSRPQSLTHVDNGIVATDPLCVESNAASCQQSPASKKGMFTDDLHKLVDDWTKEAVGNSLIKPSLNQLKQSQHKLETENWNKVSENTPSTMGYTSTWISSLSQIRGAVPTSLPQGLSLPSFPGPLSSYGMPHVCQYNAVAGAGYPVQWVGISGTTQQSVVIPAQSGGPFQPGMNMQAFPTSSVQNPATIPPGPK

SEQ ID NO: 97779 - protein, 165 aa, Homo sapiens
  Payload ID: 19505
  Gene Name: WNK lysine deficient protein kinase 3
  ENSP ID: ENSP00000401816
MATDSGDPASTEDSEKPDGISFENRVPQVAATLTVEARLKEKNSTFSASGETVERKRFFRKSVEMTEDDKVAESSPKDERIKAAMNIPRVDKLPSNVLRGGQEVKYEQCSKSTSEISKDCFKEKNEKEMEEEAEMKAVATSPSGRFLKFDIELGRGAFKTVYKGL

SEQ ID NO: 97780 - protein, 1799 aa, Homo sapiens [sequence omitted]

SEQ ID NO: 97781 - protein, 1243 aa, Homo sapiens
  Payload ID: 19506
  Gene Name: WNK lysine deficient protein kinase 4
  Uniprot ID: Q96J92
  ENSP ID: ENSP00000246914
MLASPATETTVLMSQTEADLALRPPPPLGTAGQPRLGPPPRRARRFSGKAEPRPRSSRLSRRSSVDLGLLSSWSLPASPAPDPPDPPDSAGPGPARSPPPSSKEPPEGTWTEGAPVKAAEDSARPELPDSAVGPGSREPLRVPEAVALERRREQEEKEDMETQAVATSPDGRYLKFDIEIGRGSFKTVYRGLDTDTTVEVAWCELQTRKLSRAERQRFSEEVEMLKGLQHPNIVRFYDSWKSVLRGQVCIVLVTELMTSGTLKTYLRRFREMKPRVLQRWSRQILRGLHFLHSRVPPILHRDLKCDNVFITGPTGSVKIGDLGLATLKRASFAKSVIGTPEFMAPEMYEEKYDEAVDVYAFGMCMLEMATSEYPYSECQNAAQIYRKVTSGRKPNSFHKVKIPEVKEIIEGCIRTDKNERFTIQDLLAHAFFREERGVHVELAEEDDGEKPGLKLWLRMEDARRGGRPRDNQAIEFLFQLGRDAAEEVAQEMVALGLVCEADYQPVARAVRERVAAIQRKREKLRKARELEALPPEPGPPPATVPMAPGPPSVFPPEPEEPEADQHQPFLFRHASYSSTTSDCETDGYLSSSGFLDASDPALQPPGGVPSSLAESHLCLPSAFALSIPRSGPGSDFSPGDSYASDAASGLSDVGEGMGQMRRPPGRNLRRRPRSRLRVTSVSDQNDRVVECQLQTHNSKMVTFRFDLDGDSPEEIAAAMVYNEFILPSERDGFLRRIREIIQRVETLLKRDTGPMEAAEDTLSPQEEPAPLPALPVPLPDPSNEELQSSTSLEHRSWTAFSTSSSSPGTPLSPGNPFSPGTPISPGPIFPITSPPCHPSPSPFSPISSQVSSNPSPHPTSSPLPFSSSTPEFPVPLSQCPWSSLPTTSPPTFSPTCSQVTLSSPFFPPCPSTSSFPSTTAAPLLSLASAFSLAVMTVAQSLLSPSPGLLSQSPPAPPSPLPSLPLPPPVAPGGQESPSPHTAEVESEASPPPARPLPGEARLAPISEEGKPQLVGRFQVTSSKEPAEPLPLQPTSPTLSGSPKPSTPQLTSESSDTEDSAGGGPETREALAESDRAAEGLGAGVEEEGDDGKEPQVGGSPQPLSHPSPVWMNYSYSSLCLSSEESESSGEDEEFWAELQSLRQKHLSEVETLQTLQKKEIEDLYSRLGKQPPPGIVAPAAMLSSRQRRLSKGSFPTSRRNSLQRSEPPGPGIMRRNSLSGSSTGSQEQRASKGVTFAGDVGRM

SEQ ID NO: 97782 - protein, 469 aa, Homo sapiens
  Payload ID: 19506
  Gene Name: WNK lysine deficient protein kinase 4
  ENSP ID: ENSP00000467088
MLASPATETTVLMSQTEADLALRPPPPLGTAGQPRLGPPPRRARRFSGKAEPRPRSSRLSRRSSVDLGLLSSWSLPASPAPDPPDPPDSAGPGPARSPPPSSKEPPEGTWTEGAPVKAAEDSARPELPDSAVGPGSREPLRVPEAVALERRREQEEKEDMETQAVATSPDGRYLKFDIEIGRGSFKTVYRGLDTDTTVEVAWCELQTRKLSRAERQRFSEEVEMLKGLQHPNIVRFYDSWKSVLRGQVCIVLVTELMTSGTLKTYLRRFREMKPRVLQRWSRQILRGLHFLHSRVPPILHRDLKCDNVFITGPTGSVKIGDLGLATLKRASFAKSVIGTPEFMAPEMYEEKYDEAVDVYAFGMCMLEMATSEYPYSECQNAAQIYRKVTSVHHPGPPGPRLLPRGARCARGTSGGGRRREAGPQALAAHGGRAARGAPTGQPGHRVPVPAGPGRGRGGGTGDGGSGLGL

SEQ ID NO: 97783 - protein, 62 aa, Homo sapiens
  Payload ID: 19506
  Gene Name: WNK lysine deficient protein kinase 4
  ENSP ID: ENSP00000467312
TLSPQEEPAPLPALPVPLPDPSNEGKPQLVGRFQVTSSKEPAEPLPLQPTSPTLSGSPKPST

SEQ ID NO: 97784 - protein, 379 aa, Homo sapiens
  Payload ID: 19507
  Gene Name: WNT inhibitory factor 1
  Uniprot ID: Q9Y5W5
  ENSP ID: ENSP00000286574
MARRSAFPAAALWLWSILLCLLALRAEAGPPQEESLYLWIDAHQARVLIGFEEDILIVSEGKMAPFTHDFRKAQQRMPAIPVNIHSMNFTWQAAGQAEYFYEFLSLRSLDKGIMADPTVNVPLLGTVPHKASVVQVGFPCLGKQDGVAAFEVDVIVMNSEGNTILQTPQNAIFFKTCQQAECPGGCRNGGFCNERRICECPDGFHGPHCEKALCTPRCMNGGLCVTPGFCICPPGFYGVNCDKANCSTTCFNGGTCFYPGKCICPPGLEGEQCEISKCPQPCRNGGKCIGKSKCKCSKGYQGDLCSKPVCEPGCGAHGTCHEPNKCQCQEGWHGRHCNKRYEASLIHALRPAGAQLRQHTPSLKKAEERRDPPESNYIW

SEQ ID NO: 97785 - protein, 128 aa, Homo sapiens
  Payload ID: 19507
  Gene Name: WNT inhibitory factor 1
  ENSP ID: ENSP00000439024
GVNCDKANCSTTCFNGGTCFYPGKCICPPGLEGEQCEISKCPQPCRNGGKCIGKSKSVCEPGCGAHGTCHEPNKCQCQEGWHGRHCNKRYEASLIHALRPAGAQLRQHTPSLKKAEERRDPPESNYIW

SEQ ID NO: 97786 - protein, 133 aa, Homo sapiens
  Payload ID: 19507
  Gene Name: WNT inhibitory factor 1
  ENSP ID: ENSP00000442063
MAPFTHDFRKAQQRMPAIPVNIHSMNFTWQAAGQAEYFYEFLSLRSLDKGIMADPTVNVPLLGTVPHKASVVQVGFPCLGKQDGVAAFEVDVIVMNSEGNTILQTPQNAIFFKTCQQAECPGGCRNGGFCNER

SEQ ID NO: 97787 - protein, 280 aa, Homo sapiens
  Payload ID: 19508
  Gene Name: WNT1 inducible signaling pathway protein 1
  Uniprot ID: O95388
  ENSP ID: ENSP00000220856
MRWFLPWTLAAVTAAAASTVLATALSPAPTTMDFTPAPLEDTSSRPQFCKWPCECPPSPPRCPLGVSLITDGCECCKMCAQQLGDNCTEAAICDPHRGLYCDYSGDRPRYAIGVCAHAVGEVEAWHRNCIAYTSPWSPCSTSCGLGVSTRISNVNAQCWPEQESRLCNLRPCDVDIHTLIKAGKKCLAVYQPEASMNFTLAGCISTRSYQPKYCGVCMDNRCCIPYKSKTIDVSFQCPDGLGFSRQVLWINACFCNLSCRNPNDIFADLESYPDFSEIAN

SEQ ID NO: 97788 - protein, 367 aa, Homo sapiens
  Payload ID: 19508
  Gene Name: WNT1 inducible signaling pathway protein 1
  Uniprot ID: O95388
  ENSP ID: ENSP00000250160
MRWFLPWTLAAVTAAAASTVLATALSPAPTTMDFTPAPLEDTSSRPQFCKWPCECPPSPPRCPLGVSLITDGCECCKMCAQQLGDNCTEAAICDPHRGLYCDYSGDRPRYAIGVCAQVVGVGCVLDGVRYNNGQSFQPNCKYNCTCIDGAVGCTPLCLRVRPPRLWCPHPRRVSIPGHCCEQWVCEDDAKRPRKTAPRDTGAFDAVGEVEAWHRNCIAYTSPWSPCSTSCGLGVSTRISNVNAQCWPEQESRLCNLRPCDVDIHTLIKAGKKCLAVYQPEASMNFTLAGCISTRSYQPKYCGVCMDNRCCIPYKSKTIDVSFQCPDGLGFSRQVLWINACFCNLSCRNPNDIFADLESYPDFSEIAN

SEQ ID NO: 97789 - protein, 36 aa, Homo sapiens
  Payload ID: 19508
  Gene Name: WNT1 inducible signaling pathway protein 1
  ENSP ID: ENSP00000367093
MRWFLPWTLAAVTAAAASTVLATMLWVRWRHGTGTA

SEQ ID NO: 97790 - protein, 155 aa, Homo sapiens
  Payload ID: 19508
  Gene Name: WNT1 inducible signaling pathway protein 1
  Uniprot ID: O95388
  ENSP ID: ENSP00000427744
MRWFLPWTLAAVTAAAASTVLATALSPAPTTMDFTPAPLEDTSSRPQFCKWPCECPPSPPRCPLGVSLITDGCECCKMCAQQLGDNCTEAAICDPHRGLYCDYSGDRPRYAIGVCARREEVSGCVPARGIHELHTCGLHQHTLLSTQVLWSLHGQ

SEQ ID NO: 97791 - protein, 122 aa, Homo sapiens
  Payload ID: 19508
  Gene Name: WNT1 inducible signaling pathway protein 1
  Uniprot ID: O95388
  ENSP ID: ENSP00000429185
MRWFLPWTLAAVTAAAASTVLATAGKKCLAVYQPEASMNFTLAGCISTRSYQPKYCGVCMDNRCCIPYKSKTIDVSFQCPDGLGFSRQVLWINACFCNLSCRNPNDIFADLESYPDFSEIAN

SEQ ID NO: 97792 - protein, 250 aa, Homo sapiens
  Payload ID: 19509
  Gene Name: WNT1 inducible signaling pathway protein 2
  Uniprot ID: O76076
  ENSP ID: ENSP00000190983
MRGTPKTHLLAFSLLCLLSKVRTQLCPTPCTCPWPPPRCPLGVPLVLDGCGCCRVCARRLGEPCDQLHVCDASQGLVCQPGAGPGGRGALCLLAEDDSSCEVNGRLYREGETFQPHCSIRCRCEDGGFTCVPLCSEDVRLPSWDCPHPRRVEVLGKCCPEWVCGQGGGLGTQPLPAQGPQFSGLVSSLPPGVPCPEWSTAWGPCSTTCGLGMATRVSNQNRFCRLETQRRLCLSRPCPPSRGRSPQNSAF

SEQ ID NO: 97793 - protein, 218 aa, Homo sapiens
  Payload ID: 19509
  Gene Name: WNT1 inducible signaling pathway protein 2
  Uniprot ID: O76076
  ENSP ID: ENSP00000361956
MRGTPKTHLLAFSLLCLLSKVRTQLCPTPCTCPWPPPRCPLGVPLVLDGCGCCRVCARRLGEPCDQLHVCDASQGLVCQPGAGPGGRGALCLCKQDPSFLALSLPCPLVSPAQNGARPGDPARPPVGWAWPPGCPTRTASADWRPSAACACPGPAHPPGVAVHKTVPSRAGLGMGTRCPPSPAGGPVPGPWADGRWSVPRPLAAGNTLAWVHHAEHQY

SEQ ID NO: 97794 - protein, 250 aa, Homo sapiens; identical to SEQ ID NO: 97792
  Payload ID: 19509
  Gene Name: WNT1 inducible signaling pathway protein 2
  Uniprot ID: O76076
  ENSP ID: ENSP00000361959

SEQ ID NO: 97795 - protein, 354 aa, Homo sapiens
  Payload ID: 19510
  Gene Name: WNT1 inducible signaling pathway protein 3
  Uniprot ID: O95389
  ENSP ID: ENSP00000230529
MQGLLFSTLLLAGLAQFCCRVQGTGPLDTTPEGRPGEVSDAPQRKQFCHWPCKCPQQKPRCPPGVSLVRDGCGCCKICAKQPGEICNEADLCDPHKGLYCDYSVDRPRYETGVCAYLVAVGCEFNQVHYHNGQVFQPNPLFSCLCVSGAIGCTPLFIPKLAGSHCSGAKGGKKSDQSNCSLEPLLQQLSTSYKTMPAYRNLPLIWKKKCLVQATKWTPCSRTCGMGISNRVTNENSNCEMRKEKRLCYIQPCDSNILKTIKIPKGKTCQPTFQLSKAEKFVFSGCSSTQSYKPTFCGICLDKRCCIPNKSKMITIQFDCPNEGSFKWKMLWITSCVCQRNCREPGDIFSELKIL

SEQ ID NO: 97796 - protein, 354 aa, Homo sapiens; identical to SEQ ID NO: 97795
  Payload ID: 19510
  Gene Name: WNT1 inducible signaling pathway protein 3
  Uniprot ID: O95389
  ENSP ID: ENSP00000354734

SEQ ID NO: 97797 - protein, 230 aa, Homo sapiens
  Payload ID: 19510
  Gene Name: WNT1 inducible signaling pathway protein 3
  ENSP ID: ENSP00000357652
MQGLLFSTLLLAGLAQFCCRVQGTGPLDTTPEGRPGEVSDAPQRKQFCHWPCKCPQQKPRCPPGVSLVRDGCGCCKICAKQPGEICNEADLCDPHKGLYCDYSVDRPRYETGVCAYLVAVGCEFNQVHYHNGQVFQPNPLFSCLCVSGAIGCTPLFIPKLAGSHCSGAKGGKKSDQSNCSLEPLLQQLSTSYKTMPAYRNLPLIWKKNVLCKQQNGLPAPEHVGWEYLTG

SEQ ID NO: 97798 - protein, 237 aa, Homo sapiens
  Payload ID: 19510
  Gene Name: WNT1 inducible signaling pathway protein 3
  ENSP ID: ENSP00000357653
MNKRRLLYPSGWLHGPSDMQGLLFSTLLLAGLAQFCCRVQGTGPLDTTPEGRPGEVSDAPQRKQFCHWPCKCPQQKPRCPPGVSLVRDGCGCCKICAKQPGEICNEADLCDPHKGLYCDYSVDRPRYETGVCAYLVAVGCEFNQVHYHNGQVFQPNPLFSCLCVSGAIGCTPLFIPKLAGSHCSGAKGGKKSDQSNCSLEPLLQQLSTSYKTMPDVCQASNLLPALRSLNCCLPSSL

SEQ ID NO: 97799 - protein, 372 aa, Homo sapiens
  Payload ID: 19510
  Gene Name: WNT1 inducible signaling pathway protein 3
  Uniprot ID: O95389
  ENSP ID: ENSP00000357655
MNKRRLLYPSGWLHGPSDMQGLLFSTLLLAGLAQFCCRVQGTGPLDTTPEGRPGEVSDAPQRKQFCHWPCKCPQQKPRCPPGVSLVRDGCGCCKICAKQPGEICNEADLCDPHKGLYCDYSVDRPRYETGVCAYLVAVGCEFNQVHYHNGQVFQPNPLFSCLCVSGAIGCTPLFIPKLAGSHCSGAKGGKKSDQSNCSLEPLLQQLSTSYKTMPAYRNLPLIWKKKCLVQATKWTPCSRTCGMGISNRVTNENSNCEMRKEKRLCYIQPCDSNILKTIKIPKGKTCQPTFQLSKAEKFVFSGCSSTQSYKPTFCGICLDKRCCIPNKSKMITIQFDCPNEGSFKWKMLWITSCVCQRNCREPGDIFSELKIL

SEQ ID NO: 97800 - protein, 130 aa, Homo sapiens
  Payload ID: 19510
  Gene Name: WNT1 inducible signaling pathway protein 3
  ENSP ID: ENSP00000386467
MGISNRVTNENSNCEMRKEKRLCYIQPCDSNILKTIKIPKGKTCQPTFQLSKAEKFVFSGCSSTQSYKPTFCGICLDKRCCIPNKSKMITIQFDCPNEGSFKWKMLWITSCVCQRNCREPGDIFSELKIL

SEQ ID NO: 97801 - protein, 219 aa, Homo sapiens
  Payload ID: 19510
  Gene Name: WNT1 inducible signaling pathway protein 3
  ENSP ID: ENSP00000395928
MQGLLFSTLLLAGLAQFCCRVQGTGPLDTTPEGRPGEVSDAPQRKQFCHWPCKCPQQKPRCPPGVSLVRDGCGCCKICAKQPGEICNEADLCDPHKGLYCDYSVDRPRYETGVCAYLVAVGCEFNQVHYHNGQVFQPNPLFSCLCVSGAIGCTPLFIPKLAGSHCSGAKGGKKSDQSNCSLEPLLQQLSTSYKTMPDVCQASNLLPALRSLNCCLPSSL

SEQ ID NO: 97802 - protein, 354 aa, Homo sapiens; identical to SEQ ID NO: 97795
  Payload ID: 19510
  Gene Name: WNT1 inducible signaling pathway protein 3
  Uniprot ID: O95389
  ENSP ID: ENSP00000473777

SEQ ID NO: 97803 - protein, 541 aa, Homo sapiens
  Payload ID: 19511
  Gene Name: wntless Wnt ligand secretion mediator
  Uniprot ID: Q5T9L3
  ENSP ID: ENSP00000262348
MAGAIIENMSTKKLCIVGGILLVFQIIAFLVGGLIAPGPTTAVSYMSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGDLGVHSGEELQLTTTITHVDGPTEIYKLTRKEAQE

SEQ ID NO: 97804 - protein, 543 aa, Homo sapiens
  Payload ID: 19511
  Gene Name: wntless Wnt ligand secretion mediator
  Uniprot ID: Q5T9L3
  ENSP ID: ENSP00000346829
MAGAIIENMSTKKLCIVGGILLVFQIIAFLVGGLIGPTTAVSYMSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGMQLPCKSREDCALFVSELYQELFSASKYSFINDNAASGI

SEQ ID NO: 97805 - protein, 127 aa, Homo sapiens
  Payload ID: 19511
  Gene Name: wntless Wnt ligand secretion mediator
  ENSP ID: ENSP00000360010
MAGAIIENMSTKKLCIVGGILLVFQIIAFLVGGLIAPGPTTAVSYMSVKCVDARKNHHKTKWFVPWGPNHCDKIRDIEEAIPREIEANDIVFSVHIPLPHMEMSPWFQFMLFILQLDIAFKLNNQIS

SEQ ID NO: 97806 - protein, 122 aa, Homo sapiens
  Payload ID: 19511
  Gene Name: wntless Wnt ligand secretion mediator
  ENSP ID: ENSP00000360012
MDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRR

SEQ ID NO: 97807 - protein, 450 aa, Homo sapiens
  Payload ID: 19511
  Gene Name: wntless Wnt ligand secretion mediator
  Uniprot ID: Q5T9L3
  ENSP ID: ENSP00000360015
MAGAIIENMSTKKLCIVGGILLVFQIIAFLVGGLIGENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGDLGVHSGEELQLTTTITHVDGPTEIYKLTRKEAQE

SEQ ID NO: 97808 - protein, 200 aa, Homo sapiens
  Payload ID: 19511
  Gene Name: wntless Wnt ligand secretion mediator
  ENSP ID: ENSP00000431552
  MOD_RES (1)..(1): Any amino acid
XNMSTKKLCIVGGILLVFQIIAFLVGGLIGENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWML

SEQ ID NO: 97809 - protein, 222 aa, Homo sapiens
  Payload ID: 19511
  Gene Name: wntless Wnt ligand secretion mediator
  ENSP ID: ENSP00000433111
MSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLE

SEQ ID NO: 97810 - protein, 38 aa, Homo sapiens
  Payload ID: 19511
  Gene Name: wntless Wnt ligand secretion mediator
  ENSP ID: ENSP00000433188
MAGAIIENMSTKKLCIVGGILLVFQIIAFLVGGLIAYP

SEQ ID NO: 97811 - protein, 134 aa, Homo sapiens
  Payload ID: 19511
  Gene Name: wntless Wnt ligand secretion mediator
  ENSP ID: ENSP00000433690
MDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLE

SEQ ID NO: 97812 - protein, 152 aa, Homo sapiens
  Payload ID: 19511
  Gene Name: wntless Wnt ligand secretion mediator
  ENSP ID: ENSP00000433867
  MOD_RES (1)..(1): Any amino acid
XFPSNQLREGNVIDFIRNNRRVGELCPAQTRSSVTRLRYLHAPGPTTAVSYMSVKCVDARKNHHKTKWFVPWGPNHCDKIRDIEEAIPREIEANDIVFSVHIPLPHMEMSPWFQFMLFILQLDIAFKLNNQITMNRTSEKSLGVWQTRSYYT

SEQ ID NO: 97813 - protein, 152 aa, Homo sapiens
  Payload ID: 19511
  Gene Name: wntless Wnt ligand secretion mediator
  ENSP ID: ENSP00000436196
MSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLL

SEQ ID NO: 97814 - protein, 647 aa, Homo sapiens
  Payload ID: 19512
  Gene Name: Wolf-Hirschhorn syndrome candidate 1
  Uniprot ID: O96028
  ENSP ID: ENSP00000308780
MEFSIKQSPLSVQSVVKCIKMKQAPEILGSANGKTPSCEVNRECSVFLSKAQLSSSLQEGVMQKFNGHDALPFIPADKLKDLTSRVFNGEPGAHDAKLRFESQEMKGIGTPPNTTPIKNGSPEIKLKITKTYMNGKPLFESSICGDSAADVSQSEENGQKPENKARRNRKRSIKYDSLLEQGLVEAALVSKISSPSDKKIPAKKESCPNTGRDKDHLLKYNVGDLVWSKVSGYPWWPCMVSADPLLHSYTKLKGQKKSARQYHVQFFGDAPERAWIFEKSLVAFEGEGQFEKLCQESAKQAPTKAEKIKLLKPISGKLRAQWEMGIVQAEEAASMSVEERKAKFTFLYVGDQLHLNPQVAKEAGIAAESLGEMAESSGVSEEAAENPKSVREECIPMKRRRRAKLCSSAETLESHPDIGKSTPQKTAEADPRRGVGSPPGRKKTTVSMPRSRKGDAASQFLVFCQKHRDEVVAEHPDASGEEIEELLRSQWSLLSEKQRARYNTKFALVAPVQAEEDSGNVNGKKRNHTKRIQDPTEDAEAEDTPRKRLRTDKHSLRKRDTITDKTARTSSYKAMEAASSLKSQAATKNLSDACKPLKKRNRASTAASSALGFSKSSSPSASLTENELLWEPTPVKLDLNPAALYCT

SEQ ID NO: 97815 - protein, 647 aa, Homo sapiens; identical to SEQ ID NO: 97814
  Payload ID: 19512
  Gene Name: Wolf-Hirschhorn syndrome candidate 1
  Uniprot ID: O96028
  ENSP ID: ENSP00000329167

SEQ ID NO: 97816 - protein, 713 aa, Homo sapiens
  Payload ID: 19512
  Gene Name: Wolf-Hirschhorn syndrome candidate 1
  Uniprot ID: O96028
  ENSP ID: ENSP00000372344
MAGSFCWRMLGLVSKVGNRARCFSSMAASEEELLDFSGSELQFNSCSLHLSLHPFFNFLLGIHSCFVCKESKTDVKRCVVTQCGKFYHEACVKKYPLTVFESRGFRCPLHSCVSCHASNPSNPRPSKGKMMRCVRCPVAYHSGDACLAAGCSVIASNSIICTAHFTARKGKRHHAHVNVSWCFVCSKGGSLLCCESCPAAFHPDCLNIEMPDGSWFCNDCRAGKKLHFQDIIWVKLGNYRWWPAEVCHPKNVPPNIQKMKHEIGEFPVFFFGSKDYYWTHQARVFPYMEGDRGSRYQGVRGIGRVFKNALQEAEARFREIKLQREARETQESERKPPPYKHIKVNKPYGKVQIYTADISEIPKCNCKPTDENPCGFDSECLNRMLMFECHPQVCPAGEFCQNQCFTKRQYPETKIIKTDGKGWGLVAKRDIRKGEFVNEYVGELIDEEECMARIKHAHENDITHFYMLTIDKDRIIDAGPKGNYSRFMNHSCQPNCETLKWTVNGDTRVGLFAVCDIPAGTELTFNYNLDCLGNEKTVCRCGASNCSGFLGDRPKTSTTLSSEEKGKKTKKKTRRRRAKGEGKRQSEDECFRCGDGGQLVLCDRKFCTKAYHLSCLGLGKRPFGKWECPWHHCDVCGKPSTSFCHLCPNSFCKEHQDGTAFSCTPDGRSYCCEHDLGAASVRSTKTEKPPPEPGKPKGKRRRRRGWRRVTEGK

SEQ ID NO: 97817 - protein, 1365 aa, Homo sapiens
  Payload ID: 19512
  Gene Name: Wolf-Hirschhorn syndrome candidate 1
  Uniprot ID: O96028
  ENSP ID: ENSP00000372347
MEFSIKQSPLSVQSVVKCIKMKQAPEILGSANGKTPSCEVNRECSVFLSKAQLSSSLQEGVMQKFNGHDALPFIPADKLKDLTSRVFNGEPGAHDAKLRFESQEMKGIGTPPNTTPIKNGSPEIKLKITKTYMNGKPLFESSICGDSAADVSQSEENGQKPENKARRNRKRSIKYDSLLEQGLVEAALVSKISSPSDKKIPAKKESCPNTGRDKDHLLKYNVGDLVWSKVSGYPWWPCMVSADPLLHSYTKLKGQKKSARQYHVQFFGDAPERAWIFEKSLVAFEGEGQFEKLCQESAKQAPTKAEKIKLLKPISGKLRAQWEMGIVQAEEAASMSVEERKAKFTFLYVGDQLHLNPQVAKEAGIAAESLGEMAESSGVSEEAAENPKSVREECIPMKRRRRAKLCSSAETLESHPDIGKSTPQKTAEADPRRGVGSPPGRKKTTVSMPRSRKGDAASQFLVFCQKHRDEVVAEHPDASGEEIEELLRSQWSLLSEKQRARYNTKFALVAPVQAEEDSGNVNGKKRNHTKRIQDPTEDAEAEDTPRKRLRTDKHSLRKRDTITDKTARTSSYKAMEAASSLKSQAATKNLSDACKPLKKRNRASTAASSALGFSKSSSPSASLTENEVSDSPGDEPSESPYESADETQTEVSVSSKKSERGVTAKKEYVCQLCEKPGSLLLCEGPCCGAFHLACLGLSRRPEGRFTCSECASGIHSCFVCKESKTDVKRCVVTQCGKFYHEACVKKYPLTVFESRGFRCPLHSCVSCHASNPSNPRPSKGKMMRCVRCPVAYHSGDACLAAGCSVIASNSIICTAHFTARKGKRHHAHVNVSWCFVCSKGGSLLCCESCPAAFHPDCLNIEMPDGSWFCNDCRAGKKLHFQDIIWVKLGNYRWWPAEVCHPKNVPPNIQKMKHEIGEFPVFFFGSKDYYWTHQARVFPYMEGDRGSRYQGVRGIGRVFKNALQEAEARFREIKLQREARETQESERKPPPYKHIKVNKPYGKVQIYTADISEIPKCNCKPTDENPCGFDSECLNRMLMFECHPQVCPAGEFCQNQCFTKRQYPETKIIKTDGKGWGLVAKRDIRKGEFVNEYVGELIDEEECMARIKHAHENDITHFYMLTIDKDRIIDAGPKGNYSRFMNHSCQPNCETLKWTVNGDTRVGLFAVCDIPAGTELTFNYNLDCLGNEKTVCRCGASNCSGFLGDRPKTSTTLSSEEKGKKTKKKTRRRRAKGEGKRQSEDECFRCGDGGQLVLCDRKFCTKAYHLSCLGLGKRPFGKWECPWHHCDVCGKPSTSFCHLCPNSFCKEHQDGTAFSCTPDGRSYCCEHDLGAASVRSTKTEKPPPEPGKPKGKRRRRRGWRRVTEGK

SEQ ID NO: 97818 - protein, 1365 aa, Homo sapiens; identical to SEQ ID NO: 97817
  Payload ID: 19512
  Gene Name: Wolf-Hirschhorn syndrome candidate 1
  Uniprot ID: O96028
  ENSP ID: ENSP00000372348

SEQ ID NO: 97819 - protein, 1365 aa, Homo sapiens; identical to SEQ ID NO: 97817
  Payload ID: 19512
  Gene Name: Wolf-Hirschhorn syndrome candidate 1
  Uniprot ID: O96028
  ENSP ID: ENSP00000372351

SEQ ID NO: 97820 - protein, 647 aa, Homo sapiens; identical to SEQ ID NO: 97814
  Payload ID: 19512
  Gene Name: Wolf-Hirschhorn syndrome candidate 1
  Uniprot ID: O96028
  ENSP ID: ENSP00000381311

SEQ ID NO: 97821 - protein, 629 aa, Homo sapiens
  Payload ID: 19512
  Gene Name: Wolf-Hirschhorn syndrome candidate 1
  Uniprot ID: O96028
  ENSP ID: ENSP00000399251
MEFSIKQSPLSVQSVVKCIKMKQAPEILGSANGKTPSCEVNRECSVFLSKAQLSSSLQEGVMQKFNGHDALPFIPADKLKDLTSRVFNGEPGAHDAKLRFESQEMKGIGTPPNTTPIKNGSPEIKLKITKTYMNGKPLFESSICGDSAADVSQSEENGQKPENKARRNRKRSIKYDSLLEQGLVEAALVSKISSPSDKKIPAKKESCPNTGRDKDHLLKYNVGDLVWSKVSGYPWWPCMVSADPLLHSYTKLKGQKKSARQYHVQFFGDAPERAWIFEKSLVAFEGEGQFEKLCQESAKQAPTKAEKIKLLKPISGKLRAQWEMGIVQAEEAASMSVEERKAKFTFLYVGDQLHLNPQVAKEAGIAAESLGEMAESSGVSEEAAENPKSVREECIPMKRRRRAKLCSSAETLESHPDIGKSTPQKTAEADPRRGVGSPPGRKKTTVSMPRSRKGDAASQFLVFCQKHRDEVVAEHPDASGEEIEELLRSQWSLLSEKQRARYNTKFALVAPVQAEEDSGNVNGKKRNHTKRIQDPTEDAEAEDTPRKRLRTDKHSLRKRDTITDKTARTSSYKAMEAASSLKSQAATKNLSDACKPLKKRNRASTAASSALGFSKSSSPSASLTENEVK

SEQ ID NO: 97822 - protein, 273 aa, Homo sapiens
  Payload ID: 19512
  Gene Name: Wolf-Hirschhorn syndrome candidate 1
  Uniprot ID: O96028
  ENSP ID: ENSP00000416725
MEFSIKQSPLSVQSVVKCIKMKQAPEILGSANGKTPSCEVNRECSVFLSKAQLSSSLQEGVMQKFNGHDALPFIPADKLKDLTSRVFNGEPGAHDAKLRFESQEMKGIGTPPNTTPIKNGSPEIKLKITKTYMNGKPLFESSICGDSAADVSQSEENGQKPENKARRNRKRSIKYDSLLEQGLVEAALVSKISSPSDKKIPAKKESCPNTGRDKDHLLKYNVGDLVWSKVSGYPWWPCMVSADPLLHSYTKLKGIFKSKKFEHLKTSQIVLKD

SEQ ID NO: 97823 - protein, 37 aa, Homo sapiens
  Payload ID: 19512
  Gene Name: Wolf-Hirschhorn syndrome candidate 1
  ENSP ID: ENSP00000421551
MEFSIKQSPLSVQSVVKCIKMKQAPEILGSANGKTPS

SEQ ID NO: 97824 - protein, 629 aa, Homo sapiens; identical to SEQ ID NO: 97821
  Payload ID: 19512
  Gene Name: Wolf-Hirschhorn syndrome candidate 1
  Uniprot ID: O96028
  ENSP ID: ENSP00000421681

SEQ ID NO: 97825 - protein, 392 aa, Homo sapiens
  Payload ID: 19512
  Gene Name: Wolf-Hirschhorn syndrome candidate 1
  ENSP ID: ENSP00000422878
MEFSIKQSPLSVQSVVKCIKMKQAPEILGSANGKTPSCEVNRECSVFLSKAQLSSSLQEGVMQKFNGHDALPFIPADKLKDLTSRVFNGEPGAHDAKLRFESQEMKGIGTPPNTTPIKNGSPEIKLKITKTYMNGKPLFESSICGDSAADVSQSEENGQKPENKARRNRKRSIKYDSLLEQGLVEAALVSKISSPSDKKIPAKKESCPNTGRDKDHLLKYNVGDLVWSKVSGYPWWPCMVSADPLLHSYTKLKGQKKSARQYHVQFFGDAPERAWIFEKSLVAFEGEGQFEKLCQESAKQAPTKAEKIKLLKPISGKLRAQWEMGIVQAEEAASMSVEERKAKFTFLYVGDQLHLNPQVAKEAGIAAESLGEMAESSGVSEEAAENPKSVRE

SEQ ID NO: 97826 - protein, 1365 aa, Homo sapiens; identical to SEQ ID NO: 97817
  Payload ID: 19512
  Gene Name: Wolf-Hirschhorn syndrome candidate 1
  Uniprot ID: O96028
  ENSP ID: ENSP00000423972

SEQ ID NO: 97827 - protein, 163 aa, Homo sapiens
  Payload ID: 19512
  Gene Name: Wolf-Hirschhorn syndrome candidate 1
  ENSP ID: ENSP00000424482
SSAETLESHPDIGKSTPQKTAEADPRRGVGSPPGRKKTTVSMPRSRKGDAASQFLVFCQKHRDEVVAEHPDASGEEIEELLRSQWSLLSEKQRARYNTKFALVAPVQAEEDSGNVNGKKRNHTKRIQDPTEDAEAEDTPRKRLRTDKHSLRKQRKICLMHVNH

SEQ ID NO: 97828 - protein, 284 aa, Homo sapiens
  Payload ID: 19512
  Gene Name: Wolf-Hirschhorn syndrome candidate 1
  ENSP ID: ENSP00000425094
  MOD_RES (1)..(1): Any amino acid
XNLSDACKPLKKRNRASTAASSALGFSKSSSPSASLTENEVSDSPGDEPSESPYESADETQTEVSVSSKKSERGVTAKKEYVCQLCEKPGSLLLCEGPCCGAFHLACLGLSRRPEGRFTCSECASGCSVIASNSIICTAHFTARKGKRHHAHVNVSWCFVCSKGGSLLCCESCPAAFHPDCLNIEMPDGSWFCNDCRAGKKLHFQDIIWVKLGNYRWWPAEVCHPKNVPPNIQKMKHEIGEFPVFFFGSKDYYWTHQARVFPYMEGDRGSRYQGVRGIGRVFKN

SEQ ID NO: 97829 - protein, 647 aa, Homo sapiens; identical to SEQ ID NO: 97814
  Payload ID: 19512
  Gene Name: Wolf-Hirschhorn syndrome candidate 1
  Uniprot ID: O96028
  ENSP ID: ENSP00000425761

SEQ ID NO: 97830 - protein, 199 aa, Homo sapiens
  Payload ID: 19512
  Gene Name: Wolf-Hirschhorn syndrome candidate 1
  ENSP ID: ENSP00000427434
MEFSIKQSPLSVQSVVKCIKMKQAPEILGSANGKTPSCEVNRECSVFLSKAQLSSSLQEGVMQKFNGHDALPFIPADKLKDLTSRVFNGEPGAHDAKLRFESQEMKGIGTPPNTTPIKNGSPEIKLKITKTYMNGKPLFESSICGDSAADVSQSEENGQKPENKARRNRKRSIKYDSLLEQGLVEAALVSKISSPSDKK

SEQ ID NO: 97831 - protein, 273 aa, Homo sapiens; identical to SEQ ID NO: 97822
  Payload ID: 19512
  Gene Name: Wolf-Hirschhorn syndrome candidate 1
  Uniprot ID: O96028
  ENSP ID: ENSP00000427516

SEQ ID NO: 97832 - protein, 645 aa, Homo sapiens
  Payload ID: 19513
  Gene Name: Wolf-Hirschhorn syndrome candidate 1-like 1
  Uniprot ID: Q9BZ95
  ENSP ID: ENSP00000313410
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGSADRGVQGSVRFSDSSVSAAIEETVD

SEQ ID NO: 97833 - protein, 1437 aa, Homo sapiens
  Payload ID: 19513
  Gene Name: Wolf-Hirschhorn syndrome candidate 1-like 1
  Uniprot ID: Q9BZ95
  ENSP ID: ENSP00000313983
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGASEISDSCKPLKKRSRASTDVEMTSSAYRDTSDSDSRGLSDLQVGFGKQVDSPSATADADVSDVQSMDSSLSRRGTGMSKKDTVCQICESSGDSLIPCEGECCKHFHLECLGLASLPDSKFICMECKTGQHPCFSCKVSGKDVKRCSVGACGKFYHEACVRKFPTAIFESKGFRCPQHCCSACSMEKDIHKASKGRMMRCLRCPVAYHSGDACIAAGSMLVSSYILICSNHSKRSSNSSAVNVGFCFVCARGLIVQDHSDPMFSSYAYKSHYLLNESNRAELMKLPMIPSSSASKKKCEKGGRLLCCESCPASFHPECLSIEMPEGCWNCNDCKAGKKLHYKQIVWVKLGNYRWWPAEICNPRSVPLNIQGLKHDLGDFPVFFFGSHDYYWVHQGRVFPYVEGDKSFAEGQTSINKTFKKALEEAAKRFQELKAQRESKEALEIEKNSRKPPPYKHIKANKVIGKVQIQVADLSEIPRCNCKPADENPCGLESECLNRMLQYECHPQVCPAGDRCQNQCFTKRLYPDAEIIKTERRGWGLRTKRSIKKGEFVNEYVGELIDEEECRLRIKRAHENSVTNFYMLTVTKDRIIDAGPKGNYSRFMNHSCNPNCETQKWTVNGDVRVGLFALCDIPAGMELTFNYNLDCLGNGRTECHCGADNCSGFLGVRPKSACASTNEEKAKNAKLKQKRRKIKTEPKQMHEDYCFQCGDGGELVMCDKKDCPKAYHLLCLNLTQPPYGKWECPWHQCDECSSAAVSFCEFCPHSFCKDHEKGALVPSALEGRLCCSEHDPMAPVSPEYWSKIKCKWESQDHGEEVKE

SEQ ID NO: 97834 - protein, 1388 aa, Homo sapiens
  Payload ID: 19513
  Gene Name: Wolf-Hirschhorn syndrome candidate 1-like 1
  Uniprot ID: Q9BZ95
  ENSP ID: ENSP00000393284
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGASEISDSCKPLKKRSRASTDVEMTSSAYRDTSDSDSRGLSDLQVGFGKQVDSPSATADADVSDVQSMDSSLSRRGTGMSKKDTVCQICESSGDSLIPCEGECCKHFHLECLGLASLPDSKFICMECKTGQHPCFSCKVSGKDVKRCSVGACGKFYHEACVRKFPTAIFESKGFRCPQHCCSACSMEKDIHKASKGRMMRCLRCPVAYHSGDACIAAGSMLVSSYILICSNHSKRSSNSSAVNVGFCFVCARGGRLLCCESCPASFHPECLSIEMPEGCWNCNDCKAGKKLHYKQIVWVKLGNYRWWPAEICNPRSVPLNIQGLKHDLGDFPVFFFGSHDYYWVHQGRVFPYVEGDKSFAEGQTSINKTFKKALEEAAKRFQELKAQRESKEALEIEKNSRKPPPYKHIKANKVIGKVQIQVADLSEIPRCNCKPADENPCGLESECLNRMLQYECHPQVCPAGDRCQNQCFTKRLYPDAEIIKTERRGWGLRTKRSIKKGEFVNEYVGELIDEEECRLRIKRAHENSVTNFYMLTVTKDRIIDAGPKGNYSRFMNHSCNPNCETQKWTVNGDVRVGLFALCDIPAGMELTFNYNLDCLGNGRTECHCGADNCSGFLGVRPKSACASTNEEKAKNAKLKQKRRKIKTEPKQMHEDYCFQCGDGGELVMCDKKDCPKAYHLLCLNLTQPPYGKWECPWHQCDECSSAAVSFCEFCPHSFCKDHEKGALVPSALEGRLCCSEHDPMAPVSPEYWSKIKCKWESQDHGEEVKE

SEQ ID NO: 97835 - protein, 15 aa, Homo sapiens
  Payload ID: 19513
  Gene Name: Wolf-Hirschhorn syndrome candidate 1-like 1
  ENSP ID: ENSP00000431598
MDFSFSFMQGIMGNT

SEQ ID NO: 97836 - protein, 25 aa, Homo sapiens
  Payload ID: 19513
  Gene Name: Wolf-Hirschhorn syndrome candidate 1-like 1
  ENSP ID: ENSP00000432544
MDFSFSFMQGIMGNTIQQPPQLIDS

SEQ ID NO: 97837 - protein, 1426 aa, Homo sapiens
  Payload ID: 19513
  Gene Name: Wolf-Hirschhorn syndrome candidate 1-like 1
  Uniprot ID: Q9BZ95
  ENSP ID: ENSP00000434730
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGASEISDSCKPLKKRSRASTDVEMTSSAYRDTSDSDSRGLSDLQVGFGKQVDSPSATADADVSDVQSMDSSLSRRGTGMSKKDTVCQICESSGDSLIPCEGECCKHFHLECLGLASLPDSKFICMECKTGQHPCFSCKVSGKDVKRCSVGACGKFYHEACVRKFPTAIFESKGFRCPQHCCSACSMEKDIHKASKGRMMRCLRCPVAYHSGDACIAAGSMLVSSYILICSNHSKRSSNSSAVNVGFCFVCARGLIVQDHSDPMFSSYAYKSHYLLNESNRAELMKLPMIPSSSASKKKCEKGGRLLCCESCPASFHPECLSIEMPEGCWNCNDCKAGKKLHYKQIVWVKLGNYRWWPAEICNPRSVPLNIQGLKHDLGDFPVFFFGSHDYYWVHQGRVFPYVEGDKSFAEGQTSINKTFKKALEEAAKRFQELKAQRESKEALEIEKNSRKPPPYKHIKANKVIGKVQIQVADLSEIPRCNCKPADENPCGLESECLNRMLQYECHPQVCPAGDRCQNQCFTKRLYPDAEIIKTERRGWGLRTKRSIKKGEFVNEYVGELIDEEECRLRIKRAHENSDRIIDAGPKGNYSRFMNHSCNPNCETQKWTVNGDVRVGLFALCDIPAGMELTFNYNLDCLGNGRTECHCGADNCSGFLGVRPKSACASTNEEKAKNAKLKQKRRKIKTEPKQMHEDYCFQCGDGGELVMCDKKDCPKAYHLLCLNLTQPPYGKWECPWHQCDECSSAAVSFCEFCPHSFCKDHEKGALVPSALEGRLCCSEHDPMAPVSPEYWSKIKCKWESQDHGEEVKE

SEQ ID NO: 97838 - protein, 77 aa, Homo sapiens
  Payload ID: 19513
  Gene Name: Wolf-Hirschhorn syndrome candidate 1-like 1
  ENSP ID: ENSP00000435073
ISVRGQDRLIISTPNQRNEKPTQSVSSPEATSGSTGSVEKKQQRRSIRTRSESEKSTEVVPKKKIKKEQVGFLHVES

SEQ ID NO: 97839 - protein, 282 aa, Homo sapiens
  Payload ID: 19513
  Gene Name: Wolf-Hirschhorn syndrome candidate 1-like 1
  ENSP ID: ENSP00000435422
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYP

SEQ ID NO: 97840 - protein, 890 aa, Homo sapiens
  Payload ID: 19514
  Gene Name: Wolfram syndrome 1 (wolframin)
  Uniprot ID: O76024
  ENSP ID: ENSP00000226760
MDSNTAPLGPSCPQPPPAPQPQARSRLNATASLEQERSERPRAPGPQAGPGPGVRDAAAPAEPQAQHTRSRERADGTGPTKGDMEIPFEEVLERAKAGDPKAQTEVGKHYLQLAGDTDEELNSCTAVDWLVLAAKQGRREAVKLLRRCLADRRGITSENEREVRQLSSETDLERAVRKAALVMYWKLNPKKKKQVAVAELLENVGQVNEHDGGAQPGPVPKSLQKQRRMLERLVSSESKNYIALDDFVEITKKYAKGVIPSSLFLQDDEDDDELAGKSPEDLPLRLKVVKYPLHAIMEIKEYLIDMASRAGMHWLSTIIPTHHINALIFFFIVSNLTIDFFAFFIPLVIFYLSFISMVICTLKVFQDSKAWENFRTLTDLLLRFEPNLDVEQAEVNFGWNHLEPYAHFLLSVFFVIFSFPIASKDCIPCSELAVITGFFTVTSYLSLSTHAEPYTRRALATEVTAGLLSLLPSMPLNWPYLKVLGQTFITVPVGHLVVLNVSVPCLLYVYLLYLFFRMAQLRNFKGTYCYLVPYLVCFMWCELSVVILLESTGLGLLRASIGYFLFLFALPILVAGLALVGVLQFARWFTSLELTKIAVTVAVCSVPLLLRWWTKASFSVVGMVKSLTRSSMVKLILVWLTAIVLFCWFYVYRSEGMKVYNSTLTWQQYGALCGPRAWKETNMARTQILCSHLEGHRVTWTGRFKYVRVTDIDNSAESAINMLPFFIGDWMRCLYGEAYPACSPGNTSTAEEELCRLKLLAKHPCHIKKFDRYKFEITVGMPFSSGADGSRSREEDDVTKDIVLRASSEFKSVLLSLRQGSLIEFSTILEGRLGSKWPVFELKAISCLNCMAQLSPTRRHVKIEHDWRSTVHGAVKFAFDFFFFPFLSAA

SEQ ID NO: 97841 - protein, 890 aa, Homo sapiens; identical to SEQ ID NO: 97840
  Payload ID: 19514
  Gene Name: Wolfram syndrome 1 (wolframin)
  Uniprot ID: O76024
  ENSP ID: ENSP00000423337

SEQ ID NO: 97842 - protein, 252 aa, Homo sapiens
  Payload ID: 19514
  Gene Name: Wolfram syndrome 1 (wolframin)
  ENSP ID: ENSP00000424103
  MOD_RES (1)..(1): Any amino acid
XQGRREAVKLLRRCLADRRGITSENEREVRQLSSETDLERAVRKAALVMYWKLNPKKKKQVAVAELLENVGQVNEHDGGAQPGPVPKSLQKQRRMLERLVSSELWGAHAVFSHASAKNYIALDDFVEITKKYAKGVIPSSLFLQDDEDDDELAGKSPEDLPLRLKVVKYPLHAIMEIKEYLIDMASRAGMHWLSTIIPTHHINALIFFFIVSNLTIDFFAFFIPLVIFYLSFISMVICTLKVFQDSKAWENF

SEQ ID NO: 97843 - protein, 575 aa, Homo sapiens
  Payload ID: 19515
  Gene Name: WSC domain containing 1
  Uniprot ID: Q658N2
  ENSP ID: ENSP00000323087
MAKPFFRLQKFLRRTQFLLFFLTAAYLMTGSLLLLQRVRVALPQGPRAPGPLQTLPVAAVALGVGLLDSRALHDPRVSPELLLGVDMLQSPLTRPRPGPRWLRSRNSELRQLRRRWFHHFMSDSQGPPALGPEAARPAIHSRGTYIGCFSDDGHERTLKGAVFYDLRKMTVSHCQDACAERSYVYAGLEAGAECYCGNRLPAVSVGLEECNHECKGEKGSVCGAVDRLSVYRVDELQPGSRKRRTATYRGCFRLPENITHAFPSSLIQANVTVGTCSGFCSQKEFPLAILRGWECYCAYPTPRFNLRDAMDSSVCGQDPEAQRLAEYCEVYQTPVQDTRCTDRRFLPNKSKVFVALSSFPGAGNTWARHLIEHATGFYTGSYYFDGTLYNKGFKGEKDHWRSRRTICVKTHESGRREIEMFDSAILLIRNPYRSLVAEFNRKCAGHLGYAADRNWKSKEWPDFVNSYASWWSSHVLDWLKYGKRLLVVHYEELRRSLVPTLREMVAFLNVSVSEERLLCVENNKEGSFRRRGRRSHDPEPFTPEMKDLINGYIRTVDQALRDHNWTGLPREYVPR

SEQ ID NO: 97844 - protein, 575 aa, Homo sapiens; identical to SEQ ID NO: 97843
  Payload ID: 19515
  Gene Name: WSC domain containing 1
  Uniprot ID: Q658N2
  ENSP ID: ENSP00000446032

SEQ ID NO: 97845 - protein, 136 aa, Homo sapiens
  Payload ID: 19515
  Gene Name: WSC domain containing 1
  ENSP ID: ENSP00000458339
  MOD_RES (1)..(1): Any amino acid
XGSLLLLQRVRVALPQGPRAPGPLQTLPVAAVALGVGLLDSRALHDPRVSPELLLGVDMLQSPLTRPRPGPRWLRSRNSELRQLRRRWFHHFMSDSQGPPALGPEAARPAIHSRGPMSTPAWRPGRSVTAGTGCQR

SEQ ID NO: 97846 - protein, 575 aa, Homo sapiens; identical to SEQ ID NO: 97843
  Payload ID: 19515
  Gene Name: WSC domain containing 1
  Uniprot ID: Q658N2
  ENSP ID: ENSP00000458374

SEQ ID NO: 97847 - protein, 87 aa, Homo sapiens
  Payload ID: 19515
  Gene Name: WSC domain containing 1
  ENSP ID: ENSP00000458527
MAKPFFRLQKFLRRTQFLLFFLTAAYLMTGSLLLLQRVRVALPQGPRAPGPLQTLPVAAVALGVGLLDSRALHDPRVSPELLLGVDM

SEQ ID NO: 97848 - protein, 180 aa, Homo sapiens
  Payload ID: 19515
  Gene Name: WSC domain containing 1
  ENSP ID: ENSP00000460041
MAKPFFRLQKFLRRTQFLLFFLTAAYLMTGSLLLLQRVRVALPQGPRAPGPLQTLPVAAVALGVGLLDSRALHDPRVSPELLLGVDMLQSPLTRPRPGPRWLRSRNSELRQLRRRWFHHFMSDSQGPPALGPEAARPAIHSRGTYIGCFSDDGHERTLKGAVFYDLRKMTVSHCQDACAE

SEQ ID NO: 97849 - protein, 459 aa, Homo sapiens
  Payload ID: 19515
  Gene Name: WSC domain containing 1
  ENSP ID: ENSP00000460396
MAEQGRCCDLAALGEQGGAPPWEKSLGTYIGCFSDDGHERTLKGAVFYDLRKMTVSHCQDACAERSYVYAGLEAGAECYCGNRLPAVSVGLEECNHECKGEKGSVCGAVDRLSVYRVDELQPGSRKRRTATYRGCFRLPENITHAFPSSLIQANVTVGTCSGFCSQKEFPLAILRGWECYCAYPTPRFNLRDAMDSSVCGQDPEAQRLAEYCEVYQTPVQDTRCTDRRFLPNKSKVFVALSSFPGAGNTWARHLIEHATGFYTGSYYFDGTLYNKGFKGEKDHWRSRRTICVKTHESGRREIEMFDSAILLIRNPYRSLVAEFNRKCAGHLGYAADRNWKSKEWPDFVNSYASWWSSHVLDWLKYGKRLLVVHYEELRRSLVPTLREMVAFLNVSVSEERLLCVENNKEGSFRRRGRRSHDPEPFTPEMKDLINGYIRTVDQALRDHNWTGLPREYVPR

SEQ ID NO: 97850 - protein, 26 aa, Homo sapiens
  Payload ID: 19515
  Gene Name: WSC domain containing 1
  ENSP ID: ENSP00000460428
MTVSHCQDACAERSYVYAGLEAGAEC

SEQ ID NO: 97851 - protein, 575 aa, Homo sapiens; identical to SEQ ID NO: 97843
  Payload ID: 19515
  Gene Name: WSC domain containing 1
  Uniprot ID: Q658N2
  ENSP ID: ENSP00000460825

SEQ ID NO: 97852 - protein, 45 aa, Homo sapiens
  Payload ID: 19515
  Gene Name: WSC domain containing 1
  ENSP ID: ENSP00000461642
MAKPFFRLQKFLRRTQFLLFFLTAAYLMTGSLLLLQRVRVALPQG

SEQ ID NO: 97853 - protein, 44 aa, Homo sapiens
  Payload ID: 19515
  Gene Name: WSC domain containing 1
  ENSP ID: ENSP00000461865
MAKPFFRLQKFLRRTQFLLFFLTAAYLMTGSLLLLQRVRVALPQ

SEQ ID NO: 97854 - protein, 565 aa, Homo sapiens
  Payload ID: 19516
  Gene Name: WSC domain containing 2
  Uniprot ID: Q2TBF2
  ENSP ID: ENSP00000331933
MAKLWFKFQRYFRRKPVRFFTFLALYLTAGSLVFLHSGFVGQPAVSGNQANPAAAGGPAEGAELSFLGDMHLGRGFRDTGEASSIARRYGPWFKGKDGNERAKLGDYGGAWSRALKGRVVREKEEERAKYIGCYLDDTQSRALRGVSFFDYKKMTIFRCQDNCAERGYLYGGLEFGAECYCGHKIQATNVSEAECDMECKGERGSVCGGANRLSVYRLQLAQESARRYGSAVFRGCFRRPDNLSLALPVTAAMLNMSVDKCVDFCTEKEYPLAALAGTACHCGFPTTRFPLHDREDEQLCAQKCSAEEFESCGTPSYFIVYQTQVQDNRCMDRRFLPGKSKQLIALASFPGAGNTWARHLIELATGFYTGSYYFDGSLYNKGFKGERDHWRSGRTICIKTHESGQKEIEAFDAAILLIRNPYKALMAEFNRKYGGHIGFAAHAHWKGKEWPEFVRNYAPWWATHTLDWLKFGKKVLVVHFEDLKQDLFVQLGRMVSLLGVAVREDRLLCVESQKDGNFKRSGLRKLEYDPYTADMQKTISAYIKMVDAALKGRNLTGVPDDYYPR

SEQ ID NO: 97855 - protein, 123 aa, Homo sapiens
  Payload ID: 19516
  Gene Name: WSC domain containing 2
  ENSP ID: ENSP00000446744
MTIFRCQDNCAERGYLYGGLEFGAECYCGHKIQATNVSEAECDMECKGERGSVCGGANRLSVYRLQLAQESARRYGSAVFRGCFRRPDNLSLALPVTAAMLNMSVDKCVDFCTEKEYPLAALA

SEQ ID NO: 97856 - protein, 585 aa, Homo sapiens
  Payload ID: 19516
  Gene Name: WSC domain containing 2
  Uniprot ID: Q2TBF2
  ENSP ID: ENSP00000447272
MAKLWFKFQRYFRRKPVRFFTFLALYLTAGSLVFLHSGFVGQPAVSGNQANPAAAGGPAEGAELSFLGDMHLGRGFRDTGEASSIARRYGPWFKGKDGNERAKLGDYGGAWSRALKGRVVREKEEERAKYIGCYLDDTQSRALRGVSFFDYKKMTIFRCQDNCAERGYLYGGLEFGAECYCGHKIQATNVSEAECDMECKGERGSVCGGANRLSVYRLQLAQESARRYGSAVFRGCFRRPDNLSLALPVTAAMLNMSVDKCVDFCTEKEYPLAALAGTACHCGFPTTRFPLHDREDEQLCAQKCSAEEFESCGTPSYFIVYQTQVQDNRCMDRRFLPGKSKQLIALASFPGAGNTWARHLIELATGFYTGSYYFDGSLYNKGFKGERDHWRSGRTICIKTHESGQKEIEAFDAAILLIRNPYKALMAEFNRKYGGHIGFAAHAHWKGKGAVPGSLQILFRSICTASVGEWPEFVRNYAPWWATHTLDWLKFGKKVLVVHFEDLKQDLFVQLGRMVSLLGVAVREDRLLCVESQKDGNFKRSGLRKLEYDPYTADMQKTISAYIKMVDAALKGRNLTGVPDDYYPR

SEQ ID NO: 97857 - protein, 565 aa, Homo sapiens; identical to SEQ ID NO: 97854
  Payload ID: 19516
  Gene Name: WSC domain containing 2
  Uniprot ID: Q2TBF2
  ENSP ID: ENSP00000448047

SEQ ID NO: 97858 - protein, 1113 aa, Homo sapiens
  Payload ID: 19517
  Gene Name: WW and C2 domain containing 1
  Uniprot ID: Q8IX03
  ENSP ID: ENSP00000265293
MPRPELPLPEGWEEARDFDGKVYYIDHTNRTTSWIDPRDRYTKPLTFADCISDELPLGWEEAYDPQVGDYFIDHNTKTTQIEDPRVQWRREQEHMLKDYLVVAQEALSAQKEIYQVKQQRLELAQQEYQQLHAVWEHKLGSQVSLVSGSSSSSKYDPEILKAEIATAKSRVNKLKREMVHLQHELQFKERGFQTLKKIDKKMSDAQGSYKLDEAQAVLRETKAIKKAITCGEKEKQDLIKSLAMLKDGFRTDRGSHSDLWSSSSSLESSSFPLPKQYLDVSSQTDISGSFGINSNNQLAEKVRLRLRYEEAKRRIANLKIQLAKLDSEAWPGVLDSERDRLILINEKEELLKEMRFISPRKWTQGEVEQLEMARKRLEKDLQAARDTQSKALTERLKLNSKRNQLVRELEEATRQVATLHSQLKSLSSSMQSLSSGSSPGSLTSSRGSLVASSLDSSTSASFTDLYYDPFEQLDSELQSKVEFLLLEGATGFRPSGCITTIHEDEVAKTQKAEGGGRLQALRSLSGTPKSMTSLSPRSSLSSPSPPCSPLMADPLLAGDAFLNSLEFEDPELSATLCELSLGNSAQERYRLEEPGTEGKQLGQAVNTAQGCGLKVACVSAAVSDESVAGDSGVYEASVQRLGASEAAAFDSDESEAVGATRIQIALKYDEKNKQFAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTDAVSALLEQTAVELEKRQEGRSSTQTLEDSWRYEETSENEAVAEEEEEEVEEEEGEEDVFTEKASPDMDGYPALKVDKETNTETPAPSPTVVRPKDRRVGTPSQGPFLRGSTIIRSKTFSPGPQSQYVCRLNRSDSDSSTLSKKPPFVRNSLERRSVRMKRPSSVKSLRSERLIRTSLDLELDLQATRTWHSQLTQEISVLKELKEQLEQAKSHGEKELPQWLREDERFRLLLRMLEKRQMDRAEHKGELQTDKMMRAAAKDVHRLRGQSCKEPPEVQSFREKMAFFTRPRMNIPALSADDV

SEQ ID NO: 97859 - protein, 1080 aa, Homo sapiens
  Payload ID: 19517
  Gene Name: WW and C2 domain containing 1
  ENSP ID: ENSP00000377473
  MOD_RES (1)..(1): Any amino acid
XRYTKPLTFADCISDELPLGWEEAYDPQVGDYFIDHNTKTTQIEDPRVQWRREQEHMLKDYLVVAQEALSAQKEIYQVKQQRLELAQQEYQQLHAVWEHKLGSQVSLVSGSSSSSKYDPEILKAEIATAKSRVNKLKREMVHLQHELQFKERGFQTLKKIDKKMSDAQGSYKLDEAQAVLRETKAIKKAITCGEKEKQDLIKSLAMLKDGFRTDRGSHSDLWSSSSSLESSSFPLPKQYLDVSSQTDISGSFGINSNNQLAEKVRLRLRYEEAKRRIANLKIQLAKLDSEAWPGVLDSERDRLILINEKEELLKEMRFISPRKWTQGEVEQLEMARKRLEKDLQAARDTQSKALTERLKLNSKRNQLVRELEEATRQVATLHSQLKSLSSSMQSLSSGSSPGSLTSSRGSLVASSLDSSTSASFTDLYYDPFEQLDSELQSKVEFLLLEGATGFRPSGCITTIHEDEVAKTQKAEGGGRLQALRSLSGTPKSMTSLSPRSSLSSPSPPCSPLMADPLLAGDAFLNSLEFEDPELSATLCELSLGNSAQERYRLEEPGTEGKQLGQAVNTAQGCGLKVACVSAAVSDESVAGDSGVYEASVQRLGASEAAAFDSDESEAVGATRIQIALKYDEKNKQFAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTDAVSALLEQTAVELEKRQEGRSSTQTLEDSWRYEETSENEAVAEEEEEEVEEEEGEEDVFTEKASPDMDGYPALKVDKETNTETPAPSPTVVRPKDRRVGTPSQGPFLRGSTIIRSKTFSPGPQSQYVCRLNRSDSDSSTLSKKPPFVRNSLERRSVRMKRPSPPPQPSSVKSLRSERLIRTSLDLELDLQATRTWHSQLTQEISVLKELKEQLEQAKSHGEKELPQWLREDERFRLLLRMLEKRMDRAEHKGELQTDKMMRAAAKDVHRLRGQSCKEPPEVQSFREKMAFFTRPRMNIPALSADDV

SEQ ID NO: 97860 - protein, 1119 aa, Homo sapiens
  Payload ID: 19517
  Gene Name: WW and C2 domain containing 1
  Uniprot ID: Q8IX03
  ENSP ID: ENSP00000427772
MPRPELPLPEGWEEARDFDGKVYYIDHTNRTTSWIDPRDRYTKPLTFADCISDELPLGWEEAYDPQVGDYFIDHNTKTTQIEDPRVQWRREQEHMLKDYLVVAQEALSAQKEIYQVKQQRLELAQQEYQQLHAVWEHKLGSQVSLVSGSSSSSKYDPEILKAEIATAKSRVNKLKREMVHLQHELQFKERGFQTLKKIDKKMSDAQGSYKLDEAQAVLRETKAIKKAITCGEKEKQDLIKSLAMLKDGFRTDRGSHSDLWSSSSSLESSSFPLPKQYLDVSSQTDISGSFGINSNNQLAEKVRLRLRYEEAKRRIANLKIQLAKLDSEAWPGVLDSERDRLILINEKEELLKEMRFISPRKWTQGEVEQLEMARKRLEKDLQAARDTQSKALTERLKLNSKRNQLVRELEEATRQVATLHSQLKSLSSSMQSLSSGSSPGSLTSSRGSLVASSLDSSTSASFTDLYYDPFEQLDSELQSKVEFLLLEGATGFRPSGCITTIHEDEVAKTQKAEGGGRLQALRSLSGTPKSMTSLSPRSSLSSPSPPCSPLMADPLLAGDAFLNSLEFEDPELSATLCELSLGNSAQERYRLEEPGTEGKQLGQAVNTAQGCGLKVACVSAAVSDESVAGDSGVYEASVQRLGASEAAAFDSDESEAVGATRIQIALKYDEKNKQFAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTDAVSALLEQTAVELEKRQEGRSSTQTLEDSWRYEETSENEAVAEEEEEEVEEEEGEEDVFTEKASPDMDGYPALKVDKETNTETPAPSPTVVRPKDRRVGTPSQGPFLRGSTIIRSKTFSPGPQSQYVCRLNRSDSDSSTLSKKPPFVRNSLERRSVRMKRPSPPPQPSSVKSLRSERLIRTSLDLELDLQATRTWHSQLTQEISVLKELKEQLEQAKSHGEKELPQWLREDERFRLLLRMLEKRQMDRAEHKGELQTDKMMRAAAKDVHRLRGQSCKEPPEVQSFREKMAFFTRPRMNIPALSADDV

SEQ ID NO: 97861 - protein, 444 aa, Homo sapiens
  Payload ID: 19517
  Gene Name: WW and C2 domain containing 1
  ENSP ID: ENSP00000428084
FAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTDAVSALLEQTAVELEKRQEGRSSTQTLEDSWRYEETSENEAVAEEEEEEVEEEEGEEDVFTEKASPDMDGYPALKVDKETNTETPAPSPTVVRPKDRRVGTPSQGPFLRGSTIIRSKTFSPGPQSQYVCRLNRSDSDSSTLSKKPPFVRNSLERRSVRMKRPSPPPQPSSVKSLRSERLIRTSLDLELDLQATRTWHSQLTQEISVLKELKEQLEQAKSHGEKELPQWLREDERFRLLLRMLEKRMDRAEHKGELQTDKMMRAAAKDVHRLRGQSCKEPPEVQSFREKMAFFTRPRMNIPALSADDV

SEQ ID NO: 97862 - protein, 889 aa, Homo sapiens
  Payload ID: 19517
  Gene Name: WW and C2 domain containing 1
  ENSP ID: ENSP00000429339
  MOD_RES (1)..(1): Any amino acid
XKKAITCGEKEKQDLIKSLAMLKDGFRTDRGSHSDLWSSSSSLESSSFPLPKQYLDVSSQTDISGSFGINSNNQLAEKVRLRLRYEEAKRRIANLKIQLAKLDSEAWPGVLDSERDRLILINEKEELLKEMRFISPRKWTQGEVEQLEMARKRLEKDLQAARDTQSKALTERLKLNSKRNQLVRELEEATRQVATLHSQLKSLSSSMQSLSSGSSPGSLTSSRGSLVASSLDSSTSASFTDLYYDPFEQLDSELQSKVEFLLLEGATGFRPSGCITTIHEDEVAKTQKAEGGGRLQALRSLSGTPKSMTSLSPRSSLSSPSPPCSPLMADPLLAGDAFLNSLEFEDPELSATLCELSLGNSAQERYRLEEPGTEGKQLGQAVNTAQGCGLKVACVSAAVSDESVAGDSGVYEASVQRLGASEAAAFDSDESEAVGATRIQIALKYDEKNKQFAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTDAVSALLEQTAVELEKRQEGRSSTQTLEDSWRYEETSENEAVAEEEEEEVEEEEGEEDVFTEKASPDMDGYPALKVDKETNTETPAPSPTVVRPKDRRVGTPSQGPFLRGSTIIRSKTFSPGPQSQYVCRLNRSDSDSSTLSKKPPFVRNSLERRSVRMKRPSSVKSLRSERLIRTSLDLELDLQATRTWHSQLTQEISVLKELKEQLEQAKSHGEKELPQWLREDERFRLLLRMLEKRMDRAEHKGELQTDKMMRAAAKDVHRLRGQSCKEPPEVQSFREKMAFFTRPRMNIPALSADDV

SEQ ID NO: 97863 - protein, 337 aa, Homo sapiens
  Payload ID: 19517
  Gene Name: WW and C2 domain containing 1
  ENSP ID: ENSP00000483898
MSYPALHQKTLRVDVCTTDRSHLEECLGGAQISLAEVCRSGERSTRWYNLLSYKYLKKQSRELKPVGVMAPASGPASTVSWDQDAVSALLEQTAVELEKRQEGRSSTQTLEDSWRYEETSENEAVAEEEEEEVEEEEGEEDVFTEKASPDMDGYPALKVDKETNTETPAPSPTVVRPKDRRVGTPSQGPFLRGSTIIRSKTFSPGPQSQYVCRLNRSDSDSSTLSKKPPFVRNSLERRSVRMKRPSSVKSLRSERLIRTSLDLELDLQATRTWHSQLTQEISVLKELKEQLEQAKSHGEKELPQWLREDERFRLLLRMLEKRQMDRAEHKGELQTTR

SEQ ID NO: 97864 - protein, 1192 aa, Homo sapiens
  Payload ID: 19518
  Gene Name: WW and C2 domain containing 2
  Uniprot ID: Q6AWC2
  ENSP ID: ENSP00000384222
MPRRAGSGQLPLPRGWEEARDYDGKVFYIDHNTRRTSWIDPRDRLTKPLSFADCVGDELPWGWEAGFDPQIGVYYIDHINKTTQIEDPRKQWRGEQEKMLKDYLSVAQDALRTQKELYHVKEQRLALALDEYVRLNDAYKEKSSSHTSLFSGSSSSTKYDPDILKAEISTTRLRVKKLKRELSQMKQELLYKEQGFETLQQIDKKMSGGQSGYELSEAKAILTELKSIRKAISSGEKEKQDLMQSLAKLQERFHLDQNIGRSEPDLRCSPVNSHLCLSRQTLDAGSQTSISGDIGVRSRSNLAEKVRLSLQYEEAKRSMANLKIELSKLDSEAWPGALDIEKEKLMLINEKEELLKELQFVTPQKRTQDELERLEAERQRLEEELLSVRGTPSRALAERLRLEERRKELLQKLEETTKLTTYLHSQLKSLSASTLSMSSGSSLGSLASSRGSLNTSSRGSLNSLSSTELYYSSQSDQIDVDYQYKLDFLLQEKSGYIPSGPITTIHENEVVKSPSQPGQSGLCGVAAAATGHTPPLAEAPKSVASLSSRSSLSSLSPPGSPLVLEGTFPMSSSHDASLHQFTADFEDCELSSHFADISLIENQILLDSDSGGASQSLSEDKDLNECAREPLYEGTADVEKSLPKRRVIHLLGEKTTCVSAAVSDESVAGDSGVYEAFVKQPSEMEDVTYSEEDVAIVETAQVQIGLRYNAKSSSFMVIIAQLRNLHAFLIPHTSKVYFRVAVLPSSTDVSCLFRTKVHPPTESILFNDVFRVAISQTALQQKTLRVDLCSVSKHRREECLAGTQISLADLPFSSEVFTLWYNLLPSKQMPCKKNEENEDSVFQPNQPLVDSIDLDAVSALLARTSAELLAVEQELAQEEEEESGQEEPRGPDGDWLTMLREASDEIVAEKEAEVKLPEDSSCTEDLSSCTSVPEMNEDGNRKESNCAKDLRSQPPTRIPTLVDKETNTDEAANDNMAVRPKERSSLSSRQHPFVRSSVIVRSQTFSPGERNQYICRLNRSDSDSSTLAKKSLFVRNSTERRSLRVKRTVCQSVLRRTTQECPVRTSLDLELDLQASLTRQSRLNDELQALRDLRQKLEELKAQGETDLPPGVLEDERFQRLLKQAEKQAEQSKEEQKQGLNAEKLMRQVSKDVCRLREQSQKVPRQVQSFREKIAYFTRAKISIPSLPADDV

SEQ ID NO: 97865 - protein, 77 aa, Homo sapiens
  Payload ID: 19518
  Gene Name: WW and C2 domain containing 2
  ENSP ID: ENSP00000393342
MLKDYLSVAQDALRTQKELYHVKEQRLALALDEYVRLNDAYKEKSSSHTSLFSGSSSSTKYDPDILKAEISTTRLRN

SEQ ID NO: 97866 - protein, 1216 aa, Homo sapiens
  Payload ID: 19518
  Gene Name: WW and C2 domain containing 2
  Uniprot ID: Q6AWC2
  ENSP ID: ENSP00000398577
MPRRAGSGQLPLPRGWEEARDYDGKVFYIDHNTRRTSWIDPRDRLTKPLSFADCVGDELPWGWEAGFDPQIGVYYIDHINKTTQIEDPRKQWRGEQEKMLKDYLSVAQDALRTQKELYHVKEQRLALALDEYVRLNDAYKEKSSSHTSLFSGSSSSTKYDPDILKAEISTTRLRVKKLKRELSQMKQELLYKEQGFETLQQIDKKMSGGQSGYELSEAKAILTELKSIRKAISSGEKEKQDLMQSLAKLQERFHLDQNIGRSEPDLRCSPVNSHLCLSRQTLDAGSQTSISGDIGVRSRSNLAEKVRLSLQYEEAKRSMANLKIELSKLDSEAWPGALDIEKEKLMLINEKEELLKELQFVTPQKRTQDELERLEAERQRLEEELLSVRGTPSRALAERLRLEERRKELLQKLEETTKLTTYLHSQLKSLSASTLSMSSGSSLGSLASSRGSLNTSSRGSLNSLSSTELYYSSQSDQIDVDYQYKLDFLLQEKSGYIPSGPITTIHENEVVKSPSQPGQSGLCGVAAAATGHTPPLAEAPKSVASLSSRSSLSSLSPPGSPLVLEGTFPMSSSHDASLHQFTADFEDCELSSHFADISLIENQILLDSDSGGASQSLSEDKDLNECAREPLYEGTADVEKSLPKRRVIHLLGEKTTCVSAAVSDESVAGDSGVYEAFVKQPSEMEDVTYSEEDVAIVETAQVQIGLRYNAKSSSFMVIIAQLRNLHAFLIPHTSKVYFRVAVLPSSTDVSCLFRTKVHPPTESILFNDVFRVAISQTALQQKTLRVDLCSVSKHRREECLAGTQISLADLPFSSEVFTLWYNLLPSKQMPCKKNEENEDSVFQPNQPLVDSIDLDAVSALLARTSAELLAVEQELAQEEEEESGQEEPRGPDGDWLNTYFLCCWELKDDVFTRLTVKPLLTMLREASDEIVAEKEAEVKLPEDSSCTEDLSSCTSVPEMNEDGNRKESNCAKDLRSQPPTRIPTLVDKETNTDEAANDNMAVRPKERSSLSSRQHPFVRSSVIVRSQTFSPGERNQYICRLNRSDSDSSTLAKKSLFVRNSTERRSLRVKRTVCQSVLRRTTQECPVRTSLDLELDLQASLTRQSRLNDELQALRDLRQKLEELKAQGETDLPPGVLEDERFQRLLKQAEKQAEQSKEEQKQGLNAEKLMRQVSKDVCRLREQSQKVPRQVQSFREKIAYFTRAKISIPSLPADDV

SEQ ID NO: 97867 - protein, 712 aa, Homo sapiens
  Payload ID: 19518
  Gene Name: WW and C2 domain containing 2
  Uniprot ID: Q6AWC2
  ENSP ID: ENSP00000413521
MLKDYLSVAQDALRTQKELYHVKEQRLALALDEYVRLNDAYKEKSSSHTSLFSGSSSSTKYDPDILKAEISTTRLRVKKLKRELSQMKQELLYKEQGFETLQQIDKKMSGGQSGYELSEAKAILTELKSIRKAISSGEKEKQDLMQSLAKLQERFHLDQNIGRSEPDLRCSPVNSHLCLSRQTLDAGSQTSISGDIGVRSRSNLAEKVRLSLQYEEAKRSMANLKIELSKLDSEAWPGALDIEKEKLMLINEKEELLKELQFVTPQKRTQDELERLEAERQRLEEELLSVRGTPSRALAERLRLEERRKELLQKLEETTKLTTYLHSQLKSLSASTLSMSSGSSLGSLASSRGSLNTSSRGSLNSLSSTELYYSSQSDQIDVDYQYKLDFLLQEKSGYIPSGPITTIHENEVVKSPSQPGQSGLCGVAAAATGHTPPLAEAPKSVASLSSRSSLSSLSPPGSPLVLEGTFPMSSSHDASLHQFTADFEDCELSSHFADISLIENQILLDSDSGGASQSLSEDKDLNECAREPLYEGTADVEKSLPKRRVIHLLGEKTTCVSAAVSDESVAGDSGVYEAFVKQPSEMEDVTYSEEDVAIVETAQVQIGLRYNAKSSSFMVIIAQLRNLHAFLIPHTSKVYFRVAVLPSSTDVSCLFRTKVHPPTESILFNDVFRVAISQTALQQKTLRKNFTFVTAITHGVCLPLPVPMPSFA

SEQ ID NO: 97868 - protein, 320 aa, Homo sapiens
  Payload ID: 19518
  Gene Name: WW and C2 domain containing 2
  Uniprot ID: Q6AWC2
  ENSP ID: ENSP00000420835
MPRLRVHGACLPTKSVLFLFYHRLTMLREASDEIVAEKEAEVKLPEDSSCTEDLSSCTSVPEMNEDGNRKESNCAKDLRSQPPTRIPTLVDKETNTDEAANDNMAVRPKERSSLSSRQHPFVRSSVIVRSQTFSPGERNQYICRLNRSDSDSSTLAKKSLFVRNSTERRSLRVKRTVCQSVLRRTTQECPVRTSLDLELDLQASLTRQSRLNDELQALRDLRQKLEELKAQGETDLPPGVLEDERFQRLLKQAEKQAEQSKEEQKQGLNAEKLMRQVSKDVCRLREQSQKVPRQVQSFREKIAYFTRAKISIPSLPADDV

SEQ ID NO: 97869 - protein, 81 aa, Homo sapiens
  Payload ID: 19518
  Gene Name: WW and C2 domain containing 2
  ENSP ID: ENSP00000423238
MPRRAGSGQLPLPRGWEEARDYDGKVFYIDHNTRRTSWIDPRDRLTKPLSFADCVGDELPWGWEAGFDPQIGVYYIDHINS

SEQ ID NO: 97870 - protein, 1143 aa, Homo sapiens
  Payload ID: 19518
  Gene Name: WW and C2 domain containing 2
  Uniprot ID: Q6AWC2
  ENSP ID: ENSP00000425054
MPRRAGSGQLPLPRGWEEARDYDGKVFYIDHNTRRTSWIDPRDRLTKPLSFADCVGDELPWGWEAGFDPQIGVYYIDHINKTTQIEDPRKQWRGEQEKMLKDYLSVAQDALRTQKELYHVKEQRLALALDEYVRLNDAYKEKSSSHTSLFSGSSSSTKYDPDILKAEISTTRLRVKKLKRELSQMKQELLYKEQGFETLQQIDKKMSGGQSGYELSEAKAILTELKSIRKAISSGEKEKQDLMQSLAKLQERFHLDQNIGRSEPDLRCSPVNSHLCLSRQTLDAGSQTSISGDIGVRSRSNLAEKVRLSLQYEEAKRSMANLKIELSKLDSEAWPGALDIEKEKLMLINEKEELLKELQFVTPQKRTQDELERLEAERQRLEEELLSVRGTPSRALAERLRLEERRKELLQKLEETTKLTTYLHSQLKSLSASTLSMSSGSSLGSLASSRGSLNTSSRGSLNSLSSTELYYSSQSDQIDVDYQYKLDFLLQEKSGYIPSGPITTIHENEVVKSPSQPGQSGLCGVAAAATGHTPPLAEAPKSVASLSSRSSLSSLSPPGSPLVLEGTFPMSSSHDASLHQFTADFEDYVEKSLPKRRVIHLLGEKTTCVSAAVSDESVAGDSGVYEAFVKQPSEMEDVTYSEEDVAIVETAQVQIGLRYNAKSSSFMVIIAQLRNLHAFLIPHTSKVYFRVAVLPSSTDVSCLFRTKVHPPTESILFNDVFRVAISQTALQQKTLRVDLCSVSKHRREECLAGTQISLADLPFSSEVFTLWYNLLPSKQMPCKKNEENEDSVFQPNQPLVDSIDLDAVSALLARTSAELLAVEQELAQEEEEESGQEEPRGPDGDWLTMLREASDEIVAEKEAEVKLPEDSSCTEDLSSCTSVPEMNEDGNRKESNCAKDLRSQPPTRIPTLVDKETNTDEAANDNMAVRPKERSSLSSRQHPFVRSSVIVRSQTFSPGERNQYICRLNRSDSDSSTLAKKSLFVRNSTERRSLRVKRTVCQSVLRRTTQECPVRTSLDLELDLQASLTRQSRLNDELQALRDLRQKLEELKAQGETDLPPGVLEDERFQRLLKQAEKQAEQSKEEQKQGLNAEKLMRQVSKDVCRLREQSQKVPRQVQSFREKIAYFTRAKISIPSLPADDV

SEQ ID NO: 97871 - protein, 874 aa, Homo sapiens
  Payload ID: 19518
  Gene Name: WW and C2 domain containing 2
  Uniprot ID: Q6AWC2
  ENSP ID: ENSP00000427569
MANLKIELSKLDSEAWPGALDIEKEKLMLINEKEELLKELQFVTPQKRTQDELERLEAERQRLEEELLSVRGTPSRALAERLRLEERRKELLQKLEETTKLTTYLHSQLKSLSASTLSMSSGSSLGSLASSRGSLNTSSRGSLNSLSSTELYYSSQSDQIDVDYQYKLDFLLQEKSGYIPSGPITTIHENEVVKSPSQPGQSGLCGVAAAATGHTPPLAEAPKSVASLSSRSSLSSLSPPGSPLVLEGTFPMSSSHDASLHQFTADFEDCELSSHFADISLIENQILLDSDSGGASQSLSEDKDLNECAREPLYEGTADVEKSLPKRRVIHLLGEKTTCVSAAVSDESVAGDSGVYEAFVKQPSEMEDVTYSEEDVAIVETAQVQIGLRYNAKSSSFMVIIAQLRNLHAFLIPHTSKVYFRVAVLPSSTDVSCLFRTKVHPPTESILFNDVFRVAISQTALQQKTLRVDLCSVSKHRREECLAGTQISLADLPFSSEVFTLWYNLLPSKQMPCKKNEENEDSVFQPNQPLVDSIDLDAVSALLARTSAELLAVEQELAQEEEEESGQEEPRGPDGDWLTMLREASDEIVAEKEAEVKLPEDSSCTEDLSSCTSVPEMNEDGNRKESNCAKDLRSQPPTRIPTLVDKETNTDEAANDNMAVRPKERSSLSSRQHPFVRSSVIVRSQTFSPGERNQYICRLNRSDSDSSTLAKKSLFVRNSTERRSLRVKRTVCQSVLRRTTQECPVRTSLDLELDLQASLTRQSRLNDELQALRDLRQKLEELKAQGETDLPPGVLEDERFQRLLKQAEKQAEQSKEEQKQGLNAEKLMRQVSKDVCRLREQSQKVPRQVQSFREKIAYFTRAKISIPSLPADDV

SEQ ID NO: 97872 - protein, 269 aa, Homo sapiens
  Payload ID: 19519
  Gene Name: WW domain binding protein 1
  Uniprot ID: Q96G27
  ENSP ID: ENSP00000233615
MARASSGNGSEEAWGALRAPQQQLRELCPGVNNQPYLCESGHCCGETGCCTYYYELWWFWLLWTVLILFSCCCAFRHRRAKLRLQQQQRQREINLLAYHGACHGAGPFPTGSLLDLRFLSTFKPPAYEDVVHRPGTPPPPYTVAPGRPLTASSEQTCCSSSSSCPAHFEGTNVEGVSSHQSAPPHQEGEPGAGVTPASTPPSCRYRRLTGDSGIELCPCPASGEGEPVKEVRVSATLPDLEDYSPCALPPESVPQIFPMGLSSSEGDIP

SEQ ID NO: 97873 - protein, 303 aa, Homo sapiens
  Payload ID: 19519
  Gene Name: WW domain binding protein 1
  ENSP ID: ENSP00000377542
MARASSGNGSEEAWGALRAPQQQSPAASSLEGAIWRRAGTQTRALDAILYHPQQSHLLRELCPGVNNQPYLCESGHCCGETGCCTYYYELWWFWLLWTVLILFSCCCAFRHRRAKLRLQQQQRQREINLLAYHGACHGAGPFPTGSLLDLRFLSTFKPPAYEDVVHRPGTPPPPYTVAPGRPLTASSEQTCCSSSSSCPAHFEGTNVEGVSSHQSAPPHQEGEPGAGVTPASTPPSCRYRRLTGDSGIELCPCPASGEGEPVKEVRVSATLPDLEDYSPCALPPESVPQIFPMGLSSSEGDIP

SEQ ID NO: 97874 - protein, 266 aa, Homo sapiens
  Payload ID: 19519
  Gene Name: WW domain binding protein 1
  ENSP ID: ENSP00000386812
MARASSGNGSEEAWGALRAPQQQLCPGVNNQPYLCESGHCCGETGCCTYYYELWWFWLLWTVLILFSCCCAFRHRRAKLRLQQQQRQREINLLAYHGACHGAGPFPTGSLLDLRFLSTFKPPAYEDVVHRPGTPPPPYTVAPGRPLTASSEQTCCSSSSSCPAHFEGTNVEGVSSHQSAPPHQEGEPGAGVTPASTPPSCRYRRLTGDSGIELCPCPASGEGEPVKEVRVSATLPDLEDYSPCALPPESVPQIFPMGLSSSEGDIP

SEQ ID NO: 97875 - protein, 249 aa, Homo sapiens
  Payload ID: 19519
  Gene Name: WW domain binding protein 1
  ENSP ID: ENSP00000408816
MAAVEACGGSPVTRGIVRSQGGSLCLATVICDLFLCAYCHNRVRQRLLLREQFGEELEPRLAPWMPSFIIHSNPIWLGALLWLRELCPGVNNQPYLCESGHCCGETGCCTYYYELWWFWLLWTVLILFSCCCAFRHRRAKLRLQQQQRQREINLLAYHGACHGAGPFPTGSLLDLRFLSTFKPPAYEDVVHRPGTPPPPYTVAPGRPLTASSEQTCCSSSSSCPAHFEGTNVEGVSSHQSAPPHQEGEP

SEQ ID NO: 97876 - protein, 641 aa, Homo sapiens
  Payload ID: 19520
  Gene Name: WW domain binding protein 11
  Uniprot ID: Q9Y2W2
  ENSP ID: ENSP00000261167
MGRRSTSSTKSGKFMNPTDQARKEARKRELKKNKKQRMMVRAAVLKMKDPKQIIRDMEKLDEMEFNPVQQPQLNEKVLKDKRKKLRETFERILRLYEKENPDIYKELRKLEVEYEQKRAQLSQYFDAVKNAQHVEVESIPLPDMPHAPSNILIQDIPLPGAQPPSILKKTSAYGPPTRAVSILPLLGHGVPRLPPGRKPPGPPPGPPPPQVVQMYGRKVGFALDLPPRRRDEDMLYSPELAQRGHDDDVSSTSEDDGYPEDMDQDKHDDSTDDSDTDKSDGESDGDEFVHRDNGERDNNEEKKSGLSVRFADMPGKSRKKKKNMKELTPLQAMMLRMAGQEIPEEGREVEEFSEDDDEDDSDDSEAEKQSQKQHKEESHSDGTSTASSQQQAPPQSVPPSQIQAPPMPGPPPLGPPPAPPLRPPGPPTGLPPGPPPGAPPFLRPPGMPGLRGPLPRLLPPGPPPGRPPGPPPGPPPGLPPGPPPRGPPPRLPPPAPPGIPPPRPGMMRPPLVPPLGPAPPGLFPPAPLPNPGVLSAPPNLIQRPKADDTSAATIEKKATATISAKPQITNPKAEITRFVPTALRVRRENKGATAAPQRKSEDDSAVPLAKAAPKSGPSVPVSVQTKDDVYEAFMKEMEGLL

SEQ ID NO: 97877 - protein, 53 aa, Homo sapiens
  Payload ID: 19520
  Gene Name: WW domain binding protein 11
  ENSP ID: ENSP00000440988
MGRRSTSSTKSGKFMNPTDQARKEARKRELKKNKKQRMMVRAAVLKMKDPKQI

SEQ ID NO: 97878 - protein, 194 aa, Homo sapiens
  Payload ID: 19520
  Gene Name: WW domain binding protein 11
  ENSP ID: ENSP00000443420
MGRRSTSSTKSGKFMNPTDQARKEARKRELKKNKKQRMMVRAAVLKMKDPKQIIRDMEKLDEMEFNPVQQPQLNEKVLKDKRKKLRETFERILRLYEKENPDIYKELRKLEVEYEQKRAQLSQYFDAVKPSEVMMMMFLAPVKMMAILRTWIKISMMTVLMTVTPTNQMEKVTGMNLCTVIMVRETTMKKRSQV

SEQ ID NO: 97879 - protein, 342 aa, Homo sapiens
  Payload ID: 19521
  Gene Name: WW domain binding protein 1-like
  Uniprot ID: Q9NX94
  ENSP ID: ENSP00000358905
MPFLLGLRQDKEACVGTNNQSYICDTGHCCGQSQCCNYYYELWWFWLVWTIIIILSCCCVCHHRRAKHRLQAQQRQHEINLIAYREAHNYSALPFYFRFLPNYLLPPYEEVVNRPPTPPPPYSAFQLQQQQLLPPQCGPAGGSPPGIDPTRGSQGAQSSPLSEPSRSSTRPPSIADPDPSDLPVDRAATKAPGMEPSGSVAGLGELDPGAFLDKDAECREELLKDDSSEHGAPDSKEKTPGRHRRFTGDSGIEVCVCNRGHHDDDLKEFNTLIDDALDGPLDFCDSCHVRPPGDEEEGLCQSSEEQAREPGHPHLPRPPACLLLNTINEQDSPNSQSSSSPS

SEQ ID NO: 97880 - protein, 363 aa, Homo sapiens
  Payload ID: 19521
  Gene Name: WW domain binding protein 1-like
  Uniprot ID: Q9NX94
  ENSP ID: ENSP00000414721
MERRRLLGGMALLLLQALPSPLSARAEPPQDKEACVGTNNQSYICDTGHCCGQSQCCNYYYELWWFWLVWTIIIILSCCCVCHHRRAKHRLQAQQRQHEINLIAYREAHNYSALPFYFRFLPNYLLPPYEEVVNRPPTPPPPYSAFQLQQQQLLPPQCGPAGGSPPGIDPTRGSQGAQSSPLSEPSRSSTRPPSIADPDPSDLPVDRAATKAPGMEPSGSVAGLGELDPGAFLDKDAECREELLKDDSSEHGAPDSKEKTPGRHRRFTGDSGIEVCVCNRGHHDDDLKEFNTLIDDALDGPLDFCDSCHVRPPGDEEEGLCQSSEEQAREPGHPHLPRPPACLLLNTINEQDSPNSQSSSSPS

SEQ ID NO: 97881 - protein, 261 aa, Homo sapiens
  Payload ID: 19522
  Gene Name: WW domain binding protein 2
  Uniprot ID: Q969T9
  ENSP ID: ENSP00000254806
MALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQASRGEVPSGAYGYSYMPSGAYVYPPPVANGMYPCPPGYPYPPPPPEFYPGPPMMDGAMGYVQPPPPPYPGPMEPPVSGPDVPSTPAAEAKAAEAAASAYYNPGNPHNVYMPTSQPPPPPYYPPEDKKTQ

SEQ ID NO: 97882 - protein, 216 aa, Homo sapiens
  Payload ID: 19522
  Gene Name: WW domain binding protein 2
  ENSP ID: ENSP00000415251
MALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQEFYPGPPMMDGAMGYVQPPPPPYPGPMEPPVSGPDVPSTPAAEAKAAEAAASAYYNPGNPHNVYMPTSQPPPPPYYPPEDKKTQ

SEQ ID NO: 97883 - protein, 167 aa, Homo sapiens
  Payload ID: 19522
  Gene Name: WW domain binding protein 2
  ENSP ID: ENSP00000464768
MSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQASRGEVPSGAYGYSYMPSGAYVYPPPVANGMYPCPPGYPYPPPPPEFYPGPPMMDGA

SEQ ID NO: 97884 - protein, 205 aa, Homo sapiens
  Payload ID: 19522
  Gene Name: WW domain binding protein 2
  ENSP ID: ENSP00000464782
  MOD_RES (1)..(1): Any amino acid
XGWEGSASYKLTFTAGGAIEFGQRMLQVASQASRGEVPSGAYGYSYMPSGAYVYPPPVANGMYPCPPGYPYPPPPPEFYPGPPMMDGAMGYVQPPPPPYPGPMEPPVSGPDVPSTPAAEAKAAEAAASAYYNPGNPHNVYMPTSQPPPPPYYPPEDKKTQRSFLTGTRECMSVHLVAAGWGREQGPLTLCAGRDLPPAPQPASSP

SEQ ID NO: 97885 - protein, 114 aa, Homo sapiens
  Payload ID: 19522
  Gene Name: WW domain binding protein 2
  ENSP ID: ENSP00000464820
MKDCEIKQPVFGANYIKGTVKAEAGGGWEGSASYKLTFTAGGAIEFGQRMLQVASQASRGEVPSGAYGYSYMPSGAYVYPPPVANGMYPCPPGYPYPPPPPGPPMMDGAMGYVQ

SEQ ID NO: 97886 - protein, 35 aa, Homo sapiens
  Payload ID: 19522
  Gene Name: WW domain binding protein 2
  ENSP ID: ENSP00000465052
MALNKNHSEGGGVIVNNTERLEKQTSKNRTSITRT

SEQ ID NO: 97887 - protein, 257 aa, Homo sapiens
  Payload ID: 19522
  Gene Name: WW domain binding protein 2
  ENSP ID: ENSP00000466450
MALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQASRGEVPSGAYGYSYMPSGAYVYPPPVANGMYPCPPGYPYPPPPPGPPMMDGAMGYVQPPPPPYPGPMEPPVSGPDVPSTPAAEAKAAEAAASAYYNPGNPHNVYMPTSQPPPPPYYPPEDKKTQ

SEQ ID NO: 97888 - protein, 231 aa, Homo sapiens
  Payload ID: 19522
  Gene Name: WW domain binding protein 2
  ENSP ID: ENSP00000466999
MALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQASRGEVPSGAYGYSYMPSGAYVYPPPVANGMYPCPPGYPYPPPPPEFYPGPPMMDGAMGYVQPPPPPYPGPMEPPVSGPDVPSTPAEPAAATSLLPTGR

SEQ ID NO: 97889 - protein, 261 aa, Homo sapiens; identical to SEQ ID NO: 97881
  Payload ID: 19522
  Gene Name: WW domain binding protein 2
  Uniprot ID: Q969T9
  ENSP ID: ENSP00000467579

SEQ ID NO: 97890 - protein, 239 aa, Homo sapiens
  Payload ID: 19522
  Gene Name: WW domain binding protein 2
  ENSP ID: ENSP00000467583
MSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQASRGEVPSGAYGYSYMPSGAYVYPPPVANGMYPCPPGYPYPPPPPEFYPGPPMMDGAMGYVQPPPPPYPGPMEPPVSGPDVPSTPAAEAKAAEAAASAYYNPGNPHNVYMPTSQPPPPPYYPPEDKKTQ

SEQ ID NO: 97891 - protein, 152 aa, Homo sapiens
  Payload ID: 19522
  Gene Name: WW domain binding protein 2
  ENSP ID: ENSP00000468793
MQSFMMPFYLMKDCEIKQPVFGANYIKGTVKAEAGGGWEGSASYKLTFTAGGAIEFGQRMLQVASQASRGEVPSGAYGYSYMPSGAYVYPPPVANGMYPCPPGYPYPPPPPEFYPGPPMMDGAMGYVQPPPPPYPGPMEPPVSGPDVPSTPA

SEQ ID NO: 97892 - protein, 231 aa, Homo sapiens; identical to SEQ ID NO: 97888
  Payload ID: 19522
  Gene Name: WW domain binding protein 2
  ENSP ID: ENSP00000486675

SEQ ID NO: 97893 - protein, 376 aa, Homo sapiens
  Payload ID: 19523
  Gene Name: WW domain binding protein 4
  Uniprot ID: O75554
  ENSP ID: ENSP00000368801
MADYWKSQPKKFCDYCKCWIADNRPSVEFHERGKNHKENVAKRISEIKQKSLDKAKEEEKASKEFAAMEAAALKAYQEDLKRLGLESEILEPSITPVTSTIPPTSTSNQQKEKKEKKKRKKDPSKGRWVEGITSEGYHYYYDLISGASQWEKPEGFQGDLKKTAVKTVWVEGLSEDGFTYYYNTETGESRWEKPDDFIPHTSDLPSSKVNENSLGTLDESKSSDSHSDSDGEQEAEEGGVSTETEKPKIKFKEKNKNSDGGSDPETQKEKSIQKQNSLGSNEEKSKTLKKSNPYGEWQEIKQEVESHEEVDLELPSTENEYVSTSEADGGGEPKVVFKEKTVTSLGVMADGVAPVFKKRRTENGKSRNLRQRGDDQ

SEQ ID NO: 97894 - protein, 104 aa, Homo sapiens
  Payload ID: 19524
  Gene Name: WW domain binding protein 5
  Uniprot ID: Q9UHQ7
  ENSP ID: ENSP00000361740
MKSCQKMEGKPENESEPKHEEEPKPEEKPEEEEKLEEEAKAKGTFRERLIQSLQEFKEDIHNRHLSNEDMFREVDEIDEIRRVRNKLIVMRWKVNRNHPYPYLM

SEQ ID NO: 97895 - protein, 104 aa, Homo sapiens; identical to SEQ ID NO: 97894
  Payload ID: 19524
  Gene Name: WW domain binding protein 5
  Uniprot ID: Q9UHQ7
  ENSP ID: ENSP00000361745

SEQ ID NO: 97896 - protein, 544 aa, Homo sapiens
  Payload ID: 19525
  Gene Name: WW domain containing adaptor with coiled-coil
  Uniprot ID: Q9BTA9
  ENSP ID: ENSP00000311106
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGKSTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKVSTPVVKQGPVSQSATQQPVTADKQQGHEPVSPRSLQRSSSQRSPSPGPNHTSNSSNASNATVVPQNSSARSTCSLTPALAAHFSENLIKHVQGWPADHAEKQASRLREEAHNMGTIHMSEICTELKNLRSLVRVCEIQATLREQRILFLRQQIKELEKLKNQNSFMV

SEQ ID NO: 97897 - protein, 647 aa, Homo sapiens
  Payload ID: 19525
  Gene Name: WW domain containing adaptor with coiled-coil
  Uniprot ID: Q9BTA9
  ENSP ID: ENSP00000346986
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKKSFDANGASTLSKLPTPTSSVPAQKTERKESTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKVSTPVVKQGPVSQSATQQPVTADKQQGHEPVSPRSLQRSSSQRSPSPGPNHTSNSSNASNATVVPQNSSARSTCSLTPALAAHFSENLIKHVQGWPADHAEKQASRLREEAHNMGTIHMSEICTELKNLRSLVRVCEIQATLREQRILFLRQQIKELEKLKNQNSFMV

SEQ ID NO: 97898 - protein, 495 aa, Homo sapiens
  Payload ID: 19525
  Gene Name: WW domain containing adaptor with coiled-coil
  ENSP ID: ENSP00000364797
MRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGKSTSGDKPVSHSCTTPSTSSASGLNPTSAPPTSASAVPVSPVPQSPIPPLLQDPNLLRQLLPALQATLQLNNSNVDISKINEAVTQASLQSIIHKFLTAGPSAFNITSLISQAAQLSTQAQPSNQSPMSLTSDASSPRSYVSPRISTPQTNTVPIKPLISTPPVSSQPKVSTPVVKQGPVSQSATQQPVTADKQQGHEPVSPRSLQRSSSQRSPSPGPNHTSNSSNASNATVVPQNSSARSTCSLTPALAAHFSENLIKHVQGWPADHAEKQASRLREEAHNMGTIHMSEICTELKNLRSLVRVCEIQATLREQRILFLRQQIKELEKLKNQNSFMV

SEQ ID NO: 97899 - protein, 602 aa, Homo sapiens
  Payload ID: 19525
  Gene Name: WW domain containing adaptor with coiled-coil
  Uniprot ID: Q9BTA9
  ENSP ID: ENSP00000364816
MRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKKSFDANGASTLSKLPTPTSSVPAQKTERKESTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKVSTPVVKQGPVSQSATQQPVTADKQQGHEPVSPRSLQRSSSQRSPSPGPNHTSNSSNASNATVVPQNSSARSTCSLTPALAAHFSENLIKHVQGWPADHAEKQASRLREEAHNMGTIHMSEICTELKNLRSLVRVCEIQATLREQRILFLRQQIKELEKLKNQNSFMV

SEQ ID NO: 97900 - protein, 59 aa, Homo sapiens
  Payload ID: 19525
  Gene Name: WW domain containing adaptor with coiled-coil
  ENSP ID: ENSP00000395008
MRDAGDPSPPNKMLRRSDSPENKYSDSTGHSKAKNVHTHRVRERDGGTSYSPQENSHNH

SEQ ID NO: 97901 - protein, 148 aa, Homo sapiens
  Payload ID: 19525
  Gene Name: WW domain containing adaptor with coiled-coil
  ENSP ID: ENSP00000399706
MKRCETPEILHHQIKCCGDLIVLKTNTVTAQVTVRPKMCILTELERGMVGPVTLHKKIHTTTVLFIVQIHILLIQAITQAKLQMHLMILQMTGLSILALLGKSTTTIVEQKFHNGKNQKSGLKENRDKKKQTRWQSTASQKIGITEER

SEQ ID NO: 97902 - protein, 173 aa, Homo sapiens
  Payload ID: 19525
  Gene Name: WW domain containing adaptor with coiled-coil
  ENSP ID: ENSP00000400848
MRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQ

SEQ ID NO: 97903 - protein, 34 aa, Homo sapiens
  Payload ID: 19525
  Gene Name: WW domain containing adaptor with coiled-coil
  ENSP ID: ENSP00000404125
MVMYARKQQRLSDGCHDRRGDSQPYQVTGGSSLI

SEQ ID NO: 97904 - protein, 204 aa, Homo sapiens
  Payload ID: 19525
  Gene Name: WW domain containing adaptor with coiled-coil
  ENSP ID: ENSP00000404758
MRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHP

SEQ ID NO: 97905 - protein, 233 aa, Homo sapiens
  Payload ID: 19525
  Gene Name: WW domain containing adaptor with coiled-coil
  ENSP ID: ENSP00000415645
MRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKK

SEQ ID NO: 97906 - protein, 436 aa, Homo sapiens
  Payload ID: 19525
  Gene Name: WW domain containing adaptor with coiled-coil
  Uniprot ID: Q9BTA9
  ENSP ID: ENSP00000415727
MRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKKSFDANGASTLSKLPTPTSSVPAQKTERKESTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQDIPLHEGIQMERDTHRSKWEVKGSLCQKADKQQECLVWNGSIMVQRLLQPSG

SEQ ID NO: 97907 - protein, 36 aa, Homo sapiens
  Payload ID: 19525
  Gene Name: WW domain containing adaptor with coiled-coil
  ENSP ID: ENSP00000434903
MRDAGDPSPPNKMLRRSDSPENKYSDSTGHSKAKNV

SEQ ID NO: 97908 - protein, 148 aa, Homo sapiens; identical to SEQ ID NO: 97901
  Payload ID: 19525
  Gene Name: WW domain containing adaptor with coiled-coil
  ENSP ID: ENSP00000486994

SEQ ID NO: 97909 - protein, 922 aa, Homo sapiens
  Payload ID: 19526
  Gene Name: WW domain containing E3 ubiquitin protein ligase 1
  Uniprot ID: Q9H0M0
  ENSP ID: ENSP00000265428
MATASPRSDTSNNHSGRLQLQVTVSSAKLKRKKNWFGTAIYTEVVVDGEITKTAKSSSSSNPKWDEQLTVNVTPQTTLEFQVWSHRTLKADALLGKATIDLKQALLIHNRKLERVKEQLKLSLENKNGIAQTGELTVVLDGLVIEQENITNCSSSPTIEIQENGDALHENGEPSARTTARLAVEGTNGIDNHVPTSTLVQNSCCSYVVNGDNTPSSPSQVAARPKNTPAPKPLASEPADDTVNGESSSFAPTDNASVTGTPVVSEENALSPNCTSTTVEDPPVQEILTSSENNECIPSTSAELESEARSILEPDTSNSRSSSAFEAAKSRQPDGCMDPVRQQSGNANTETLPSGWEQRKDPHGRTYYVDHNTRTTTWERPQPLPPGWERRVDDRRRVYYVDHNTRTTTWQRPTMESVRNFEQWQSQRNQLQGAMQQFNQRYLYSASMLAAENDPYGPLPPGWEKRVDSTDRVYFVNHNTKTTQWEDPRTQGLQNEEPLPEGWEIRYTREGVRYFVDHNTRTTTFKDPRNGKSSVTKGGPQIAYERGFRWKLAHFRYLCQSNALPSHVKINVSRQTLFEDSFQQIMALKPYDLRRRLYVIFRGEEGLDYGGLAREWFFLLSHEVLNPMYCLFEYAGKNNYCLQINPASTINPDHLSYFCFIGRFIAMALFHGKFIDTGFSLPFYKRMLSKKLTIKDLESIDTEFYNSLIWIRDNNIEECGLEMYFSVDMEILGKVTSHDLKLGGSNILVTEENKDEYIGLMTEWRFSRGVQEQTKAFLDGFNEVVPLQWLQYFDEKELEVMLCGMQEVDLADWQRNTVYRHYTRNSKQIIWFWQFVKETDNEVRMRLLQFVTGTCRLPLGGFAELMGSNGPQKFCIEKVGKDTWLPRSHTCFNRLDLPPYKSYEQLKEKLLFAIEETEGFGQE

SEQ ID NO: 97910 - protein, 922 aa, Homo sapiens; identical to SEQ ID NO: 97909
  Payload ID: 19526
  Gene Name: WW domain containing E3 ubiquitin protein ligase 1
  Uniprot ID: Q9H0M0
  ENSP ID: ENSP00000427793

SEQ ID NO: 97911 - protein, 232 aa, Homo sapiens
  Payload ID: 19526
  Gene Name: WW domain containing E3 ubiquitin protein ligase 1
  ENSP ID: ENSP00000429076
  MOD_RES (1)..(1): Any amino acid
XGGPQIAYERGFRWKLAHFRYLCQSNALPSHVKINVSRQTLFEDSFQQIMALKPYDLRRRLYVIFRGEEGLDYGGLARNILRSSLMSGKFSSIMSLNIFSVPFVPFFFRNISHGEWFFLLSHEVLNPMYCLFEYAGKNNYCLQINPASTINPDHLSYFCFIGRFIAMALFHGKFIDTGFSLPFYKRMLSKKLTIKDLESIDTEFYNSLIWIRDNNIEECGLEMYFSVDMEIL

SEQ ID NO: 97912 - protein, 55 aa, Homo sapiens
  Payload ID: 19526
  Gene Name: WW domain containing E3 ubiquitin protein ligase 1
  ENSP ID: ENSP00000430228
VKETDNEVRMRLLQFVTGTCRLPLGGFAELMGSNGPQKFCIEKVGKDTWLPRSHT

SEQ ID NO: 97913 - protein, 754 aa, Homo sapiens
  Payload ID: 19527
  Gene Name: WW domain containing E3 ubiquitin protein ligase 2
  Uniprot ID: O00308
  ENSP ID: ENSP00000348283
MQLTLNLQTENKGSVVSGGELTIFLDGPTVDLGNVPNGSALTDGSQLPSRDSSGTAVAPENRHQPPSTNCFGGRSRTHRHSGASARTTPATGEQSPGARSRHRQPVKNSGHSGLANGTVNDEPTTATDPEEPSVVGVTSPPAAPLSVTPNPNTTSLPAPATPAEGEEPSTSGTQQLPAAAQAPDALPAGWEQRELPNGRVYYVDHNTKTTTWERPLPPGWEKRTDPRGRFYYVDHNTRTTTWQRPTAEYVRNYEQWQSQRNQLQGAMQHFSQRFLYQSSSASTDHDPLGPLPPGWEKRQDNGRVYYVNHNTRTTQWEDPRTQGMIQEPALPPGWEMKYTSEGVRYFVDHNTRTTTFKDPRPGFESGTKQGSPGAYDRSFRWKYHQFRFLCHSNALPSHVKISVSRQTLFEDSFQQIMNMKPYDLRRRLYIIMRGEEGLDYGGIAREWFFLLSHEVLNPMYCLFEYAGKNNYCLQINPASSINPDHLTYFRFIGRFIAMALYHGKFIDTGFTLPFYKRMLNKRPTLKDLESIDPEFYNSIVWIKENNLEECGLELYFIQDMEILGKVTTHELKEGGESIRVTEENKEEYIMLLTDWRFTRGVEEQTKAFLDGFNEVAPLEWLRYFDEKELELMLCGMQEIDMSDWQKSTIYRHYTKNSKQIQWFWQVVKEMDNEKRIRLLQFVTGTCRLPVGGFAELIGSNGPQKFCIDKVGKETWLPRSHTCFNRLDLPPYKSYEQLREKLLYAIEETEGFGQE

SEQ ID NO: 97914 - protein, 870 aa, Homo sapiens
  Payload ID: 19527
  Gene Name: WW domain containing E3 ubiquitin protein ligase 2
  Uniprot ID: O00308
  ENSP ID: ENSP00000352069
MASASSSRAGVALPFEKSQLTLKVVSAKPKVHNRQPRINSYVEVAVDGLPSETKKTGKRIGSSELLWNEIIILNVTAQSHLDLKVWSCHTLRNELLGTASVNLSNVLKNNGGKMENMQLTLNLQTENKGSVVSGGELTIFLDGPTVDLGNVPNGSALTDGSQLPSRDSSGTAVAPENRHQPPSTNCFGGRSRTHRHSGASARTTPATGEQSPGARSRHRQPVKNSGHSGLANGTVNDEPTTATDPEEPSVVGVTSPPAAPLSVTPNPNTTSLPAPATPAEGEEPSTSGTQQLPAAAQAPDALPAGWEQRELPNGRVYYVDHNTKTTTWERPLPPGWEKRTDPRGRFYYVDHNTRTTTWQRPTAEYVRNYEQWQSQRNQLQGAMQHFSQRFLYQSSSASTDHDPLGPLPPGWEKRQDNGRVYYVNHNTRTTQWEDPRTQGMIQEPALPPGWEMKYTSEGVRYFVDHNTRTTTFKDPRPGFESGTKQGSPGAYDRSFRWKYHQFRFLCHSNALPSHVKISVSRQTLFEDSFQQIMNMKPYDLRRRLYIIMRGEEGLDYGGIAREWFFLLSHEVLNPMYCLFEYAGKNNYCLQINPASSINPDHLTYFRFIGRFIAMALYHGKFIDTGFTLPFYKRMLNKRPTLKDLESIDPEFYNSIVWIKENNLEECGLELYFIQDMEILGKVTTHELKEGGESIRVTEENKEEYIMLLTDWRFTRGVEEQTKAFLDGFNEVAPLEWLRYFDEKELELMLCGMQEIDMSDWQKSTIYRHYTKNSKQIQWFWQVVKEMDNEKRIRLLQFVTGTCRLPVGGFAELIGSNGPQKFCIDKVGKETWLPRSHTCFNRLDLPPYKSYEQLREKLLYAIEETEGFGQE

SEQ ID NO: 97915 - protein, 335 aa, Homo sapiens
  Payload ID: 19527
  Gene Name: WW domain containing E3 ubiquitin protein ligase 2
  Uniprot ID: O00308
  ENSP ID: ENSP00000455311
MASASSSRAGVALPFEKSQLTLKVVSAKPKVHNRQPRINSYVEVAVDGLPSETKKTGKRIGSSELLWNEIIILNVTAQSHLDLKVWSCHTLRNELLGTASVNLSNVLKNNGGKMENMQLTLNLQTENKGSVVSGGELTIFLDGPTVDLGNVPNGSALTDGSQLPSRDSSGTAVAPENRHQPPSTNCFGGRSRTHRHSGASARTTPATGEQSPGARSRHRQPVKNSGHSGLANGTVNDEPTTATDPEEPSVVGVTSPPAAPLSVTPNPNTTSLPAPATPAEGEEPSTSGTQQLPAAAQAPDALPAGWEQRELPNGRVYYVDHNTKTTTWERPLPPG

SEQ ID NO: 97916 - protein, 61 aa, Homo sapiens
  Payload ID: 19527
  Gene Name: WW domain containing E3 ubiquitin protein ligase 2
  ENSP ID: ENSP00000455347
MASASSSRAGVALPFEKSQLTLKVVSAKPKVHNRQPRINSYVEVAVDGLPSETKKTGKRIG

SEQ ID NO: 97917 - protein, 431 aa, Homo sapiens
  Payload ID: 19527
  Gene Name: WW domain containing E3 ubiquitin protein ligase 2
  Uniprot ID: O00308
  ENSP ID: ENSP00000456216
MIQEPALPPGWEMKYTSEGVRYFVDHNTRTTTFKDPRPGFESGTKQGSPGAYDRSFRWKYHQFRFLCHSNALPSHVKISVSRQTLFEDSFQQIMNMKPYDLRRRLYIIMRGEEGLDYGGIAREWFFLLSHEVLNPMYCLFEYAGKNNYCLQINPASSINPDHLTYFRFIGRFIAMALYHGKFIDTGFTLPFYKRMLNKRPTLKDLESIDPEFYNSIVWIKENNLEECGLELYFIQDMEILGKVTTHELKEGGESIRVTEENKEEYIMLLTDWRFTRGVEEQTKAFLDGFNEVAPLEWLRYFDEKELELMLCGMQEIDMSDWQKSTIYRHYTKNSKQIQWFWQVVKEMDNEKRIRLLQFVTGTCRLPVGGFAELIGSNGPQKFCIDKVGKETWLPRSHTCFNRLDLPPYKSYEQLREKLLYAIEETEGFGQE

SEQ ID NO: 97918 - protein, 107 aa, Homo sapiens
  Payload ID: 19527
  Gene Name: WW domain containing E3 ubiquitin protein ligase 2
  ENSP ID: ENSP00000456451
MASASSSRAGVALPFEKSQLTLKVVSAKPKVHNRQPRINSYVEVAVDGLPSETKKTGKRIGSSELLWNEIIILNVTAQSHLDLKVWSCHTLRNELLGTASVNLSNVL

SEQ ID NO: 97919 - protein, 116 aa, Homo sapiens
  Payload ID: 19527
  Gene Name: WW domain containing E3 ubiquitin protein ligase 2
  ENSP ID: ENSP00000456582
MASASSSRAGVALPFEKSQLTLKVVSAKPKVHNRQPRINSYVEVAVDGLPSETKKTGKRIGSSELLWNEIIILNVTAQSHLDLKVWSCHTLRNELLGTASVNLSNVLKNNGGKSTF

SEQ ID NO: 97920 - protein, 189 aa, Homo sapiens
  Payload ID: 19528
  Gene Name: WW domain containing oxidoreductase
  Uniprot ID: Q9NZC7
  ENSP ID: ENSP00000348119
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIGFETAKSFALHGAHVILACRNMARASEAVSRILEEWKTKYHPPPEKCRIKIFH

SEQ ID NO: 97921 - protein, 311 aa, Homo sapiens
  Payload ID: 19528
  Gene Name: WW domain containing oxidoreductase
  Uniprot ID: Q9NZC7
  ENSP ID: ENSP00000384238
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIATGSCHHRVLCCCPRTGGSGRDVLQQLLPLHALTRSSERRDGPDPVGAQREADPRTAWQPVRLSGAQSGWAHTPALCVSPHASARAGPLPNVPPTQIRKSKGNKSSHNRVKNLKYQWEAGNSWGKVSLFWGWARHRSLCFLVVACLKVKTCLVCRFRISLEKHQQFSFFYCYRIA

SEQ ID NO: 97922 - protein, 234 aa, Homo sapiens
  Payload ID: 19528
  Gene Name: WW domain containing oxidoreductase
  Uniprot ID: Q9NZC7
  ENSP ID: ENSP00000384495
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIGFETAKSFALHGAHVILACRNMARASEAVSRILEEWQQGAATTVYCAAVPELEGLGGMYFNNCCRCMPSPEAQSEETARTLWALSERLIQERLGSQSG

SEQ ID NO: 97923 - protein, 363 aa, Homo sapiens
  Payload ID: 19528
  Gene Name: WW domain containing oxidoreductase
  Uniprot ID: Q9NZC7
  ENSP ID: ENSP00000386161
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIGFETAKSFALHGAHVILACRNMARASEAVSRILEEWHKAKVEAMTLDLALLRSVQHFAEAFKAKNVPLHVLVCNAATFALPWSLTKDGLETTFQVNHLGHFYLVQLLQDVLCRSAPARVIVVSSESHRFTDINDSLGKLDFSRLSPTKNDYWAMLAYNRSKLCNILFSNELHRRLSPRGVTSNAVHPGNMMYSNIHRSWWVYTLLFTLARPFTKSMVSDCLVEGGHF

SEQ ID NO: 97924 - protein, 213 aa, Homo sapiens
  Payload ID: 19528
  Gene Name: WW domain containing oxidoreductase
  ENSP ID: ENSP00000445210
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIGKASCHVGRILKHTRVEELSLLPTAINRELPPPCTVLLSQNWRVWEGCTSTTAAAACPHQKLRAKRRPGPCGRSARG

SEQ ID NO: 97925 - protein, 45 aa, Homo sapiens
  Payload ID: 19528
  Gene Name: WW domain containing oxidoreductase
  ENSP ID: ENSP00000454331
MAALRYAGLDDTDSEDELPPGWEERTTKDGWVYYAKFAIRMGTRN

SEQ ID NO: 97926 - protein, 36 aa, Homo sapiens
  Payload ID: 19528
  Gene Name: WW domain containing oxidoreductase
  Uniprot ID: Q9NZC7
  ENSP ID: ENSP00000454485
MAALRYAGLDDTDSEDELPPGWEERTTKDGWVYYAK

SEQ ID NO: 97927 - protein, 45 aa, Homo sapiens; identical to SEQ ID NO: 97925
  Payload ID: 19528
  Gene Name: WW domain containing oxidoreductase
  ENSP ID: ENSP00000454788

SEQ ID NO: 97928 - protein, 414 aa, Homo sapiens
  Payload ID: 19528
  Gene Name: WW domain containing oxidoreductase
  Uniprot ID: Q9NZC7
  ENSP ID: ENSP00000457230
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIGFETAKSFALHGAHVILACRNMARASEAVSRILEEWHKAKVEAMTLDLALLRSVQHFAEAFKAKNVPLHVLVCNAATFALPWSLTKDGLETTFQVNHLGHFYLVQLLQDVLCRSAPARVIVVSSESHRFTDINDSLGKLDFSRLSPTKNDYWAMLAYNRSKLCNILFSNELHRRLSPRGVTSNAVHPGNMMYSNIHRSWWVYTLLFTLARPFTKSMQQGAATTVYCAAVPELEGLGGMYFNNCCRCMPSPEAQSEETARTLWALSERLIQERLGSQSG

SEQ ID NO: 97929 - protein, 150 aa, Homo sapiens
  Payload ID: 19528
  Gene Name: WW domain containing oxidoreductase
  ENSP ID: ENSP00000482648
PLHVLVCNAATFALPWSLTKDGLETTFQVNHLGHFYLVQLLQDVLCRSAPARVIVVSSESHRFTDINDSLGKLDFSRLSPTKNDYWAMLAYNRSKLCNILFSNELHRRLSPRGVTSNAVHPGNMMYSNIHRSWWVYTLLFTLARPFTKSM

SEQ ID NO: 97930 - protein, 45 aa, Homo sapiens; identical to SEQ ID NO: 97925
  Payload ID: 19528
  Gene Name: WW domain containing oxidoreductase
  ENSP ID: ENSP00000485925

SEQ ID NO: 97931 - protein, 400 aa, Homo sapiens
  Payload ID: 19529
  Gene Name: WW domain containing transcription regulator 1
  Uniprot ID: Q9GZV5
  ENSP ID: ENSP00000353847
MNPASAPPPLPPPGQQVIHVTQDLDTDLEALFNSVMNPKPSSWRKKILPESFFKEPDSGSHSRQSSTDSSGGHPGPRLAGGAQHVRSHSSPASLQLGTGAGAAGSPAQQHAHLRQQSYDVTDELPLPPGWEMTFTATGQRYFLNHIEKITTWQDPRKAMNQPLNHMNLHPAVSSTPVPQRSMAVSQPNLVMNHQHQQQMAPSTLSQQNHPTQNPPAGLMSMPNALTTQQQQQQKLRLQRIQMERERIRMRQEELMRQEAALCRQLPMEAETLAPVQAAVNPPTMTPDMRSITNNSSDPFLNGGPYHSREQSTDSGLGLGCYSVPTTPEDFLSNVDEMDTGENAGQTPMNINPQQTRFPDFLDCLPGTNVDLGTLESEDLIPLFNDVESALNKSEPFLTWL

SEQ ID NO: 97932 - protein, 247 aa, Homo sapiens
  Payload ID: 19529
  Gene Name: WW domain containing transcription regulator 1
  ENSP ID: ENSP00000417339
MLHIEKITTWQDPRKAMNQPLNHMNLHPAVSSTPVPQRSMAVSQPNLVMNHQHQQQMAPSTLSQQNHPTQNPPAGLMSMPNALTTQQQQQQKLRLQRIQMERERIRMRQEELMRQEAALCRQLPMEAETLAPVQAAVNPPTMTPDMRSITNNSSDPFLNGGPYHSREQSTDSGLGLGCYSVPTTPEDFLSNVDEMDTGENAGQTPMNINPQQTRFPDFLDCLPGTNVDLGTLESEDLIPLFNDVESA

SEQ ID NO: 97933 - protein, 29 aa, Homo sapiens
  Payload ID: 19529
  Gene Name: WW domain containing transcription regulator 1
  ENSP ID: ENSP00000417862
  MOD_RES (1)..(1): Any amino acid
XMLILGGCGTWGVVLHHRSCPLSTAPHGS

SEQ ID NO: 97934 - protein, 21 aa, Homo sapiens
  Payload ID: 19529
  Gene Name: WW domain containing transcription regulator 1
  ENSP ID: ENSP00000417984
MNPASAPPPLPPPGQQVIHVT

SEQ ID NO: 97935 - protein, 189 aa, Homo sapiens
  Payload ID: 19529
  Gene Name: WW domain containing transcription regulator 1
  ENSP ID: ENSP00000418580
MNPASAPPPLPPPGQQVIHVTQDLDTDLEALFNSVMNPKPSSWRKKILPESFFKEPDSGSHSRQSSTDSSGGHPGPRLAGGAQHVRSHSSPASLQLGTGAGAAGSPAQQHAHLRQQSYDVTDELPLPPGWEMTFTATGQRYFLNHIEKITTWQDPRKAMNQPLNHMNLHPAVSSTPVPQRSMAVSQPNL

SEQ ID NO: 97936 - protein, 42 aa, Homo sapiens
  Payload ID: 19529
  Gene Name: WW domain containing transcription regulator 1
  ENSP ID: ENSP00000418621
  MOD_RES (1)..(1): Any amino acid
XHSRELSWRKGPSMLGKLPSVDSSPWKLRLLPQFRLLSTHPR

SEQ ID NO: 97937 - protein, 400 aa, Homo sapiens; identical to SEQ ID NO: 97931
  Payload ID: 19529
  Gene Name: WW domain containing transcription regulator 1
  Uniprot ID: Q9GZV5
  ENSP ID: ENSP00000419234

SEQ ID NO: 97938 - protein, 400 aa, Homo sapiens; identical to SEQ ID NO: 97931
  Payload ID: 19529
  Gene Name: WW domain containing transcription regulator 1
  Uniprot ID: Q9GZV5
  ENSP ID: ENSP00000419465

SEQ ID NO: 97939 - protein, 138 aa, Homo sapiens
  Payload ID: 19529
  Gene Name: WW domain containing transcription regulator 1
  ENSP ID: ENSP00000420120
MNPASAPPPLPPPGQQVIHVTQDLDTDLEALFNSVMNPKPSSWRKKILPESFFKEPDSGSHSRQSSTDSSGGHPGPRLAGGAQHVRSHSSPASLQLGTGAGAAGSPAQQHAHLRQQSYDVTDELPLPPGWEMTFTATG

SEQ ID NO: 97940 - protein, 109 aa, Homo sapiens
  Payload ID: 19529
  Gene Name: WW domain containing transcription regulator 1
  ENSP ID: ENSP00000420159
MNPASAPPPLPPPGQQVIHVTQDLDTDLEALFNSVMNPKPSSWRKKILPESFFKEPDSGSHSRQSSTDSSGGHPGPRLAGGAQHVRSHSSPASLQLGTGAGAAGSPAQQ

SEQ ID NO: 97941 - protein, 1092 aa, Homo sapiens
  Payload ID: 19530
  Gene Name: WWC family member 3
  Uniprot ID: Q9ULE0
  ENSP ID: ENSP00000370242
MDHINKLTQIEDPREQWRREQERMLKEYLIVAQEALNAKKEIYQIKQQRFELAQEEYQQLHKMCEDDSRSYASSFSGYSTNTKYDPHQIKAEIASRRDRLSRLKRELTQMKQELQYKEKGVETLQEIDRKMSSTHTSYKLDEAQAIMSELRTIKKAICTGEKERRDLMHSLAKLTDSFKNSCSVTDSLVDFPHHVGVPGDAGVPQQFCDAGSQTDIIGEFVFDDKTRLVDRVRLNWQYEEARKRVANIQQQLARLDNESWPSTAEADRDRLQLIKEKEALLQELQLIIAQRRSAGDVARLEEERERLEEELRRARATSAQGATERILLQEKRNCLLMQLEEATRLTSYLQSQLKSLCASTLTVSSGSSRGSLASSRGSLASSRGSLSSVSFTDIYGLPQYEKPDAEGSQLLRFDLIPFDSLGRDAPFSEPPGPSGFHKQRRSLDTPQSLASLSSRSSLSSLSPPSSPLDTPFLPASRDSPLAQLADSCEGPGLGALDRLRAHASAMGDEDLPGMAALQPHGVPGDGEGPHERGPPPASAPVGGTVTLREDSAKRLERRARRISACLSDYSLASDSGVFEPLTKRNEDAEEPAYGDTASNGDPQIHVGLLRDSGSECLLVHVLQLKNPAGLAVKEDCKVHIRVYLPPLDSGTPNTYCSKALEFQVPLVFNEVFRIPVHSSALTLKSLQLYVCSVTPQLQEELLGIAQINLADYDSLSEMQLRWHSVQVFTSSEPSRTREAGCAGESSARDPAHTISISGKTDAVTVLLARTTAQLQAVERELAEERAKLEYTEEEVLEMERKEEQAEAISERSWQADSVDSGCSNCTQTSPPYPEPCCMGIDSILGHPFAAQAGPYSPEKFQPSPLKVDKETNTEDLFLEEAASLVKERPSRRARGSPFVRSGTIVRSQTFSPGARSQYVCRLYRSDSDSSTLPRKSPFVRNTLERRTLRYKQSCRSSLAELMARTSLDLELDLQASRTRQRQLNEELCALRELRQRLEDAQLRGQTDLPPWVLRDERLRGLLREAERQTRQTKLDYRHEQAAEKMLKKASKEIYQLRGQSHKEPIQVQTFREKIAFFTRPRINIPPLPADDV

SEQ ID NO: 97942 - protein, 1216 aa, Homo sapiens
  Payload ID: 19530
  Gene Name: WWC family member 3
  ENSP ID: ENSP00000399584
MPWLSGGRRRRRGQPREAPREPPPSAQPQREPPPAPPAAVPTPPAPSAPPPRARESAELPLPAGWEEARDYDGRVFYIDHNTRQTSWIDPRDRITKPLTFADCVGDELPLGWETVYDKQIGVYYMDHINKLTQIEDPREQWRREQERMLKEYLIVAQEALNAKKEIYQIKQQRFELAQEEYQQLHKMCEDDSRSYASSFSGYSTNTKYDPHQIKAEIASRRDRLSRLKRELTQMKQELQYKEKGVETLQEIDRKMSSTHTSYKLDEAQAIMSELRTIKKAICTGEKERRDLMHSLAKLTDSFKNSCSVTDSLVDFPHHVGVPGDAGVPQQFCDAGSQTDIIGEFVFDDKTRLVDRVRLNWQYEEARKRVANIQQQLARLDNESWPSTAEADRDRLQLIKEKEALLQELQLIIAQRRSAGDVARLEEERERLEEELRRARATSAQGATERILLQEKRNCLLMQLEEATRLTSYLQSQLKSLCASTLTVSSGSSRGSLASSRGSLASSRGSLSSVSFTDIYGLPQYEKPDAEGSQLLRFDLIPFDSLGRDAPFSEPPGPSGFHKQRRSLDTPQSLASLSSRSSLSSLSPPSSPLDTPFLPASRDSPLAQLADSCEGPGLGALDRLRAHASAMGDEDLPGMAALQPHGVPGDGEGPHERGPPPASAPVGGTVTLREDSAKRLERRARRISACLSDYSLASDSGVFEPLTKRNEDAEEPAYGDTASNGDPQIHVGLLRDSGSECLLVHVLQLKNPAGLAVKEDCKVHIRVYLPPLDSGTPNTYCSKALEFQVPLVFNEVFRIPVHSSALTLKSLQLYVCSVTPQLQEELLGIAQINLADYDSLSEMQLRWHSVQVFTSSEPSRTREAGCAGESSARDPAHTISISGKTDAVTVLLARTTAQLQAVERELAEERAKLEYTEEEVLEMERKEEQAEAISERSWQADSVDSGCSNCTQTSPPYPEPCCMGIDSILGHPFAAQAGPYSPEKFQPSPLKVDKETNTEDLFLEEAASLVKERPSRRARGSPFVRSGTIVRSQTFSPGARSQYVCRLYRSDSDSSTLPRKSPFVRNTLERRTLRYKQSCRSSLAELMARTSLDLELDLQASRTRQRQLNEELCALRELRQRLEDAQLRGQTDLPPWVLRDERLRGLLREAERQTRQTKLDYRHEQAAEKMLKKASKEIYQLRGQSHKEPIQVQTFREKIAFFTRPRINIPPLPADDV

SEQ ID NO: 97943 - protein, 69 aa, Homo sapiens
  Payload ID: 19531
  Gene Name: X antigen family, member 1A
  Uniprot ID: Q9HD64
  ENSP ID: ENSP00000364750
MESPKKKNQQLKVGILHLGSRQKKIRIQLRSQVLGREMRDMEGDLQELHQSNTGDKSGFGFRRQGEDNT

SEQ ID NO: 97944 - protein, 81 aa, Homo sapiens
  Payload ID: 19531
  Gene Name: X antigen family, member 1A
  Uniprot ID: Q9HD64
  ENSP ID: ENSP00000364752
MESPKKKNQQLKVGILHLGSRQKKIRIQLRSQCATWKVICKSCISQTPGINLDLGSGVKVKIIPKEEHCKMPEAGEEQPQV

SEQ ID NO: 97945 - protein, 69 aa, Homo sapiens; identical to SEQ ID NO: 97943
  Payload ID: 19532
  Gene Name: X antigen family, member 1B
  Uniprot ID: Q9HD64
  ENSP ID: ENSP00000364763

SEQ ID NO: 97946 - protein, 81 aa, Homo sapiens; identical to SEQ ID NO: 97944
  Payload ID: 19532
  Gene Name: X antigen family, member 1B
  Uniprot ID: Q9HD64
  ENSP ID: ENSP00000364766

SEQ ID NO: 97947 - protein, 81 aa, Homo sapiens; identical to SEQ ID NO: 97944
  Payload ID: 19532
  Gene Name: X antigen family, member 1B
  Uniprot ID: Q9HD64
  ENSP ID: ENSP00000430130

SEQ ID NO: 97948 - protein, 111 aa, Homo sapiens
  Payload ID: 19533
  Gene Name: X antigen family, member 2
  Uniprot ID: Q96GT9
  ENSP ID: ENSP00000286049
MSWRGRSTYRPRPRRSLQPPELIGAMLEPTDEEPKEEKPPTKSRNPTPDQKREDDQGAAEIQVPDLEADLQELCQTKTGDGCEGGTDVKGKILPKAEHFKMPEAGEGKSQV

SEQ ID NO: 97949 - protein, 111 aa, Homo sapiens
  Payload ID: 19534
  Gene Name: X antigen family, member 3
  Uniprot ID: Q8WTP9
  ENSP ID: ENSP00000303061
MIWRGRSTYRPRPRRSVPPPELIGPMLEPGDEEPQQEEPPTESRDPAPGQEREEDQGAAETQVPDLEADLQELSQSKTGGECGNGPDDQGKILPKSEQFKMPEGGDRQPQV

SEQ ID NO: 97950 - protein, 111 aa, Homo sapiens; identical to SEQ ID NO: 97949
  Payload ID: 19534
  Gene Name: X antigen family, member 3
  Uniprot ID: Q8WTP9
  ENSP ID: ENSP00000364640

SEQ ID NO: 97951 - protein, 108 aa, Homo sapiens
  Payload ID: 19535
  Gene Name: X antigen family, member 5
  Uniprot ID: Q8WWM1
  ENSP ID: ENSP00000342240
MSWRGRRYRPRRCLRLAQLVGPMLEPSVPEPQQEEPPTESQDHTPGQKREDDQGAAEIQVPNLEADLQELSQSKTGDECGDSPDVQGKILPKSEQFKMPEGGEGKPQL

SEQ ID NO: 97952 - protein, 108 aa, Homo sapiens; identical to SEQ ID NO: 97951
  Payload ID: 19535
  Gene Name: X antigen family, member 5
  Uniprot ID: Q8WWM1
  ENSP ID: ENSP00000364651

SEQ ID NO: 97953 - protein, 75 aa, Homo sapiens
  Payload ID: 19535
  Gene Name: X antigen family, member 5
  ENSP ID: ENSP00000364653
MSWRGRRYRPRRCLRLAQLVGPMLEPSVPEPQQEEPPTESQDHTPGQKREDDQGAAEIQGTSILAQDKTQFSETG

SEQ ID NO: 97954 - protein, 1333 aa, Homo sapiens
  Payload ID: 19536
  Gene Name: xanthine dehydrogenase
  Uniprot ID: P47989
  ENSP ID: ENSP00000368727
MTADKLVFFVNGRKVVEKNADPETTLLAYLRRKLGLSGTKLGCGEGGCGACTVMLSKYDRLQNKIVHFSANACLAPICSLHHVAVTTVEGIGSTKTRLHPVQERIAKSHGSQCGFCTPGIVMSMYTLLRNQPEPTMEEIENAFQGNLCRCTGYRPILQGFRTFARDGGCCGGDGNNPNCCMNQKKDHSVSLSPSLFKPEEFTPLDPTQEPIFPPELLRLKDTPRKQLRFEGERVTWIQASTLKELLDLKAQHPDAKLVVGNTEIGIEMKFKNMLFPMIVCPAWIPELNSVEHGPDGISFGAACPLSIVEKTLVDAVAKLPAQKTEVFRGVLEQLRWFAGKQVKSVASVGGNIITASPISDLNPVFMASGAKLTLVSRGTRRTVQMDHTFFPGYRKTLLSPEEILLSIEIPYSREGEYFSAFKQASRREDDIAKVTSGMRVLFKPGTTEVQELALCYGGMANRTISALKTTQRQLSKLWKEELLQDVCAGLAEELHLPPDAPGGMVDFRCTLTLSFFFKFYLTVLQKLGQENLEDKCGKLDPTFASATLLFQKDPPADVQLFQEVPKGQSEEDMVGRPLPHLAADMQASGEAVYCDDIPRYENELSLRLVTSTRAHAKIKSIDTSEAKKVPGFVCFISADDVPGSNITGICNDETVFAKDKVTCVGHIIGAVVADTPEHTQRAAQGVKITYEELPAIITIEDAIKNNSFYGPELKIEKGDLKKGFSEADNVVSGEIYIGGQEHFYLETHCTIAVPKGEAGEMELFVSTQNTMKTQSFVAKMLGVPANRIVVRVKRMGGGFGGKETRSTVVSTAVALAAYKTGRPVRCMLDRDEDMLITGGRHPFLARYKVGFMKTGTVVALEVDHFSNVGNTQDLSQSIMERALFHMDNCYKIPNIRGTGRLCKTNLPSNTAFRGFGGPQGMLIAECWMSEVAVTCGMPAEEVRRKNLYKEGDLTHFNQKLEGFTLPRCWEECLASSQYHARKSEVDKFNKENCWKKRGLCIIPTKFGISFTVPFLNQAGALLHVYTDGSVLLTHGGTEMGQGLHTKMVQVASRALKIPTSKIYISETSTNTVPNTSPTAASVSADLNGQAVYAACQTILKRLEPYKKKNPSGSWEDWVTAAYMDTVSLSATGFYRTPNLGYSFETNSGNPFHYFSYGVACSEVEIDCLTGDHKNLRTDIVMDVGSSLNPAIDIGQVEGAFVQGLGLFTLEELHYSPEGSLHTRGPSTYKIPAFGSIPIEFRVSLLRDCPNKKAIYASKAVGEPPLFLAASIFFAIKDAIRAARAQHTGNNVKELFRLDSPATPEKIRNACVDKFTTLCVTGVPENCKPWSVRV

SEQ ID NO: 97955 - protein, 261 aa, Homo sapiens
  Payload ID: 19537
  Gene Name: X-box binding protein 1
  Uniprot ID: P17861
  ENSP ID: ENSP00000216037
MVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEENQKLLLENQLLREKTHGLVVENQELRQRLGMDALVAEEEAEAKGNEVRPVAGSAESAALRLRAPLQQVQAQLSPLQNISPWILAVLTLQIQSLISCWAFWTTWTQSCSSNALPQSLPAWRSSQRSTQKDPVPYQPPFLCQWGRHQPSWKPLMN

SEQ ID NO: 97956 - protein, 376 aa, Homo sapiens
  Payload ID: 19537
  Gene Name: X-box binding protein 1
  Uniprot ID: P17861
  ENSP ID: ENSP00000343155
MVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEENQKLLLENQLLREKTHGLVVENQELRQRLGMDALVAEEEAEAKGNEVRPVAGSAESAAGAGPVVTPPEHLPMDSGGIDSSDSESDILLGILDNLDPVMFFKCPSPEPASLEELPEVYPEGPSSLPASLSLSVGTSSAKLEAINELIRFDHIYTKPLVLEIPSETESQANVVVKIEEAPLSPSENDHPEFIVSVKEEPVEDDLVPELGISNLLSSSHCPKPSSCLLDAYSDCGYGGSLSPFSDMSSLLGVNHSWEDTFANELFPQLISV

SEQ ID NO: 97957 - protein, 211 aa, Homo sapiens
  Payload ID: 19537
  Gene Name: X-box binding protein 1
  ENSP ID: ENSP00000384295
MRAPVFQALLLCGRRLVVQPLNSDMRKLKNRVAAQTARDRKKARMSELEQQVVDLEEENQKLLLENQLLREKTHGLVVENQELRQRLGMDALVAEEEAEAKGNEVRPVAGSAESAALRLRAPLQQVQAQLSPLQNISPWILAVLTLQIQSLISCWAFWTTWTQSCSSNALPQSLPAWRSSQRSTQKDPVPYQPPFLCQWGRHQPSWKPLMN

SEQ ID NO: 97958 - protein, 266 aa, Homo sapiens
  Payload ID: 19537
  Gene Name: X-box binding protein 1
  ENSP ID: ENSP00000385162
MVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEEVKLLKNQKLLLENQLLREKTHGLVVENQELRQRLGMDALVAEEEAEAKGNEVRPVAGSAESAALRLRAPLQQVQAQLSPLQNISPWILAVLTLQIQSLISCWAFWTTWTQSCSSNALPQSLPAWRSSQRSTQKDPVPYQPPFLCQWGRHQPSWKPLMN

SEQ ID NO: 97959 - protein, 376 aa, Homo sapiens; identical to SEQ ID NO: 97956
  Payload ID: 19537
  Gene Name: X-box binding protein 1
  Uniprot ID: P17861
  ENSP ID: ENSP00000481170

SEQ ID NO: 97960 - protein, 631 aa, Homo sapiens
  Payload ID: 19538
  Gene Name: xenotropic and polytropic retrovirus receptor 1
  Uniprot ID: Q9UBH6
  ENSP ID: ENSP00000356561
MKFAEHLSAHITPEWRKQYIQYEAFKDMLYSAQDQAPSVEVTDEDTVKRYFAKFEEKFFQTCEKELAKINTFYSEKLAEAQRRFATLQNELQSSLDAQKESTGVTTLRQRRKPVFHLSHEERVQHRNIKDLKLAFSEFYLSLILLQNYQNLNFTGFRKILKKHDKILETSRGADWRVAHVEVAPFYTCKKINQLISETEAVVTNELEDGDRQKAMKRLRVPPLGAAQPAPAWTTFRVGLFCGIFIVLNITLVLAAVFKLETDRSIWPLIRIYRGGFLLIEFLFLLGINTYGWRQAGVNHVLIFELNPRSNLSHQHLFEIAGFLGILWCLSLLACFFAPISVIPTYVYPLALYGFMVFFLINPTKTFYYKSRFWLLKLLFRVFTAPFHKVGFADFWLADQLNSLSVILMDLEYMICFYSLELKWDESKGLLPNNSEERGHSDTMVFFYLWIVFYIISSCYTLIWDLKMDWGLFDKNAGENTFLREEIVYPQKAYYYCAIIEDVILRFAWTIQISITSTTLLPHSGDIIATVFAPLEVFRRFVWNFFRLENEHLNNCGEFRAVRDISVAPLNADDQTLLEQMMDQDDGVRNRQKNRSWKYNQSISLRRPRLASQSKARDTKVLIEDTDDEANT

SEQ ID NO: 97961 - protein, 696 aa, Homo sapiens
  Payload ID: 19538
  Gene Name: xenotropic and polytropic retrovirus receptor 1
  Uniprot ID: Q9UBH6
  ENSP ID: ENSP00000356562
MKFAEHLSAHITPEWRKQYIQYEAFKDMLYSAQDQAPSVEVTDEDTVKRYFAKFEEKFFQTCEKELAKINTFYSEKLAEAQRRFATLQNELQSSLDAQKESTGVTTLRQRRKPVFHLSHEERVQHRNIKDLKLAFSEFYLSLILLQNYQNLNFTGFRKILKKHDKILETSRGADWRVAHVEVAPFYTCKKINQLISETEAVVTNELEDGDRQKAMKRLRVPPLGAAQPAPAWTTFRVGLFCGIFIVLNITLVLAAVFKLETDRSIWPLIRIYRGGFLLIEFLFLLGINTYGWRQAGVNHVLIFELNPRSNLSHQHLFEIAGFLGILWCLSLLACFFAPISVIPTYVYPLALYGFMVFFLINPTKTFYYKSRFWLLKLLFRVFTAPFHKVGFADFWLADQLNSLSVILMDLEYMICFYSLELKWDESKGLLPNNSEESGICHKYTYGVRAIVQCIPAWLRFIQCLRRYRDTKRAFPHLVNAGKYSTTFFMVTFAALYSTHKERGHSDTMVFFYLWIVFYIISSCYTLIWDLKMDWGLFDKNAGENTFLREEIVYPQKAYYYCAIIEDVILRFAWTIQISITSTTLLPHSGDIIATVFAPLEVFRRFVWNFFRLENEHLNNCGEFRAVRDISVAPLNADDQTLLEQMMDQDDGVRNRQKNRSWKYNQSISLRRPRLASQSKARDTKVLIEDTDDEANT

SEQ ID NO: 97962 - protein, 273 aa, Homo sapiens
  Payload ID: 19539
  Gene Name: xeroderma pigmentosum, complementation group A
  Uniprot ID: P23025
  ENSP ID: ENSP00000364270
MAAADGALPEAAALEQPAELPASVRASIERKRQRALMLRQARLAARPYSATAAAATGGMANVKAAPKIIDTGGGFILEEEEEEEQKIGKVVHQPGPVMEFDYVICEECGKEFMDSYLMNHFDLPTCDNCRDADDKHKLITKTEAKQEYLLKDCDLEKREPPLKFIVKKNPHHSQWGDMKLYLKLQIVKRSLEVWGSQEALEEAKEVRQENREKMKQKKFDKKVKELRRAVRSSVWKRETIVHQHEYGPEENLEDDMYRKTCTMCGHELTYEKM

SEQ ID NO: 97963 - protein, 264 aa, Homo sapiens
  Payload ID: 19539
  Gene Name: xeroderma pigmentosum, complementation group A
  ENSP ID: ENSP00000433006
MAAADGALPEAAALEQPAELPASVRASIERKRQRALMLRQARLAARPYSATAAAATGGMANVKAAPKIIDTGGGFILEEEEEEEQKIGKVVHQPGPVMEFDYVICEECGKEFMDSYLMNHFDLPTCDNCRDADDKHKLITKTEAKQEYLLKDCDLEKREPPLKFIVKKNPHHSQWGDMKLYLKLQIVKRSLEVWGSQEALEEAKEVRQENREKMKQKKFDKKVKEVVPAFLNRPQRAETGVDTVEIRHKELTVQFSQKAQNREE

SEQ ID NO: 97964 - protein, 940 aa, Homo sapiens
  Payload ID: 19540
  Gene Name: xeroderma pigmentosum, complementation group C
  Uniprot ID: Q01831
  ENSP ID: ENSP00000285021
MARKRAAGGEPRGRELRSQKSKAKSKARREEEEEDAFEDEKPPKKSLLSKVSQGKRKRGCSHPGGSADGPAKKKVAKVTVKSENLKVIKDEALSDGDDLRDFPSDLKKAHHLKRGATMNEDSNEEEEESENDWEEVEELSEPVLGDVRESTAFSRSLLPVKPVEIEIETPEQAKTRERSEKIKLEFETYLRRAMKRFNKGVHEDTHKVHLLCLLANGFYRNNICSQPDLHAIGLSIIPARFTRVLPRDVDTYYLSNLVKWFIGTFTVNAELSASEQDNLQTTLERRFAIYSARDDEELVHIFLLILRALQLLTRLVLSLQPIPLKSATAKGKKPSKERLTADPGGSSETSSQVLENHTKPKTSKGTKQEETFAKGTCRPSAKGKRNKGGRKKRSKPSSSEEDEGPGDKQEKATQRRPHGRERRVASRVSYKEESGSDEAGSGSDFELSSGEASDPSDEDSEPGPPKQRKAPAPQRTKAGSKSASRTHRGSHRKDPSLPAASSSSSSSKRGKKMCSDGEKAEKRSIAGIDQWLEVFCEQEEKWVCVDCVHGVVGQPLTCYKYATKPMTYVVGIDSDGWVRDVTQRYDPVWMTVTRKCRVDAEWWAETLRPYQSPFMDREKKEDLEFQAKHMDQPLPTAIGLYKNHPLYALKRHLLKYEAIYPETAAILGYCRGEAVYSRDCVHTLHSRDTWLKKARVVRLGEVPYKMVKGFSNRARKARLAEPQLREENDLGLFGYWQTEEYQPPVAVDGKVPRNEFGNVYLFLPSMMPIGCVQLNLPNLHRVARKLDIDCVQAITGFDFHGGYSHPVTDGYIVCEEFKDVLLTAWENEQAVIERKEKEKKEKRALGNWKLLAKGLLIRERLKRRYGPKSEAAAPHTDAGGGLSSDEEEGTSSQAEAARILAASWPQNREDEEKQKLKGGPKKTKREKKAAASHLFPFEQL

SEQ ID NO: 97965 - protein, 168 aa, Homo sapiens
  Payload ID: 19540
  Gene Name: xeroderma pigmentosum, complementation group C
  ENSP ID: ENSP00000423867
MARKRAAGGEPRGRELRSQKSKAKSKARHAFEDEKPPKKSLLSKVSQGKRKRGCSHPGGSADGPAKKKVAKVTVKSENLKVIKDEALSDGDDLRDFPSDLKKAHHLKRGATMNEDSNEEEEESENDWEEVEELSEPVLGDVRESTAFSRSLLPVKPVEIEIETPEQAK

SEQ ID NO: 97966 - protein, 140 aa, Homo sapiens
  Payload ID: 19540
  Gene Name: xeroderma pigmentosum, complementation group C
  Uniprot ID: Q01831
  ENSP ID: ENSP00000424548
MARKRAAGGEPRGRELRSQKSKAKSKARREEEEEDAFEDEKPPKKSLLSKVSQGKRKRGCSHPGGSADGPAKKKVAKVTVKSENLKVIKDEALSDGDDLRDFPSDLKKAHHLKRGATMNEDSNEEEEESENDWEEVEVKR

SEQ ID NO: 97967 - protein, 180 aa, Homo sapiens
  Payload ID: 19541
  Gene Name: Xg blood group
  Uniprot ID: P55808
  ENSP ID: ENSP00000370566
MESWWGLPCLAFLCFLMHARGQRDFDLADALDDPEPTKKPNSDIYPKPKPPYYPQPENPDSGGNIYPRPKPRPQPQPGNSGNSGGYFNDVDRDDGRYPPRPRPRPPAGGGGGGYSSYGNSDNTHGGDHHSTYGNPEGNMVAKIVSPIVSVVVVTLLGAAASYFKLNNRRNCFRTHEPENV

SEQ ID NO: 97968 - protein, 195 aa, Homo sapiens
  Payload ID: 19541
  Gene Name: Xg blood group
  Uniprot ID: P55808
  ENSP ID: ENSP00000411004
MESWWGLPCLAFLCFLMHARGQRDFDLADALDDPEPTKKPNSDIYPKPKPPYYPQPENPDSGGNIYPRPKPRPQPQPGNSGNSGGYFNDVDRDDGRYPPRPRPRPPAGGGGGGYSSYGNSDNTHGRGGYRLNSRYGNTYGGDHHSTYGNPEGNMVAKIVSPIVSVVVVTLLGAAASYFKLNNRRNCFRTHEPENV

SEQ ID NO: 97969 - protein, 148 aa, Homo sapiens
  Payload ID: 19541
  Gene Name: Xg blood group
  ENSP ID: ENSP00000430005
MESWWGLPCLAFLCFLMHARDIYPKPKPPYYPQPENPDSGGNIYPRPKPRPQPQPGNSGNSGGYFNDVDRDDGRYPPRPRPRPPAGGGGGGYSSYGNSDNTHGGDHHSTYGNPEGNMVAKIVSPIVSVVVVTLLGAAASYFKLNNRRN

SEQ ID NO: 97970 - protein, 282 aa, Homo sapiens
  Payload ID: 19542
  Gene Name: XIAP associated factor 1
  Uniprot ID: Q6GPH4
  ENSP ID: ENSP00000341029
MEGDFSVCRNCKRHVVSANFTLHEAYCLRFLVLCPECEEPVPKETMEEHCKLEHQQANECQERPVECKFCKLDMQLSKLELHESYCGSRTELCQGCGQFIMHRMLAQHRDVCRSEQAQLGKGERISAPEREIYCHYCNQMIPENKYFHHMGKCCPDSEFKKHFPVGNPEILPSSLPSQAAENQTSTMEKDVRPKTRSINRFPLHSESSSKKAPRSKNKTLDPLLMSEPKPRTSSPRGDKAAYDILRRCSQCGILLPLPILNQHQEKCRWLASSKGKQVRNFS

SEQ ID NO: 97971 - protein, 301 aa, Homo sapiens
  Payload ID: 19542
  Gene Name: XIAP associated factor 1
  Uniprot ID: Q6GPH4
  ENSP ID: ENSP00000354822
MEGDFSVCRNCKRHVVSANFTLHEAYCLRFLVLCPECEEPVPKETMEEHCKLEHQQVGCTMCQQSMQKSSLEFHKANECQERPVECKFCKLDMQLSKLELHESYCGSRTELCQGCGQFIMHRMLAQHRDVCRSEQAQLGKGERISAPEREIYCHYCNQMIPENKYFHHMGKCCPDSEFKKHFPVGNPEILPSSLPSQAAENQTSTMEKDVRPKTRSINRFPLHSESSSKKAPRSKNKTLDPLLMSEPKPRTSSPRGDKAAYDILRRCSQCGILLPLPILNQHQEKCRWLASSKGKQVRNFS

SEQ ID NO: 97972 - protein, 141 aa, Homo sapiens
  Payload ID: 19542
  Gene Name: XIAP associated factor 1
  Uniprot ID: Q6GPH4
  ENSP ID: ENSP00000458229
MEGDFSVCRNCKRHVVSANFTLHEAYCLRFLVLCPECEEPVPKETMEEHCKLEHQQVGCTMCQQSMQKSSLEFHKANECQERPVECKFCKLDMQLSKLELHESYCGSRTELCQGCGQFIMHRMLAQHRDVCRSEQAQLGKG

SEQ ID NO: 97973 - protein, 164 aa, Homo sapiens
  Payload ID: 19542
  Gene Name: XIAP associated factor 1
  ENSP ID: ENSP00000458321
MEGDFSVCRNCKRHVVSANFTLHEAYCLRFLVLCPECEEPVPKETMEEHCKLEHQQVGCTMCQQSMQKSSLEFHKANECQERPVECKFCKLDMQLSKLELHESYCGSRTELCQGCGQFIMHRMLAQHRDVCRSEQAQLGKETSPDPGKCLSITVAAALSAHLWP

SEQ ID NO: 97974 - protein, 74 aa, Homo sapiens
  Payload ID: 19542
  Gene Name: XIAP associated factor 1
  ENSP ID: ENSP00000459543
MEGDFSVCRNCKRHVVSANFTLHEAYCLRFLVLCPECEEPVPKETMEEHCKLEHQQGKEFQLLKGKSTVIIATK

SEQ ID NO: 97975 - protein, 190 aa, Homo sapiens
  Payload ID: 19542
  Gene Name: XIAP associated factor 1
  ENSP ID: ENSP00000460315
MEGDFSVCRNCKRHVVSANFTLHEAYCLRFLVLCPECEEPVPKETMEEHCKLEHQQERWDLGVTEWVQSSLQERWGLRVGGRGSSPPCRLGVRCVSRACRSPRWSFIRPMSARSALLSVSSANWTCSSASWSSTSPTVAAGQSSAKAVASSSCTACSPSTEMSVAVNRPSSGKGKEFQLLKGKSTVIIAT

SEQ ID NO: 97976 - protein, 133 aa, Homo sapiens
  Payload ID: 19542
  Gene Name: XIAP associated factor 1
  ENSP ID: ENSP00000460373
MEGDFSVCRNCKRHVVSANFTLHEAYCLRFLVLCPECEEPVPKETMEEHCKLEHQQVGCTMCQQSMQKSSLEFHKANECQERPVECKFCKLDMQLSKLELHESYCGSRTELCQGCGQFIMHRMLAQHRDVCRS

SEQ ID NO: 97977 - protein, 63 aa, Homo sapiens
  Payload ID: 19542
  Gene Name: XIAP associated factor 1
  ENSP ID: ENSP00000460632
MEGDFSVCRNCKRHVVSANFTLHEAYCLRFLVLCPECEEPVPKETMEEHCKLEHQQAWRAVEN

SEQ ID NO: 97978 - protein, 122 aa, Homo sapiens
  Payload ID: 19542
  Gene Name: XIAP associated factor 1
  Uniprot ID: Q6GPH4
  ENSP ID: ENSP00000461196
MEGDFSVCRNCKRHVVSANFTLHEAYCLRFLVLCPECEEPVPKETMEEHCKLEHQQANECQERPVECKFCKLDMQLSKLELHESYCGSRTELCQGCGQFIMHRMLAQHRDVCRSEQAQLGKG

SEQ ID NO: 97979 - protein, 128 aa, Homo sapiens
  Payload ID: 19542
  Gene Name: XIAP associated factor 1
  ENSP ID: ENSP00000461635
MEGDFSVCRNCKRHVVSANFTLHEAYCLRFLVLCPECEEPVPKETMEEHCKLEHQQAYGSGIGKRFWFQERLAVLLRSVKRGCEKGRSWKAVRWSPVSRLSMSIPPGAPDLSLWRYSSSGSRCQLRLV

SEQ ID NO: 97980 - protein, 145 aa, Homo sapiens
  Payload ID: 19542
  Gene Name: XIAP associated factor 1
  ENSP ID: ENSP00000461698
MEGDFSVCRNCKRHVVSANFTLHEAYCLRFLVLCPECEEPVPKETMEEHCKLEHQQANECQERPVECKFCKLDMQLSKLELHESYCGSRTELCQGCGQFIMHRMLAQHRDVCRSEQAQLGKETSPDPGKCLSITVAAALSAHLWP

SEQ ID NO: 97981 - protein, 128 aa, Homo sapiens; identical to SEQ ID NO: 97979
  Payload ID: 19542
  Gene Name: XIAP associated factor 1
  ENSP ID: ENSP00000461750

SEQ ID NO: 97982 - protein, 1843 aa, Homo sapiens
  Payload ID: 19543
  Gene Name: xin actin binding repeat containing 1
  Uniprot ID: Q702N8
  ENSP ID: ENSP00000343140
MADTQTQVAPTPTMRMATAEDLPLPPPPALEDLPLPPPKESFSKFHQQRQASELRRLYRHIHPELRKNLAEAVAEDLAEVLGSEEPTEGDVQCMRWIFENWRLDAIGEHERPAAKEPVLCGDVQATSRKFEEGSFANSTDQEPTRPQPGGGDVRAARWLFETKPLDELTGQAKELEATVREPAASGDVQGTRMLFETRPLDRLGSRPSLQEQSPLELRSEIQELKGDVKKTVKLFQTEPLCAIQDAEGAIHEVKAACREEIQSNAVRSARWLFETRPLDAINQDPSQVRVIRGISLEEGARPDVSATRWIFETQPLDAIREILVDEKDFQPSPDLIPPGPDVQQQQHLFETRALDTLKGDEEAGAEAPPKEEVVPGDVRSTLWLFETKPLDAFRDKVQVGHLQRVDPQDGEGHLSSDSSSALPFSQSAPQRDELKGDVKTFKNLFETLPLDSIGQGEVLAHGSPSREEGTDSAGQAQGIGSPVYAMQDSKGRLHALTSVSREQIVGGDVQGYRWMFETQPLDQLGRSPSTIDVVRGITRQEVVAGDVGTARWLFETQPLEMIHQREQQERQKEEGKSQGDPQPEAPPKGDVQTIRWLFETCPMSELAEKQGSEVTDPTAKAEAQSCTWMFKPQPVDRPVGSREQHLQVSQVPAGERQTDRHVFETEPLQASGRPCGRRPVRYCSRVEIPSGQVSRQKEVFQALEAGKKEEQEPRVIAGSIPAGSVHKFTWLFENCPMGSLAAESIQGGNLLEEQPMSPSGNRMQESQETAAEGTLRTLHATPGILHHGGILMEARGPGELCLAKYVLSGTGQGHPYIRKEELVSGELPRIICQVLRRPDVDQQGLLVQEDPTGQLQLKPLRLPTPGSSGNIEDMDPELQQLLACGLGTSVARTGLVMQETEQGLVALTAYSLQPRLTSKASERSSVQLLASCIDKGDLSGLHSLRWEPPADPSPVPASEGAQSLHPTESIIHVPPLDPSMGMGHLRASGATPCPPQAIGKAVPLAGEAAAPAQLQNTEKQEDSHSGQKGMAVLGKSEGATTTPPGPGAPDLLAAMQSLRMATAEAQSLHQQVLNKHKQGPTPTATSNPIQDGLRKAGATQSNIRPGGGSDPRIPAAPRKVSREEQALPRGLPGGWVTIQDGIYTAHPVRTFDPPGGVQLSQREPQSRHRETALSVQAPRPLQGGPGQSTGPGREEPGGCTQMAWGPPGKAMAEVCPGGLQAAETTLKTAPLGRHILASGPQAAGASPHPHNAFVPPPPTLPAAVTGPDFPAGAHRAEDSIQQASEPLKDPLLHSHSSPAGQRTPGGSQTKTPKLDPTMPPKKKPQLPPKPAHLTQSHPPQRLPKPLPLSPSFSSEVGQREHQRGERDTAIPQPAKVPTTVDQGHIPLARCPSGHSQPSLQHGLSTTAPRPTKNQATGSNAQSSEPPKLNALNHDPTSPQWGPGPSGEQPMEGSHQGAPESPDSLQRNQKELQGLLNQVQALEKEAASSVDVQALRRLFEAVPQLGGAAPQAPAAHQKPEASVEQAFGELTRVSTEVAQLKEQTLARLLDIEEAVHKALSSMSSLQPEASARGHFQGPPKDHSAHKISVTVSSSARPSGSGQEVGGQTAVKNQAKVECHTEAQSQVKIRNHTEARGHTASTAPSTRRQETSREYLCPPRVLPSSRDSPSSPTFISIQSATRKPLETPSFKGNPDVSVKSTQLAQDIGQALLHQKGVQDKTGKKDITQCSVQPEPAPPSASPLPRGWQKSVLELQTGPGSSQHYGAMRTVTEQYEEVDQFGNTVLMSSTTVTEQAEPPRNPGSHLGLHASPLLRQFLHSPAGFSSDLTEAETVQVSCSYSQPAAQ

SEQ ID NO: 97983 - protein, 1121 aa, Homo sapiens
  Payload ID: 19543
  Gene Name: xin actin binding repeat containing 1
  Uniprot ID: Q702N8
  ENSP ID: ENSP00000379550
MADTQTQVAPTPTMRMATAEDLPLPPPPALEDLPLPPPKESFSKFHQQRQASELRRLYRHIHPELRKNLAEAVAEDLAEVLGSEEPTEGDVQCMRWIFENWRLDAIGEHERPAAKEPVLCGDVQATSRKFEEGSFANSTDQEPTRPQPGGGDVRAARWLFETKPLDELTGQAKELEATVREPAASGDVQGTRMLFETRPLDRLGSRPSLQEQSPLELRSEIQELKGDVKKTVKLFQTEPLCAIQDAEGAIHEVKAACREEIQSNAVRSARWLFETRPLDAINQDPSQVRVIRGISLEEGARPDVSATRWIFETQPLDAIREILVDEKDFQPSPDLIPPGPDVQQQQHLFETRALDTLKGDEEAGAEAPPKEEVVPGDVRSTLWLFETKPLDAFRDKVQVGHLQRVDPQDGEGHLSSDSSSALPFSQSAPQRDELKGDVKTFKNLFETLPLDSIGQGEVLAHGSPSREEGTDSAGQAQGIGSPVYAMQDSKGRLHALTSVSREQIVGGDVQGYRWMFETQPLDQLGRSPSTIDVVRGITRQEVVAGDVGTARWLFETQPLEMIHQREQQERQKEEGKSQGDPQPEAPPKGDVQTIRWLFETCPMSELAEKQGSEVTDPTAKAEAQSCTWMFKPQPVDRPVGSREQHLQVSQVPAGERQTDRHVFETEPLQASGRPCGRRPVRYCSRVEIPSGQVSRQKEVFQALEAGKKEEQEPRVIAGSIPAGSVHKFTWLFENCPMGSLAAESIQGGNLLEEQPMSPSGNRMQESQETAAEGTLRTLHATPGILHHGGILMEARGPGELCLAKYVLSGTGQGHPYIRKEELVSGELPRIICQVLRRPDVDQQGLLVQEDPTGQLQLKPLRLPTPGSSGNIEDMDPELQQLLACGLGTSVARTGLVMQETEQGLVALTAYSLQPRLTSKASERSSVQLLASCIDKGDLSGLHSLRWEPPADPSPVPASEGAQSLHPTESIIHVPPLDPSMGMGHLRASGATPCPPQAIGKAVPLAGEAAAPAQLQNTEKQEDSHSGQKGMAVLGKSEGATTTPPGPGAPDLLAAMQSLRMATAEAQSLHQQVLNKHKQGPTPTATSNPIQDGLRKAGATQSNIRPGGGSDPRIPAAPRKLL

SEQ ID NO: 97984 - protein, 526 aa, Homo sapiens
  Payload ID: 19543
  Gene Name: xin actin binding repeat containing 1
  Uniprot ID: Q702N8
  ENSP ID: ENSP00000391645
MPPKKKPQLPPKPAHLTQSHPPQRLPKPLPLSPSFSSEVGQREHQRGERDTAIPQPAKVPTTVDQGHIPLARCPSGHSQPSLQHGLSTTAPRPTKNQATGSNAQSSEPPKLNALNHDPTSPQWGPGPSGEQPMEGSHQGAPESPDSLQRNQKELQGLLNQVQALEKEAASSVDVQALRRLFEAVPQLGGAAPQAPAAHQKPEASVEQAFGELTRVSTEVAQLKEQTLARLLDIEEAVHKALSSMSSLQPEASARGHFQGPPKDHSAHKISVTVSSSARPSGSGQEVGGQTAVKNQAKVECHTEAQSQVKIRNHTEARGHTASTAPSTRRQETSREYLCPPRVLPSSRDSPSSPTFISIQSATRKPLETPSFKGNPDVSVKSTQLAQDIGQALLHQKGVQDKTGKKDITQCSVQPEPAPPSASPLPRGWQKSVLELQTGPGSSQHYGAMRTVTEQYEEVDQFGNTVLMSSTTVTEQAEPPRNPGSHLGLHASPLLRQFLHSPAGFSSDLTEAETVQVSCSYSQPAAQ

SEQ ID NO: 97985 - protein, 963 aa, Homo sapiens
  Payload ID: 19544
  Gene Name: xin actin binding repeat containing 2
  ENSP ID: ENSP00000295237
MPLQKTNEEVSLSGIDSECTVVQPSPGSQSNARILGVCSDNQLSTTSPETVAAKRLHHVLAASEDKDKMKKEVLQSSRDIMQSKSACEIKQSHQECSTQQTQQKKYLEQLHLPQSKPISPNFKVKTIKLPTLDHTLNETDHSYESHKQQSEIDVQTFTKKQYLKTKKTEASTECSHKQSLAERHYQLPKKEKRVTVQLPTESIQKNQEDKLKMVPRKQREFSGSDRGKLPGSEEKNQGPSMIGRKEERLITERKHEHLKNKSAPKVVKQKVIDAHLDSQTQNFQQTQIQTAESKAEHKKLPQPYNSLQEEKCLEVKGIQEKQVFSNTKDSKQEITQNKSFFSSVKESQRDDGKGALNIVEFLRKREELQQILSRVKQFEAEPNKSGLKTFQTLLNTIPGWLISEDKREYAVHIAMENNLEKVKEEITHIKTQAEDMLVSYENIIQTAMMSSKTGKPGNKPTSLDETSSKVSNVHVSNNKNSEQKENKIAKEKTVQHQVAAHHEATVRSHVKTHQEIKLDDSNIPPPSLKTRPPSPTFITIESTARRTENPTKNELSQSPKKDSYVEPPPRRPMSQKSEIHRANTSPSPPRSRSEQLVRLKDTTAKLSKGAIPCPAATPVPIVEKRSEIIMSPATLRRQIKIETRGRDSPPTITIPVNINHAASGSFRESVDAQEEIRKVEKRATYVHKDGLNSTDHMVPDTESYDAVEIIRKVAVPPRLSEHTQRYEAANRTVQMAENFVNDPENEINRWFREFEHGPVSEAKSNRRVYAKGETNHNIQQESRTFCKEEFGLTSLGNTSFTDFSCKHPRELREKIPVKQPRICSETRSLSEHFSGMDAFESQIVESKMKTSSSHSSEAGKSGCDFKHAPPTYEDVIAGHILDISDSPKEVRKNFQKTWQESGRVFKGLGYATADASATEMRTTFQEESAFISEAAAPRQGNMYTLSKDSLSNGVPSGRQAEFS

SEQ ID NO: 97986 - protein, 938 aa, Homo sapiens
  Payload ID: 19544
  Gene Name: xin actin binding repeat containing 2
  Uniprot ID: A4UGR9
  ENSP ID: ENSP00000386454
MFPMQKGSLNLLRQKWESCDYQRSECHPRDSHCTIFQPQESKLLAPEGEVVSAPQSLDPTSLPYSTGEEMWSSKPEEKDSVDKSNNTREYGRPEVLKEDSLSSRRRIERFSIALDELRSVFEAPKSGNKPAEYGGKEVEIERSLCSPAFKSHPGSQLEDSVKDSDKKGKETSFDKMSPESGHSRIFEATAGPNKPESGFAEDSAARGEGVSDLHEVVSLKERMARYQAAVSRGDCRSFSANMMEESEMCAVPGGLAKVKKQFEDEITSSRNTFAQYQYQHQNRSEQEAIHSSQVGTSRSSQEMARNEQEGSKVQKIDVHGTEMVSHLEKHTEEVNQASQFHQYVQETVIDTPEDEEIPKVSTKLLKEQFEKSAQEKILYSDKEMTTPAKQIKKLLLQDKEICILCQKTVYPMECLVADKQNFHKSCFRCHHCNSKLSLGNYASLHGQIYCKPHFKQLFKSKGNYDEGFGHKQHKDRWNCKNQSRSVDFIPNEEPNMCKNIAENTLVPGDRNEHLDAGNSEGQRNDLRKLGERGKLKVIWPPSKEIPKKTLPFEEELKMSKPKWPPEMTTLLSPEFKSESLLEDVRTPENKGQRQDHFPFLQPYLQSTHVCQKEDVIGIKEMKMPEGRKDEKKEGRKNVQDRPSEAEDTKSNRKSAMDLNDNNNVIVQSAEKEKNEKTNQTNGAEVLQVTNTDDEMMPENHKENLNKNNNNNYVAVSYLNNCRQKTSILEFLDLLPLSSEANDTANEYEIEKLENTSRISELLGIFESEKTYSRNVLAMALKKQTDRAAAGSPVQPAPKPSLSRGLMVKGGSSIISPDTNLLNIKGSHSKSKNLHFFFSNTVKITAFSKKNENIFNCDLIDSVDQIKNMPCLDLREFGKDVKPWHVETTEAARNNENTGFDALSHECTAKPLFPRVEVQSEQLTVEEQIKRNRCYSDTE

SEQ ID NO: 97987 - protein, 971 aa, Homo sapiens
  Payload ID: 19544
  Gene Name: xin actin binding repeat containing 2
  Uniprot ID: A4UGR9
  ENSP ID: ENSP00000386619
MFPMQKGSLNLLRQKWESCDYQRSECHPRDSHCTIFQPQESKLLAPEGEVVSAPQSLDPTSLPYSTGEEMWSSKPEEKDSVDKSNNTREYGRPEVLKEDSLSSRRRIERFSIALDELRSVFEAPKSGNKPAEYGGKEVEIERSLCSPAFKSHPGSQLEDSVKDSDKKGKETSFDKMSPESGHSRIFEAVFSTDQAQILRLHLHPKLTKTPKNSLKSSTYISTAGPNKPESGFAEDSAARGEGVSDLHEVVSLKERMARYQAAVSRGDCRSFSANMMEESEMCAVPGGLAKVKKQFEDEITSSRNTFAQYQYQHQNRSEQEAIHSSQVGTSRSSQEMARNEQEGSKVQKIDVHGTEMVSHLEKHTEEVNQASQFHQYVQETVIDTPEDEEIPKVSTKLLKEQFEKSAQEKILYSDKEMTTPAKQIKKLLLQDKEICILCQKTVYPMECLVADKQNFHKSCFRCHHCNSKLSLGNYASLHGQIYCKPHFKQLFKSKGNYDEGFGHKQHKDRWNCKNQSRSVDFIPNEEPNMCKNIAENTLVPGDRNEHLDAGNSEGQRNDLRKLGERGKLKVIWPPSKEIPKKTLPFEEELKMSKPKWPPEMTTLLSPEFKSESLLEDVRTPENKGQRQDHFPFLQPYLQSTHVCQKEDVIGIKEMKMPEGRKDEKKEGRKNVQDRPSEAEDTKSNRKSAMDLNDNNNVIVQSAEKEKNEKTNQTNGAEVLQVTNTDDEMMPENHKENLNKNNNNNYVAVSYLNNCRQKTSILEFLDLLPLSSEANDTANEYEIEKLENTSRISELLGIFESEKTYSRNVLAMALKKQTDRAAAGSPVQPAPKPSLSRGLMVKGGSSIISPDTNLLNIKGSHSKSKNLHFFFSNTVKITAFSKKNENIFNCDLIDSVDQIKNMPCLDLREFGKDVKPWHVETTEAARNNENTGFDALSHECTAKPLFPRVEVQSEQLTVEEQIKRNRCYSDTE

SEQ ID NO: 97988 - protein, 3549 aa, Homo sapiens
  Payload ID: 19544
  Gene Name: xin actin binding repeat containing 2
  Uniprot ID: A4UGR9
  ENSP ID: ENSP00000386840
MFPMQKGSLNLLRQKWESCDYQRSECHPRDSHCTIFQPQESKLLAPEGEVVSAPQSLDPTSLPYSTGEEMWSSKPEEKDSVDKSNNTREYGRPEVLKEDSLSSRRRIERFSIALDELRSVFEAPKSGNKPAEYGGKEVEIERSLCSPAFKSHPGSQLEDSVKDSDKKGKETSFDKMSPESGHSRIFEATAGPNKPESGFAEDSAARGEGVSDLHEVVSLKERMARYQAAVSRGDCRSFSANMMEESEMCAVPGGLAKVKKQFEDEITSSRNTFAQYQYQHQNRSEQEAIHSSQVGTSRSSQEMARNEQEGSKVQKIDVHGTEMVSHLEKHTEEVNQASQFHQYVQETVIDTPEDEEIPKVSTKLLKEQFEKSAQEKILYSDKEMTTPAKQIKTESEYEETFKPSSVVSTSSTSCVSTSQRKETSTTRYSDHSVTSSTLAQINATSSGMTEEFPPPPPDVLQTSVDVTAFSQSPELPSPPRRLPVPKDVYSKQRNLYELNRLYKHIHPELRKNLEKDYISEVSEIVSSQMNSGSSVSADVQQARYVFENTNDSSQKDLNSEREYLEWDEILKGEVQSIRWIFENQPLDSINNGSPDEGDISRGIADQEIIAGGDVKYTTWMFETQPIDTLGAYSSDTVENAEKIPELARGDVCTARWMFETRPLDSMNKMHQSQEESAVTISKDITGGDVKTVRYMFETQHLDQLGQLHSVDEVHLLQLRSELKEIKGNVKRSIKCFETQPLYVIRDGSGQMLEIKTVHREDVEKGDVRTARWMFETQPLDTINKDITEIKVVRGISMEENVKGGVSKAKWLFETQPLEKIKESEEVIIEKEKIIGTDVSRKCWMFETQPLDILKEVPDADSLQREEIIGGDVQTTKHLFETLPIEALKDSPDIGKLQKITASEEEKGDVRHQKWIFETQPLEDIRKDKKEYTRTVKLEEVDRGDVKNYTHIFESNNLIKFDASHKIEVEGVTRGAVELNKSLFETTPLYAIQDPLGKYHQVKTVQQEEIVRGDVRSCRWLFETRPIDQFDESIHKFQIIRGISAQEIQTGNVKSAKWLFETQPLDSIKYFSDVEETESKTEQTRDIVKGDVKTCKWLFETQPMESLYEKVSLMTSSEEIHKGDVKTCTWLFETQPLDTIKDDSETAVKLQTVKQEEIQGGDVRTACFLFETENLDSIQGEEVKEIKPVEMDIQAGDVSSMRYKFENQSLDSISSSSEEVLKKIKTLKTEDIQKGNVLNCRWLFENQPIDKIKESQEGDECVKTVTDIQGGDVRKGCFIFETFSLDEIKEESDYISTKKTITEEVIQGDVKSYRMLFETQPLYAIQDREGSYHEVTTVKKEEVIHGDVRGTRWLFETKPLDSINKSETVYVIKSVTQEDIQKGDVSSVRYRFETQPLDQISEESHNIMPSIDHIQGGNVKTSRQFFESENFDKNNYIRTVSVNEIQKGNVKTSTWLFETHTMDELRGEGLEYENIKTVTQEDVQKGDVKQAVWLFENRTFDSIMEAHKGITKMTKEEIPPSDVKTTTWLFETTPLHEFNETRVEKIEIIGKSIKETLEDLYSQKVIQAPGIIIEADEIGDVRMAKYKLMNQASPEIQKEEIIRADLRNIMVNLLSKRDCTEREILISEEEKGNVNLTKTQLLNRSTEFHAEKEEIVKGDVQQAIKNLFSEERSVKKGILIQEDEKGDINMTIYCLLHENDGDTIEREEVIGGDVKRTIHNLLSSTSNNKISERAKIDASERGNVQFFTTCIEAGALDYLKQLHTESNETLTAKKQEGEKEIIGGDVEGTKLLLKKRQSLVERTVSETDIIPGDVHNTVKVFMTEPQSTFGKIPKEEIIKGDLTSTLNSLSQAVNQKTVTKTEEIIKGNMLATLKSLKESSHRWKESKQPDAIPGDIEKAIECLEKATNTKTEILKKELLKDDLETSLRSLKEAQRSFKEVHKEGVIKKDAKAVMAGSSGEQKTDIHQVAVQRNKNSLLQPKPGPFEPAAKWQGGADTLSQTMGKSCHGNLVEERTEVNLPKAPKGTVKIVIDREQNNDALEKSLRRLSNSHHKSNVLESGDKTGVWTDTTGEQHLRDEYMSRQLTSTVSVKNNLTTKESDRAVRELKKDDVFNSIQSAGKTVGKQQTYELRNDHQKMEGFHIKSPKKTKNIKILTDTQSSKPSPTQHPVSMPVGGTYDLSGDFQKQTLLKQETKYSNKDIKKKNINLQPMWQLLPVEQDTSNVTEMKVSEKSHNTFKATNKKRETDVHLKSQDFLMKTNTSTGLKMAMERSLNPINFNPENNVKESECPLPPPSPPPPPPSNASSEIEFPLPPPPPLMMFPEKNGFLPSLSTEKIKAEFESFPGLPLPPPPVDEKSERESSSMFLPPPPPPTPSQKPAHLLSSSAPEKHSGDFMQQYSQKEASNSQNSQAKIITGKTGVLPPPTLPKPKLPKHIKDNKNDFSPKVELATSLSDMECKITTSKDQKKVMVMTSSEHTETKQNVISKSLDERKQLSIDSANCLSHTVPGTSAPRKKQIAPLIKSHSFPESSGQQNPKPYMRKFKTPLMIAEEKYRQQKEEIEKQKQESSYYNIVKTQSQNQHITEVEKEMPLQKTNEEVSLSGIDSECTVVQPSPGSQSNARILGVCSDNQLSTTSPETVAAKRLHHVLAASEDKDKMKKEVLQSSRDIMQSKSACEIKQSHQECSTQQTQQKKYLEQLHLPQSKPISPNFKVKTIKLPTLDHTLNETDHSYESHKQQSEIDVQTFTKKQYLKTKKTEASTECSHKQSLAERHYQLPKKEKRVTVQLPTESIQKNQEDKLKMVPRKQREFSGSDRGKLPGSEEKNQGPSMIGRKEERLITERKHEHLKNKSAPKVVKQKVIDAHLDSQTQNFQQTQIQTAESKAEHKKLPQPYNSLQEEKCLEVKGIQEKQVFSNTKDSKQEITQNKSFFSSVKESQRDDGKGALNIVEFLRKREELQQILSRVKQFEAEPNKSGLKTFQTLLNTIPGWLISEDKREYAVHIAMENNLEKVKEEITHIKTQAEDMLVSYENIIQTAMMSSKTGKPGNKPTSLDETSSKVSNVHVSNNKNSEQKENKIAKEKTVQHQVAAHHEATVRSHVKTHQEIKLDDSNIPPPSLKTRPPSPTFITIESTARRTENPTKNELSQSPKKDSYVEPPPRRPMSQKSEIHRANTSPSPPRSRSEQLVRLKDTTAKLSKGAIPCPAATPVPIVEKRSEIIMSPATLRRQIKIETRGRDSPPTITIPVNINHAASGSFRESVDAQEEIRKVEKRATYVHKDGLNSTDHMVPDTESYDAVEIIRKVAVPPRLSEHTQRYEAANRTVQMAENFVNDPENEINRWFREFEHGPVSEAKSNRRVYAKGETNHNIQQESRTFCKEEFGLTSLGNTSFTDFSCKHPRELREKIPVKQPRICSETRSLSEHFSGMDAFESQIVESKMKTSSSHSSEAGKSGCDFKHAPPTYEDVIAGHILDISDSPKEVRKNFQKTWQESGRVFKGLGYATADASATEMRTTFQEESAFISEAAAPRQGNMYTLSKDSLSNGVPSGRQAEFS

SEQ ID NO: 97989 - protein, 716 aa, Homo sapiens
  Payload ID: 19544
  Gene Name: xin actin binding repeat containing 2
  Uniprot ID: A4UGR9
  ENSP ID: ENSP00000386981
MARYQAAVSRGDCRSFSANMMEESEMCAVPGGLAKVKKQFEDEITSSRNTFAQYQYQHQNRSEQEAIHSSQVGTSRSSQEMARNEQEGSKVQKIDVHGTEMVSHLEKHTEEVNQASQFHQYVQETVIDTPEDEEIPKVSTKLLKEQFEKSAQEKILYSDKEMTTPAKQIKKLLLQDKEICILCQKTVYPMECLVADKQNFHKSCFRCHHCNSKLSLGNYASLHGQIYCKPHFKQLFKSKGNYDEGFGHKQHKDRWNCKNQSRSVDFIPNEEPNMCKNIAENTLVPGDRNEHLDAGNSEGQRNDLRKLGERGKLKVIWPPSKEIPKKTLPFEEELKMSKPKWPPEMTTLLSPEFKSESLLEDVRTPENKGQRQDHFPFLQPYLQSTHVCQKEDVIGIKEMKMPEGRKDEKKEGRKNVQDRPSEAEDTKSNRKSAMDLNDNNNVIVQSAEKEKNEKTNQTNGAEVLQVTNTDDEMMPENHKENLNKNNNNNYVAVSYLNNCRQKTSILEFLDLLPLSSEANDTANEYEIEKLENTSRISELLGIFESEKTYSRNVLAMALKKQTDRAAAGSPVQPAPKPSLSRGLMVKGGSSIISPDTNLLNIKGSHSKSKNLHFFFSNTVKITAFSKKNENIFNCDLIDSVDQIKNMPCLDLREFGKDVKPWHVETTEAARNNENTGFDALSHECTAKPLFPRVEVQSEQLTVEEQIKRNRCYSDTE

SEQ ID NO: 97990 - protein, 3327 aa, Homo sapiens
  Payload ID: 19544
  Gene Name: xin actin binding repeat containing 2
  Uniprot ID: A4UGR9
  ENSP ID: ENSP00000387255
MARYQAAVSRGDCRSFSANMMEESEMCAVPGGLAKVKKQFEDEITSSRNTFAQYQYQHQNRSEQEAIHSSQVGTSRSSQEMARNEQEGSKVQKIDVHGTEMVSHLEKHTEEVNQASQFHQYVQETVIDTPEDEEIPKVSTKLLKEQFEKSAQEKILYSDKEMTTPAKQIKTESEYEETFKPSSVVSTSSTSCVSTSQRKETSTTRYSDHSVTSSTLAQINATSSGMTEEFPPPPPDVLQTSVDVTAFSQSPELPSPPRRLPVPKDVYSKQRNLYELNRLYKHIHPELRKNLEKDYISEVSEIVSSQMNSGSSVSADVQQARYVFENTNDSSQKDLNSEREYLEWDEILKGEVQSIRWIFENQPLDSINNGSPDEGDISRGIADQEIIAGGDVKYTTWMFETQPIDTLGAYSSDTVENAEKIPELARGDVCTARWMFETRPLDSMNKMHQSQEESAVTISKDITGGDVKTVRYMFETQHLDQLGQLHSVDEVHLLQLRSELKEIKGNVKRSIKCFETQPLYVIRDGSGQMLEIKTVHREDVEKGDVRTARWMFETQPLDTINKDITEIKVVRGISMEENVKGGVSKAKWLFETQPLEKIKESEEVIIEKEKIIGTDVSRKCWMFETQPLDILKEVPDADSLQREEIIGGDVQTTKHLFETLPIEALKDSPDIGKLQKITASEEEKGDVRHQKWIFETQPLEDIRKDKKEYTRTVKLEEVDRGDVKNYTHIFESNNLIKFDASHKIEVEGVTRGAVELNKSLFETTPLYAIQDPLGKYHQVKTVQQEEIVRGDVRSCRWLFETRPIDQFDESIHKFQIIRGISAQEIQTGNVKSAKWLFETQPLDSIKYFSDVEETESKTEQTRDIVKGDVKTCKWLFETQPMESLYEKVSLMTSSEEIHKGDVKTCTWLFETQPLDTIKDDSETAVKLQTVKQEEIQGGDVRTACFLFETENLDSIQGEEVKEIKPVEMDIQAGDVSSMRYKFENQSLDSISSSSEEVLKKIKTLKTEDIQKGNVLNCRWLFENQPIDKIKESQEGDECVKTVTDIQGGDVRKGCFIFETFSLDEIKEESDYISTKKTITEEVIQGDVKSYRMLFETQPLYAIQDREGSYHEVTTVKKEEVIHGDVRGTRWLFETKPLDSINKSETVYVIKSVTQEDIQKGDVSSVRYRFETQPLDQISEESHNIMPSIDHIQGGNVKTSRQFFESENFDKNNYIRTVSVNEIQKGNVKTSTWLFETHTMDELRGEGLEYENIKTVTQEDVQKGDVKQAVWLFENRTFDSIMEAHKGITKMTKEEIPPSDVKTTTWLFETTPLHEFNETRVEKIEIIGKSIKETLEDLYSQKVIQAPGIIIEADEIGDVRMAKYKLMNQASPEIQKEEIIRADLRNIMVNLLSKRDCTEREILISEEEKGNVNLTKTQLLNRSTEFHAEKEEIVKGDVQQAIKNLFSEERSVKKGILIQEDEKGDINMTIYCLLHENDGDTIEREEVIGGDVKRTIHNLLSSTSNNKISERAKIDASERGNVQFFTTCIEAGALDYLKQLHTESNETLTAKKQEGEKEIIGGDVEGTKLLLKKRQSLVERTVSETDIIPGDVHNTVKVFMTEPQSTFGKIPKEEIIKGDLTSTLNSLSQAVNQKTVTKTEEIIKGNMLATLKSLKESSHRWKESKQPDAIPGDIEKAIECLEKATNTKTEILKKELLKDDLETSLRSLKEAQRSFKEVHKEGVIKKDAKAVMAGSSGEQKTDIHQVAVQRNKNSLLQPKPGPFEPAAKWQGGADTLSQTMGKSCHGNLVEERTEVNLPKAPKGTVKIVIDREQNNDALEKSLRRLSNSHHKSNVLESGDKTGVWTDTTGEQHLRDEYMSRQLTSTVSVKNNLTTKESDRAVRELKKDDVFNSIQSAGKTVGKQQTYELRNDHQKMEGFHIKSPKKTKNIKILTDTQSSKPSPTQHPVSMPVGGTYDLSGDFQKQTLLKQETKYSNKDIKKKNINLQPMWQLLPVEQDTSNVTEMKVSEKSHNTFKATNKKRETDVHLKSQDFLMKTNTSTGLKMAMERSLNPINFNPENNVKESECPLPPPSPPPPPPSNASSEIEFPLPPPPPLMMFPEKNGFLPSLSTEKIKAEFESFPGLPLPPPPVDEKSERESSSMFLPPPPPPTPSQKPAHLLSSSAPEKHSGDFMQQYSQKEASNSQNSQAKIITGKTGVLPPPTLPKPKLPKHIKDNKNDFSPKVELATSLSDMECKITTSKDQKKVMVMTSSEHTETKQNVISKSLDERKQLSIDSANCLSHTVPGTSAPRKKQIAPLIKSHSFPESSGQQNPKPYMRKFKTPLMIAEEKYRQQKEEIEKQKQESSYYNIVKTQSQNQHITEVEKEMPLQKTNEEVSLSGIDSECTVVQPSPGSQSNARILGVCSDNQLSTTSPETVAAKRLHHVLAASEDKDKMKKEVLQSSRDIMQSKSACEIKQSHQECSTQQTQQKKYLEQLHLPQSKPISPNFKVKTIKLPTLDHTLNETDHSYESHKQQSEIDVQTFTKKQYLKTKKTEASTECSHKQSLAERHYQLPKKEKRVTVQLPTESIQKNQEDKLKMVPRKQREFSGSDRGKLPGSEEKNQGPSMIGRKEERLITERKHEHLKNKSAPKVVKQKVIDAHLDSQTQNFQQTQIQTAESKAEHKKLPQPYNSLQEEKCLEVKGIQEKQVFSNTKDSKQEITQNKSFFSSVKESQRDDGKGALNIVEFLRKREELQQILSRVKQFEAEPNKSGLKTFQTLLNTIPGWLISEDKREYAVHIAMENNLEKVKEEITHIKTQAEDMLVSYENIIQTAMMSSKTGKPGNKPTSLDETSSKVSNVHVSNNKNSEQKENKIAKEKTVQHQVAAHHEATVRSHVKTHQEIKLDDSNIPPPSLKTRPPSPTFITIESTARRTENPTKNELSQSPKKDSYVEPPPRRPMSQKSEIHRANTSPSPPRSRSEQLVRLKDTTAKLSKGAIPCPAATPVPIVEKRSEIIMSPATLRRQIKIETRGRDSPPTITIPVNINHAASGSFRESVDAQEEIRKVEKRATYVHKDGLNSTDHMVPDTESYDAVEIIRKVAVPPRLSEHTQRYEAANRTVQMAENFVNDPENEINRWFREFEHGPVSEAKSNRRVYAKGETNHNIQQESRTFCKEEFGLTSLGNTSFTDFSCKHPRELREKIPVKQPRICSETRSLSEHFSGMDAFESQIVESKMKTSSSHSSEAGKSGCDFKHAPPTYEDVIAGHILDISDSPKEVRKNFQKTWQESGRVFKGLGYATADASATEMRTTFQEESAFISEAAAPRQGNMYTLSKDSLSNGVPSGRQAEFS

SEQ ID NO: 97991 - protein, 3374 aa, Homo sapiens
  Payload ID: 19544
  Gene Name: xin actin binding repeat containing 2
  Uniprot ID: A4UGR9
  ENSP ID: ENSP00000486198
MSPESGHSRIFEATAGPNKPESGFAEDSAARGEGVSDLHEVVSLKERMARYQAAVSRGDCRSFSANMMEESEMCAVPGGLAKVKKQFEDEITSSRNTFAQYQYQHQNRSEQEAIHSSQVGTSRSSQEMARNEQEGSKVQKIDVHGTEMVSHLEKHTEEVNQASQFHQYVQETVIDTPEDEEIPKVSTKLLKEQFEKSAQEKILYSDKEMTTPAKQIKTESEYEETFKPSSVVSTSSTSCVSTSQRKETSTTRYSDHSVTSSTLAQINATSSGMTEEFPPPPPDVLQTSVDVTAFSQSPELPSPPRRLPVPKDVYSKQRNLYELNRLYKHIHPELRKNLEKDYISEVSEIVSSQMNSGSSVSADVQQARYVFENTNDSSQKDLNSEREYLEWDEILKGEVQSIRWIFENQPLDSINNGSPDEGDISRGIADQEIIAGGDVKYTTWMFETQPIDTLGAYSSDTVENAEKIPELARGDVCTARWMFETRPLDSMNKMHQSQEESAVTISKDITGGDVKTVRYMFETQHLDQLGQLHSVDEVHLLQLRSELKEIKGNVKRSIKCFETQPLYVIRDGSGQMLEIKTVHREDVEKGDVRTARWMFETQPLDTINKDITEIKVVRGISMEENVKGGVSKAKWLFETQPLEKIKESEEVIIEKEKIIGTDVSRKCWMFETQPLDILKEVPDADSLQREEIIGGDVQTTKHLFETLPIEALKDSPDIGKLQKITASEEEKGDVRHQKWIFETQPLEDIRKDKKEYTRTVKLEEVDRGDVKNYTHIFESNNLIKFDASHKIEVEGVTRGAVELNKSLFETTPLYAIQDPLGKYHQVKTVQQEEIVRGDVRSCRWLFETRPIDQFDESIHKFQIIRGISAQEIQTGNVKSAKWLFETQPLDSIKYFSDVEETESKTEQTRDIVKGDVKTCKWLFETQPMESLYEKVSLMTSSEEIHKGDVKTCTWLFETQPLDTIKDDSETAVKLQTVKQEEIQGGDVRTACFLFETENLDSIQGEEVKEIKPVEMDIQAGDVSSMRYKFENQSLDSISSSSEEVLKKIKTLKTEDIQKGNVLNCRWLFENQPIDKIKESQEGDECVKTVTDIQGGDVRKGCFIFETFSLDEIKEESDYISTKKTITEEVIQGDVKSYRMLFETQPLYAIQDREGSYHEVTTVKKEEVIHGDVRGTRWLFETKPLDSINKSETVYVIKSVTQEDIQKGDVSSVRYRFETQPLDQISEESHNIMPSIDHIQGGNVKTSRQFFESENFDKNNYIRTVSVNEIQKGNVKTSTWLFETHTMDELRGEGLEYENIKTVTQEDVQKGDVKQAVWLFENRTFDSIMEAHKGITKMTKEEIPPSDVKTTTWLFETTPLHEFNETRVEKIEIIGKSIKETLEDLYSQKVIQAPGIIIEADEIGDVRMAKYKLMNQASPEIQKEEIIRADLRNIMVNLLSKRDCTEREILISEEEKGNVNLTKTQLLNRSTEFHAEKEEIVKGDVQQAIKNLFSEERSVKKGILIQEDEKGDINMTIYCLLHENDGDTIEREEVIGGDVKRTIHNLLSSTSNNKISERAKIDASERGNVQFFTTCIEAGALDYLKQLHTESNETLTAKKQEGEKEIIGGDVEGTKLLLKKRQSLVERTVSETDIIPGDVHNTVKVFMTEPQSTFGKIPKEEIIKGDLTSTLNSLSQAVNQKTVTKTEEIIKGNMLATLKSLKESSHRWKESKQPDAIPGDIEKAIECLEKATNTKTEILKKELLKDDLETSLRSLKEAQRSFKEVHKEGVIKKDAKAVMAGSSGEQKTDIHQVAVQRNKNSLLQPKPGPFEPAAKWQGGADTLSQTMGKSCHGNLVEERTEVNLPKAPKGTVKIVIDREQNNDALEKSLRRLSNSHHKSNVLESGDKTGVWTDTTGEQHLRDEYMSRQLTSTVSVKNNLTTKESDRAVRELKKDDVFNSIQSAGKTVGKQQTYELRNDHQKMEGFHIKSPKKTKNIKILTDTQSSKPSPTQHPVSMPVGGTYDLSGDFQKQTLLKQETKYSNKDIKKKNINLQPMWQLLPVEQDTSNVTEMKVSEKSHNTFKATNKKRETDVHLKSQDFLMKTNTSTGLKMAMERSLNPINFNPENNVKESECPLPPPSPPPPPPSNASSEIEFPLPPPPPLMMFPEKNGFLPSLSTEKIKAEFESFPGLPLPPPPVDEKSERESSSMFLPPPPPPTPSQKPAHLLSSSAPEKHSGDFMQQYSQKEASNSQNSQAKIITGKTGVLPPPTLPKPKLPKHIKDNKNDFSPKVELATSLSDMECKITTSKDQKKVMVMTSSEHTETKQNVISKSLDERKQLSIDSANCLSHTVPGTSAPRKKQIAPLIKSHSFPESSGQQNPKPYMRKFKTPLMIAEEKYRQQKEEIEKQKQESSYYNIVKTQSQNQHITEVEKEMPLQKTNEEVSLSGIDSECTVVQPSPGSQSNARILGVCSDNQLSTTSPETVAAKRLHHVLAASEDKDKMKKEVLQSSRDIMQSKSACEIKQSHQECSTQQTQQKKYLEQLHLPQSKPISPNFKVKTIKLPTLDHTLNETDHSYESHKQQSEIDVQTFTKKQYLKTKKTEASTECSHKQSLAERHYQLPKKEKRVTVQLPTESIQKNQEDKLKMVPRKQREFSGSDRGKLPGSEEKNQGPSMIGRKEERLITERKHEHLKNKSAPKVVKQKVIDAHLDSQTQNFQQTQIQTAESKAEHKKLPQPYNSLQEEKCLEVKGIQEKQVFSNTKDSKQEITQNKSFFSSVKESQRDDGKGALNIVEFLRKREELQQILSRVKQFEAEPNKSGLKTFQTLLNTIPGWLISEDKREYAVHIAMENNLEKVKEEITHIKTQAEDMLVSYENIIQTAMMSSKTGKPGNKPTSLDETSSKVSNVHVSNNKNSEQKENKIAKEKTVQHQVAAHHEATVRSHVKTHQEIKLDDSNIPPPSLKTRPPSPTFITIESTARRTENPTKNELSQSPKKDSYVEPPPRRPMSQKSEIHRANTSPSPPRSRSEQLVRLKDTTAKLSKGAIPCPAATPVPIVEKRSEIIMSPATLRRQIKIETRGRDSPPTITIPVNINHAASGSFRESVDAQEEIRKVEKRATYVHKDGLNSTDHMVPDTESYDAVEIIRKVAVPPRLSEHTQRYEAANRTVQMAENFVNDPENEINRWFREFEHGPVSEAKSNRRVYAKGETNHNIQQESRTFCKEEFGLTSLGNTSFTDFSCKHPRELREKIPVKQPRICSETRSLSEHFSGMDAFESQIVESKMKTSSSHSSEAGKSGCDFKHAPPTYEDVIAGHILDISDSPKEVRKNFQKTWQESGRVFKGLGYATADASATEMRTTFQEESAFISEAAAPRQGNMYTLSKDSLSNGVPSGRQAEFS

SEQ ID NO: 97992 - protein, 459 aa, Homo sapiens
  Payload ID: 19545
  Gene Name: XK, Kell blood group complex subunit-related family, member 3
  Uniprot ID: Q5GH77
  ENSP ID: ENSP00000331704
METVFEEMDEESTGGVSSSKEEIVLGQRLHLSFPFSIIFSTVLYCGEVAFGLYMFEIYRKANDTFWMSFTISFIIVGAILDQIILMFFNKDLRRNKAALLFWHILLLGPIVRCLHTIRNYHKWLKNLKQEKEETQVSITKRNTMLEREIAFSIRDNFMQQKAFKYMSVIQAFLGSVPQLILQMYISLTIREWPLNRALLMTFSLLSVTYGAIRCNILAIQISNDDTTIKLPPIEFFCVVMWRFLEVISRVVTLAFFIASLKLKSLPVLLIIYFVSLLAPWLEFWKSGAHLPGNKENNSNMVGTVLMLFLITLLYAAINFSCWSAVKLQLSDDKIIDGRQRWGHRILHYSFQFLENVIMILVFRFFGGKTLLNCCDSLIAVQLIISYLLATGFMLLFYQYLYPWQSGKVLPGRTENQPEAPYYYVNIEKTEKNKNKQLRNYCHSCNRVGYFSIRKSMTCS

SEQ ID NO: 97993 - protein, 650 aa, Homo sapiens
  Payload ID: 19546
  Gene Name: XK, Kell blood group complex subunit-related family, member 4
  Uniprot ID: Q5GH76
  ENSP ID: ENSP00000328326
MAAKSDGRLKMKKSSDVAFTPLQNSDHSGSVQGLAPGLPSGSGAEDEEAAGGGCCPDGGGCSRCCCCCAGSGGSAGSGGSGGVAGPGGGGAGSAALCLRLGREQRRYSLWDCLWILAAVAVYFADVGTDVWLAVDYYLRGQRWWFGLTLFFVVLGSLSVQVFSFRWFVHDFSTEDSATAAAASSCPQPGADCKTVVGGGSAAGEGEARPSTPQRQASNASKSNIAAANSGSNSSGATRASGKHRSASCSFCIWLLQSLIHILQLGQIWRYFHTIYLGIRSRQSGENDRWRFYWKMVYEYADVSMLHLLATFLESAPQLVLQLCIIVQTHSLQALQGFTAAASLVSLAWALASYQKALRDSRDDKKPISYMAVIIQFCWHFFTIAARVITFALFASVFQLYFGIFIVLHWCIMTFWIVHCETEFCITKWEEIVFDMVVGIIYIFSWFNVKEGRTRCRLFIYYFVILLENTALSALWYLYKAPQIADAFAIPALCVVFSSFLTGVVFMLMYYAFFHPNGPRFGQSPSCACEDPAAAFTLPPDVATSTLRSISNNRSVVSDRDQKFAERDGCVPVFQVRPTAPSTPSSRPPRIEESVIKIDLFRNRYPAWERHVLDRSLRKAILAFECSPSPPRLQYKDDALIQERLEYETTL

SEQ ID NO: 97994 - protein, 650 aa, Homo sapiens; identical to SEQ ID NO: 97993
  Payload ID: 19546
  Gene Name: XK, Kell blood group complex subunit-related family, member 4
  Uniprot ID: Q5GH76
  ENSP ID: ENSP00000480076

SEQ ID NO: 97995 - protein, 686 aa, Homo sapiens
  Payload ID: 19547
  Gene Name: XK, Kell blood group complex subunit-related family, member 5
  ENSP ID: ENSP00000483879
MHARLLGLSALLQAAEQSARLYTVAYYFTTGRLLWGWLALAVLLPGFLVQALSYLWFRADGHPGHCSLMMLHLLQLGVWKRHWDAALTSLQKELEAPHRGWLQLQEADLSALRLLEALLQTGPHLLLQTYVFLASDFTDIVPGVSTLFSWSSLSWALVSYTRFMGFMKPGHLAMPWAALFCQQLWRMGMLGTRVLSLVLFYKAYHFWVFVVAGAHWLVMTFWLVAQQSDIIDSTCHWRLFNLLVGAVYILCYLSFWDSPSRNRMVTFYMVMLLENIILLLLATDFLQGASWTSLQTIAGVLSGFLIGSVSLVIYYSLLHPKSTDIWQGCLRKSCGIAGGDKTERRDSPRATDLAGKRTESSGSCQGASYEPTILGKPPTPEQVPPEAGLGTQVAVEDSFLSHHHWLWVKLALKTGNVSKINAAFGDNSPAYCPPAWGLSQQDYLQRKALSAQQELPSSSRDPSTLENSSAFEGVPKAEADPLETSSYVSFASDQQDEAPTQNPAATQGEGTPKEGADAVSGTQGKGTGGQQRGGEGQQSSTLYFSATAEVATSSQQEGSPATLQTAHSGRRLGKSSPAQPASPHPVGLAPFPDTMADISPILGTGPCRGFCPSAGFPGRTLSISELEEPLEPKRELSHHAAVGVWVSLPQLRTAHEPCLTSTPKSESIQTDCSCREQMKQEPSFFI

SEQ ID NO: 97996 - protein, 86 aa, Homo sapiens
  Payload ID: 19547
  Gene Name: XK, Kell blood group complex subunit-related family, member 5
  ENSP ID: ENSP00000485506
MHARLLGLSALLQAAEQSARLYTVAYYFTTGRLLWGWLALAVLLPGFLVQALSYLWFRADGHPGHCSLMMLHLLQLGVWKRPQIHL

SEQ ID NO: 97997 - protein, 287 aa, Homo sapiens
  Payload ID: 19548
  Gene Name: XK, Kell blood group complex subunit-related family, member 6
  ENSP ID: ENSP00000297303
MAAKSDGGGVGVGFAQLHNLDEAVGSGGEEDGEPGGGGCGGGGDGSEPGESSSMHICHCCNTSSCYWGCRSACLRSLLGRKPRRSAAADGGDQPLQPPAAPGAGRQPPTPSAARPEPPPPQVERPWLDCLWIVLALLVFFGDVGTDLWLALDYYRKGDYVYFGLTLFFVLVPSLLVQSLSFRWFVQDYTGGGLGAVEGLTSRGPPMMGAGYVHGAARGGPGVRVSPTPGAQRLCRLSVWIWQSVIHLLQMGQVWSGQDPLVPSRKRRSRFNHMKLPHLVSSLLPPPI

SEQ ID NO: 97998 - protein, 418 aa, Homo sapiens
  Payload ID: 19548
  Gene Name: XK, Kell blood group complex subunit-related family, member 6
  ENSP ID: ENSP00000371900
  MOD_RES (1)..(1): Any amino acid
XLFLLPSPGDEENCKHCVLLHAGLPQANRTAGYIRTMYLGIQSQRRKEHQRRFYWAMMYEYADVNMLRLLETFLESAPQLVLQLYIMLQKNSAETLPCVSSVTSLMSLAWVLASYHKLLRDSRDDKKSMSYRGAIIQVFWRLFTISSRVISFALFASIFQLYFGIFVVVHWCAMAFWIIHGGTDFCMSKWEEILFNMVVGIVYIFCWFNVKEGRTRYRMFAYYTIVLTENAALTFLWYFYRDPETTDSYAVPALCCVFISFVAGIAMMLLYYGVLHPTGPRAKILASSCCAELLWGIPLPPDVEPMAPEIPGYRGTQVTPTRAVTEQQEDLTADTCLPVFQVRPMGPPTPLGRPYLPEGPLIKIDMPRKRYPAWDAHFVDRRLRRTINILQYVTPTAVGIRYRDGPLLYELLQYESSL

SEQ ID NO: 97999 - protein, 641 aa, Homo sapiens
  Payload ID: 19548
  Gene Name: XK, Kell blood group complex subunit-related family, member 6
  Uniprot ID: Q5GH73
  ENSP ID: ENSP00000416707
MAAKSDGGGVGVGFAQLHNLDEAVGSGGEEDGEPGGGGCGGGGDGSEPGESSSMHICHCCNTSSCYWGCRSACLRSLLGRKPRRSAAADGGDQPLQPPAAPGAGRQPPTPSAARPEPPPPQVERPWLDCLWIVLALLVFFGDVGTDLWLALDYYRKGDYVYFGLTLFFVLVPSLLVQSLSFRWFVQDYTGGGLGAVEGLTSRGPPMMGAGYVHGAARGGPGVRVSPTPGAQRLCRLSVWIWQSVIHLLQMGQVWRYIRTMYLGIQSQRRKEHQRRFYWAMMYEYADVNMLRLLETFLESAPQLVLQLYIMLQKNSAETLPCVSSVTSLMSLAWVLASYHKLLRDSRDDKKSMSYRGAIIQVFWRLFTISSRVISFALFASIFQLYFGIFVVVHWCAMAFWIIHGGTDFCMSKWEEILFNMVVGIVYIFCWFNVKEGRTRYRMFAYYTIVLTENAALTFLWYFYRDPETTDSYAVPALCCVFISFVAGIAMMLLYYGVLHPTGPRAKILASSCCAELLWGIPLPPDVEPMAPEIPGYRGTQVTPTRAVTEQQEDLTADTCLPVFQVRPMGPPTPLGRPYLPEGPLIKIDMPRKRYPAWDAHFVDRRLRRTINILQYVTPTAVGIRYRDGPLLYELLQYESSL

SEQ ID NO: 98000 - protein, 92 aa, Homo sapiens
  Payload ID: 19548
  Gene Name: XK, Kell blood group complex subunit-related family, member 6
  ENSP ID: ENSP00000436594
  MOD_RES (1)..(1): Any amino acid
XLVPSLLVQSLSFRWFVQDYTGGGLGAVEGLTSRGPPMMGAGYVHGAARGGPGVRVSPTPGAQRLCRLSVWIWQSVIHLLQMGQVWSSKRKT

SEQ ID NO: 98001 - protein, 579 aa, Homo sapiens
  Payload ID: 19549
  Gene Name: XK, Kell blood group complex subunit-related family, member 7
  Uniprot ID: Q5GH72
  ENSP ID: ENSP00000477059
MAAKSDGAAASASPDPEGAAGGARGSAGGRGEAAAAAGPPGVVGAGGPGPRYELRDCCWVLCALLVFFSDGATDLWLAASYYLQNQHTYFSLTLLFVLLPSLVVQLLSFRWFVYDYSEPAGSPGPAVSTKDSVAGGAAISTKDSAGAFRTKEGSPEPGPQPAPSSASAYRRRCCRLCIWLLQTLVHLLQLGQVWRYLRALYLGLQSRWRGERLRRHFYWQMLFESADVSMLRLLETFLRSAPQLVLQLSLLVHRGGAPDLLPALSTSASLVSLAWTLASYQKVLRDSRDDKRPLSYKGAVAQVLWHLFSIAARGLAFALFASVYKLYFGIFIVAHWCVMTFWVIQGETDFCMSKWEEIIYNMVVGIIYIFCWFNVKEGRSRRRMTLYHCIVLLENAALTGFWYSSRNFSTDFYSLIMVCVVASSFALGIFFMCVYYCLLHPNGPMLGPQAPGCIFRKASEPCGPPADAITSPPRSLPRTTGAERDGASAGERAGTPTPPVFQVRPGLPPTPVARTLRTEGPVIRIDLPRKKYPAWDAHFIDRRLRKTILALEYSSPATPRLQYRSVGTSQELLEYETTV

SEQ ID NO: 98002 - protein, 395 aa, Homo sapiens
  Payload ID: 19550
  Gene Name: XK, Kell blood group complex subunit-related family, member 8
  Uniprot ID: Q9H6D3
  ENSP ID: ENSP00000362991
MPWSSRGALLRDLVLGVLGTAAFLLDLGTDLWAAVQYALGGRYLWAALVLALLGLASVALQLFSWLWLRADPAGLHGSQPPRRCLALLHLLQLGYLYRCVQELRQGLLVWQQEEPSEFDLAYADFLALDISMLRLFETFLETAPQLTLVLAIMLQSGRAEYYQWVGICTSFLGISWALLDYHRALRTCLPSKPLLGLGSSVIYFLWNLLLLWPRVLAVALFSALFPSYVALHFLGLWLVLLLWVWLQGTDFMPDPSSEWLYRVTVATILYFSWFNVAEGRTRGRAIIHFAFLLSDSILLVATWVTHSSWLPSGIPLQLWLPVGCGCFFLGLALRLVYYHWLHPSCCWKPDPDQVDGARSLLSPEGYQLPQNRRMTHLAQKFFPKAKDEAASPVKG

SEQ ID NO: 98003 - protein, 373 aa, Homo sapiens
  Payload ID: 19551
  Gene Name: XK, Kell blood group complex subunit-related family, member 9
  Uniprot ID: Q5GH70
  ENSP ID: ENSP00000386141
MKYTKQNFMMSVLGIIIYVTDLIVDIWVSVRFFHEGQYVFSALALSFMLFGTLVAQCFSYSWFKADLKKAGQESQHCFLLLHCLQGGVFTRYWFALKRGYHAAFKYDSNTSNFVEEQIDLHKEVIDRVTDLSMLRLFETYLEGCPQLILQLYILLEHGQANFSQYAAIMVSCCAISWSTVDYQVALRKSLPDKKLLNGLCPKITYLFYKLFTLLSWMLSVVLLLFLNVKIALFLLLFLWLLGIIWAFKNNTQFCTCISMEFLYRIVVGFILIFTFFNIKGQNTKCPMSCYYIVRVLGTLGILTVFWVCPLTIFNPDYFIPISITIVLTLLLGILFLIVYYGSFHPNRSAETKCDEIDGKPVLRECRMRYFLME

SEQ ID NO: 98004 - protein, 89 aa, Homo sapiens
  Payload ID: 19551
  Gene Name: XK, Kell blood group complex subunit-related family, member 9
  ENSP ID: ENSP00000428904
MKYTKQNFMMSVLGIIIYVTDLIVDIWVSVRFFHEGQYVFSALALSFMLFGTLVAQCFSYSWFKADLKKAGQESQHCFLLLHCLQGGVF

SEQ ID NO: 98005 - protein, 125 aa, Homo sapiens
  Payload ID: 19551
  Gene Name: XK, Kell blood group complex subunit-related family, member 9
  ENSP ID: ENSP00000430781
MKYTKQNFMMSVLGIIIYVTDLIVDIWVSVRFFHEGQYVFSALALSFMLFGTLVAQCFSYSWFKADLKKAGQESQHCFLLLHCLQGGVFTRALLCHPGWPAVAPSQLIAASTSLVQEILLHQLPE

SEQ ID NO: 98006 - protein, 373 aa, Homo sapiens; identical to SEQ ID NO: 98003
  Payload ID: 19551
  Gene Name: XK, Kell blood group complex subunit-related family, member 9
  Uniprot ID: Q5GH70
  ENSP ID: ENSP00000431088

SEQ ID NO: 98007 - protein, 449 aa, Homo sapiens
  Payload ID: 19552
  Gene Name: XK, Kell blood group complex subunit-related, X-linked
  Uniprot ID: Q6PP77
  ENSP ID: ENSP00000362047
MDRVYEIPEEPNVDPVSSLEEDVIRGANPRFTFPFSILFSTFLYCGEAASALYMVRIYRKNSETYWMTYTFSFFMFSSIMVQLTLIFVHRDLAKDKPLSLFMHLILLGPVIRCLEAMIKYLTLWKKEEQEEPYVSLTRKKMLIDGEEVLIEWEVGHSIRTLAMHRNAYKRMSQIQAFLGSVPQLTYQLYVSLISAEVPLGRVVLMVFSLVSVTYGATLCNMLAIQIKYDDYKIRLGPLEVLCITIWRTLEITSRLLILVLFSATLKLKAVPFLVLNFLIILFEPWIKFWRSGAQMPNNIEKNFSRVGTLVVLISVTILYAGINFSCWSALQLRLADRDLVDKGQNWGHMGLHYSVRLVENVIMVLVFKFFGVKVLLNYCHSLIALQLIIAYLISIGFMLLFFQYLHPLRSLFTHNVVDYLHCVCCHQHPRTRVENSEPPFETEARQSVV

SEQ ID NO: 98008 - protein, 139 aa, Homo sapiens
  Payload ID: 19552
  Gene Name: XK, Kell blood group complex subunit-related, X-linked
  ENSP ID: ENSP00000419884
MDRVYEIPEEPNVDPVSSLEEDVIRGANPRFTFPFSILFSTFLYCGEAASALYMVRIYRKNSETYWMTYTFSFFMFSSIMVQLTLIFVHRDLAKDKPLSLFMHLILLGPVISCANGIFPGICHLWGHPLQYVGYPDQVR

SEQ ID NO: 98009 - protein, 497 aa, Homo sapiens
  Payload ID: 19553
  Gene Name: X-linked inhibitor of apoptosis, E3 ubiquitin protein ligase
  Uniprot ID: P98170
  ENSP ID: ENSP00000347858
MTFNSFEGSKTCVPADINKEEEFVEEFNRLKTFANFPSGSPVSASTLARAGFLYTGEGDTVRCFSCHAAVDRWQYGDSAVGRHRKVSPNCRFINGFYLENSATQSTNSGIQNGQYKVENYLGSRDHFALDRPSETHADYLLRTGQVVDISDTIYPRNPAMYSEEARLKSFQNWPDYAHLTPRELASAGLYYTGIGDQVQCFCCGGKLKNWEPCDRAWSEHRRHFPNCFFVLGRNLNIRSESDAVSSDRNFPNSTNLPRNPSMADYEARIFTFGTWIYSVNKEQLARAGFYALGEGDKVKCFHCGGGLTDWKPSEDPWEQHAKWYPGCKYLLEQKGQEYINNIHLTHSLEECLVRTTEKTPSLTRRIDDTIFQNPMVQEAIRMGFSFKDIKKIMEEKIQISGSNYKSLEVLVADLVNAQKDSMQDESSQTSLQKEISTEEQLRRLQEEKLCKICMDRNIAIVFVPCGHLVTCKQCAEAVDKCPMCYTVITFKQKIFMS

SEQ ID NO: 98010 - protein, 497 aa, Homo sapiens; identical to SEQ ID NO: 98009
  Payload ID: 19553
  Gene Name: X-linked inhibitor of apoptosis, E3 ubiquitin protein ligase
  Uniprot ID: P98170
  ENSP ID: ENSP00000360242

SEQ ID NO: 98011 - protein, 497 aa, Homo sapiens; identical to SEQ ID NO: 98009
  Payload ID: 19553
  Gene Name: X-linked inhibitor of apoptosis, E3 ubiquitin protein ligase
  Uniprot ID: P98170
  ENSP ID: ENSP00000395230

SEQ ID NO: 98012 - protein, 156 aa, Homo sapiens
  Payload ID: 19553
  Gene Name: X-linked inhibitor of apoptosis, E3 ubiquitin protein ligase
  ENSP ID: ENSP00000400637
MTFNSFEGSKTCVPADINKEEEFVEEFNRLKTFANFPSGSPVSASTLARAGFLYTGEGDTVRCFSCHAAVDRWQYGDSAVGRHRKVSPNCRFINGFYLENSATQSTNSGIQNGQYKVENYLGSRDHFALDRPSETHADYLLRTGQVVDISDTIYPR

SEQ ID NO: 98013 - protein, 16 aa, Homo sapiens
  Payload ID: 19553
  Gene Name: X-linked inhibitor of apoptosis, E3 ubiquitin protein ligase
  ENSP ID: ENSP00000405529
MTFNSFEGSKTCVPAD

SEQ ID NO: 98014 - protein, 444 aa, Homo sapiens
  Payload ID: 19554
  Gene Name: X-linked Kx blood group
  Uniprot ID: P51811
  ENSP ID: ENSP00000367879
MKFPASVLASVFLFVAETTAALSLSSTYRSGGDRMWQALTLLFSLLPCALVQLTLLFVHRDLSRDRPLVLLLHLLQLGPLFRCFEVFCIYFQSGNNEEPYVSITKKRQMPKNGLSEEIEKEVGQAEGKLITHRSAFSRASVIQAFLGSAPQLTLQLYISVMQQDVTVGRSLLMTISLLSIVYGALRCNILAIKIKYDEYEVKVKPLAYVCIFLWRSFEIATRVVVLVLFTSVLKTWVVVIILINFFSFFLYPWILFWCSGSPFPENIEKALSRVGTTIVLCFLTLLYTGINMFCWSAVQLKIDSPDLISKSHNWYQLLVYYMIRFIENAILLLLWYLFKTDIYMYVCAPLLVLQLLIGYCTAILFMLVFYQFFHPCKKLFSSSVSEGFQRWLRCFCWACRQQKPCEPIGKEDLQSSRDRDETPSSSKTSPEPGQFLNAEDLCSA

SEQ ID NO: 98015 - protein, 855 aa, Homo sapiens
  Payload ID: 19555
  Gene Name: XPA binding protein 2
  Uniprot ID: Q9HCS7
  ENSP ID: ENSP00000351137
MVVMARLSRPERPDLVFEEEDLPYEEEIMRNQFSVKCWLRYIEFKQGAPKPRLNQLYERALKLLPCSYKLWYRYLKARRAQVKHRCVTDPAYEDVNNCHERAFVFMHKMPRLWLDYCQFLMDQGRVTHTRRTFDRALRALPITQHSRIWPLYLRFLRSHPLPETAVRGYRRFLKLSPESAEEYIEYLKSSDRLDEAAQRLATVVNDERFVSKAGKSNYQLWHELCDLISQNPDKVQSLNVDAIIRGGLTRFTDQLGKLWCSLADYYIRSGHFEKARDVYEEAIRTVMTVRDFTQVFDSYAQFEESMIAAKMETASELGREEEDDVDLELRLARFEQLISRRPLLLNSVLLRQNPHHVHEWHKRVALHQGRPREIINTYTEAVQTVDPFKATGKPHTLWVAFAKFYEDNGQLDDARVILEKATKVNFKQVDDLASVWCQCGELELRHENYDEALRLLRKATALPARRAEYFDGSEPVQNRVYKSLKVWSMLADLEESLGTFQSTKAVYDRILDLRIATPQIVINYAMFLEEHKYFEESFKAYERGISLFKWPNVSDIWSTYLTKFIARYGGRKLERARDLFEQALDGCPPKYAKTLYLLYAQLEEEWGLARHAMAVYERATRAVEPAQQYDMFNIYIKRAAEIYGVTHTRGIYQKAIEVLSDEHAREMCLRFADMECKLGEIDRARAIYSFCSQICDPRTTGAFWQTWKDFEVRHGNEDTIKEMLRIRRSVQATYNTQVNFMASQMLKVSGSATGTVSDLAPGQSGMDDMKLLEQRAEQLAAEAERDQPLRAQSKILFVRSDASREELAELAQQVNPEEIQLGEDEDEDEMDLEPNEVRLEQQSVPAAVFGSLKED

SEQ ID NO: 98016 - protein, 642 aa, Homo sapiens
  Payload ID: 19556
  Gene Name: X-prolyl aminopeptidase (aminopeptidase P) 1, soluble
  Uniprot ID: Q9NQW7
  ENSP ID: ENSP00000324011
MAASRKPPRVRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYADGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 98017 - protein, 552 aa, Homo sapiens
  Payload ID: 19556
  Gene Name: X-prolyl aminopeptidase (aminopeptidase P) 1, soluble
  ENSP ID: ENSP00000358697
MWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 98018 - protein, 303 aa, Homo sapiens
  Payload ID: 19556
  Gene Name: X-prolyl aminopeptidase (aminopeptidase P) 1, soluble
  ENSP ID: ENSP00000385388
MPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIP

SEQ ID NO: 98019 - protein, 233 aa, Homo sapiens
  Payload ID: 19556
  Gene Name: X-prolyl aminopeptidase (aminopeptidase P) 1, soluble
  ENSP ID: ENSP00000410318
MPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGLFNLRGSDVEHNPVFFSYAIIGLETIMLFIDGDRIDAPSVKEHLLLDLGLEAEYRIQV

SEQ ID NO: 98020 - protein, 666 aa, Homo sapiens
  Payload ID: 19556
  Gene Name: X-prolyl aminopeptidase (aminopeptidase P) 1, soluble
  Uniprot ID: Q9NQW7
  ENSP ID: ENSP00000421566
MAASRKPPRVRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 98021 - protein, 183 aa, Homo sapiens
  Payload ID: 19557
  Gene Name: X-prolyl aminopeptidase (aminopeptidase P) 2, membrane-bound
  ENSP ID: ENSP00000360146
MARAHWGCCPWLVLLCACAWGHTKPVDLGGQDVRNCSTNPPYLPVTVVNTTMSLTALRQQMQTQNLSAYIIPGTDAHMNEYIGQHDERRAWITGFTGSAGTAVVTMKKAAVWTDSRYWTQAERQMDCNWELHKEVGTTPIVTWLLTEIPAGGRVGFDPFLLSIGMLFLQSLNLSMLTRVTQLP

SEQ ID NO: 98022 - protein, 674 aa, Homo sapiens
  Payload ID: 19557
  Gene Name: X-prolyl aminopeptidase (aminopeptidase P) 2, membrane-bound
  Uniprot ID: O43895
  ENSP ID: ENSP00000360147
MARAHWGCCPWLVLLCACAWGHTKPVDLGGQDVRNCSTNPPYLPVTVVNTTMSLTALRQQMQTQNLSAYIIPGTDAHMNEYIGQHDERRAWITGFTGSAGTAVVTMKKAAVWTDSRYWTQAERQMDCNWELHKEVGTTPIVTWLLTEIPAGGRVGFDPFLLSIDTWESYDLALQGSNRQLVSITTNLVDLVWGSERPPVPNQPIYALQEAFTGSTWQEKVSGVRSQMQKHQKVPTAVLLSALEETAWLFNLRASDIPYNPFFYSYTLLTDSSIRLFANKSRFSSETLSYLNSSCTGPMCVQIEDYSQVRDSIQAYSLGDVRIWIGTSYTMYGIYEMIPKEKLVTDTYSPVMMTKAVKNSKEQALLKASHVRDAVAVIRYLVWLEKNVPKGTVDEFSGAEIVDKFRGEEQFSSGPSFETISASGLNAALAHYSPTKELNRKLSSDEMYLLDSGGQYWDGTTDITRTVHWGTPSAFQKEAYTRVLIGNIDLSRLIFPAATSGRMVEAFARRALWDAGLNYGHGTGHGIGNFLCVHEWPVGFQSNNIAMAKGMFTSIEPGYYKDGEFGIRLEDVALVVEAKTKYPGSYLTFEVVSFVPYDRNLIDVSLLSPEHLQYLNRYYQTIREKVGPELQRRQLLEEFEWLQQHTEPLAARAPDTASWASVLVVSTLAILGWSV

SEQ ID NO: 98023 - protein, 507 aa, Homo sapiens
  Payload ID: 19558
  Gene Name: X-prolyl aminopeptidase 3, mitochondrial
  Uniprot ID: Q9NQH7
  ENSP ID: ENSP00000349658
MPWLLSAPKLVPAVANVRGLSGCMLCSQRRYSLQPVPERRIPNRYLGQPSPFTHPHLLRPGEVTPGLSQVEYALRRHKLMSLIQKEAQGQSGTDQTVVVLSNPTYYMSNDIPYTFHQDNNFLYLCGFQEPDSILVLQSLPGKQLPSHKAILFVPRRDPSRELWDGPRSGTDGAIALTGVDEAYTLEEFQHLLPKMKAETNMVWYDWMRPSHAQLHSDYMQPLTEAKAKSKNKVRGVQQLIQRLRLIKSPAEIERMQIAGKLTSQAFIETMFTSKAPVEEAFLYAKFEFECRARGADILAYPPVVAGGNRSNTLHYVKNNQLIKDGEMVLLDGGCESSCYVSDITRTWPVNGRFTAPQAELYEAVLEIQRDCLALCFPGTSLENIYSMMLTLIGQKLKDLGIMKNIKENNAFKAARKYCPHHVGHYLGMDVHDTPDMPRSLPLQPGMVITIEPGIYIPEDDKDAPEKFRGLGVRIEDDVVVTQDSPLILSADCPKEMNDIEQICSQAS

SEQ ID NO: 98024 - protein, 69 aa, Homo sapiens
  Payload ID: 19558
  Gene Name: X-prolyl aminopeptidase 3, mitochondrial
  ENSP ID: ENSP00000394283
MPWLLSAPKLVPAVANVRGLSGCMLCSQRRYSLQPVPERRIPNRYLGQPSPFTHPHLLRPDSNSCWEVG

SEQ ID NO: 98025 - protein, 55 aa, Homo sapiens
  Payload ID: 19558
  Gene Name: X-prolyl aminopeptidase 3, mitochondrial
  ENSP ID: ENSP00000483752
MPWLLSAPKLVPAVANVRGLSGSYFVTQAGVQWRDPITLQPMSSRLKQSFYQLPE

SEQ ID NO: 98026 - protein, 517 aa, Homo sapiens
  Payload ID: 19559
  Gene Name: X-ray radiation resistance associated 1
  Uniprot ID: Q6P2D8
  ENSP ID: ENSP00000319303
MLDDNRLSNPSCFASLAGLRRLKKLSLDENRIIRIPYLQQVQLYDESVDWNGGRGSPHKEPQFMLQSKPRMLEDSDEQLDYTVLPMKKDVDRTEVVFSSYPGFSTSEIAKEDAVLPVALFPSLCEFVFHNNPLVAHTRGVPPLLKSFLQERLGIHLIRRKIVKPKHHVLMSRKESWKVKSEIPKVPKQPLVLHHPRMTTTKSPSKDMLEPEAELAEDLPTTKSTSVESEMPTENLEGHSPSCRTFVPLPPICSNSTVHSEETLSHLSDTTVRLSPERPSDEDSKSTESIFLTQVSELPSSVIHKDDLELKEKDQKKPPTAPREVKGTRRKLPTAFLPSKYHGYEELLTAKPDPAFIEPKGIQKNAQALQQMLKHPLLCHSSKPKLDTLQKPYVHKEKRAQRIPIPPPKKTRAQLLDDIFIRLRDPRNITEAPLGAVLHQWTERRLVNHKQYLEAKRLLKEFQARYRQLVSGSLRTVFGTTPLPMACPALSESQPKFGHFLEFMDEFCQEPTASDSQG

SEQ ID NO: 98027 - protein, 792 aa, Homo sapiens
  Payload ID: 19559
  Gene Name: X-ray radiation resistance associated 1
  Uniprot ID: Q6P2D8
  ENSP ID: ENSP00000339918
MAFSGIYKLDDGKPYLNNCFPARNLLRVPEEGQGHWLVVQKGNLKKKPKGLVGAQAERRESLKATSFEFKGKKESRRENQVDLPGHILDQAFLLKHHCVRKPSDLCTINAKENDFKHFHSVIYINASENLLPLEAFHTFPALKELDLAFNGIKTIYVKYGDFKLLEFLDLSFNSLTVEAICDLGILPHLRVLLLTGNGLTSLPPNLAVAEQEASVTSLTSKRYILRFPALETLMLDDNRLSNPSCFASLAGLRRLKKLSLDENRIIRIPYLQQVQLYDESVDWNGGRGSPHKEPQFMLQSKPRMLEDSDEQLDYTVLPMKKDVDRTEVVFSSYPGFSTSETTKICSLPPIFEILPVKSLKARNQTLAPPFPELRYLSLAYNKIAKEDAVLPVALFPSLCEFVFHNNPLVAHTRGVPPLLKSFLQERLGIHLIRRKIVKPKHHVLMSRKESWKVKSEIPKVPKQPLVLHHPRMTTTKSPSKDMLEPEAELAEDLPTTKSTSVESEMPTENLEGHSPSCRTFVPLPPICSNSTVHSEETLSHLSDTTVRLSPERPSDEDSKSTESIFLTQVSELPSSVIHKDDLELKEKDQKKPPTAPREVKGTRRKLPTAFLPSKYHGYEELLTAKPDPAFIEPKGIQKNAQALQQMLKHPLLCHSSKPKLDTLQKPYVHKEKRAQRIPIPPPKKTRAQLLDDIFIRLRDPRNITEAPLGAVLHQWTERRLVNHKQYLEAKRLLKEFQARYRQLVSGSLRTVFGTTPLPMACPALSESQPKFGHFLEFMDEFCQEPTASDSQG

SEQ ID NO: 98028 - protein, 63 aa, Homo sapiens
  Payload ID: 19559
  Gene Name: X-ray radiation resistance associated 1
  ENSP ID: ENSP00000432689
  MOD_RES (1)..(1): Any amino acid
XRGSPHKEPQFMLQSKPRMLEDSDEQLDYTVLPMKKDVDRTDRKRGCCPTSSSLPISLRVRLS

SEQ ID NO: 98029 - protein, 115 aa, Homo sapiens
  Payload ID: 19559
  Gene Name: X-ray radiation resistance associated 1
  ENSP ID: ENSP00000433431
MLDDNRLSNPSCFASLAGLRRLKKLSLDENRIIRIPYLQQVQLYDESVDWNGGRGSPHKEPQFMLQSKPRMLEDSDEQLDYTVLPMKKDVDRTDRKRGCCPTSSSLPISLRVRLS

SEQ ID NO: 98030 - protein, 19 aa, Homo sapiens
  Payload ID: 19559
  Gene Name: X-ray radiation resistance associated 1
  ENSP ID: ENSP00000433940
MLDDNRLSNPSCFASLAGL

SEQ ID NO: 98031 - protein, 55 aa, Homo sapiens
  Payload ID: 19559
  Gene Name: X-ray radiation resistance associated 1
  ENSP ID: ENSP00000435662
MLDDNRLSNPSCFASLAGLRRLKKLSLDENRIIRIPYLQQVQLYDESVDWNGGRG

SEQ ID NO: 98032 - protein, 598 aa, Homo sapiens
  Payload ID: 19559
  Gene Name: X-ray radiation resistance associated 1
  Uniprot ID: Q6P2D8
  ENSP ID: ENSP00000435838
MAFSGIYKLDDGKPYLNNCFPARNLLRVPEEGQGHWLVVQKGNLKKKPKGLVGAQAERRESLKATSFEFKGKKESRRENQVDLPGHILDQAFLLKHHCVRKPSDLCTINAKENDFKHFHSVIYINASENLLPLEAFHTFPALKELDLAFNGIKTIYVKYGDFKLLEFLDLSFNSLTVEAICDLGILPHLRVLLLTGNGLTSLPPNLAVAEQEASVTSLTSKRYILRFPALETLMLDDNRLSNPSCFASLAGLRRLKKLSLDENRIIRIPYLQQVQLYDESVDWNGGRGSPHKEPQFMLQSKPRMLEDSDEQLDYTVLPMKKDVDRTGVPPLLKSFLQERLGIHLIRRKIVKPKHHVLMSRKESWKVKSEIPKVPKQPLVLHHPRMTTTKSPSKDMLEPEAELAEDLPTTKSTSVESEMPTENLEGHSPSCRTFVPLPPICSNSTVHSEETLSHLSDTTVRLSPERPSDEDSKSTESIFLTQVSELPSSVIHKDDLELKEKDQKKPPTAPREVKGTRRKLPTAFLPSKYHGYEELLTAKPDPAFIEPKGIQKNAQALQQMLKHPLLCHSSKPKLDTLQKPYVHKEKRVLSCTSGQNGGW

SEQ ID NO: 98033 - protein, 241 aa, Homo sapiens
  Payload ID: 19559
  Gene Name: X-ray radiation resistance associated 1
  ENSP ID: ENSP00000436390
MSRKESWKVKSEIPKVPKQPLVLHHPRMTTTKSPSKDMLEPEAELAEDLPTTKSTSVESEMPTENLEGHSPSCRTFVPLPPICSNSTVHSEETLSHLSDTTVRLSPERPSDEDSKSTESIFLTQVSELPSSVIHKDDLELKEKDQKKPPTAPREVKGTRRKLPTAFLPSKYHGYEELLTAKPDPAFIEPKGIQKNAQALQQMLKHPLLCHSSKPKLDTLQKPYVHKEKRVLSCTSGQNGGW

SEQ ID NO: 98034 - protein, 296 aa, Homo sapiens
  Payload ID: 19559
  Gene Name: X-ray radiation resistance associated 1
  ENSP ID: ENSP00000437334
MAFSGIYKLDDGKPYLNNCFPARNLLRVPEEGQGHWLVVQKGNLKKKPKGLVGAQAERRESLKATSFEFKGKKESRRENQVDLPGHILDQAFLLKHHCVRKPSDLCTINVSGLKFSKAKENDFKHFHSVIYINASENLLPLEAFHTFPALKELDLAFNGIKTIYVKYGDFKLLEFLDLSFNSLTVEAICDLGILPHLRVLLLTGNGLTSLPPNLAVAEQEASVTSLTSKRYILRFPALETLMLDDNRLSNPSCFASLAGLRRLKKLSLDENRIIRIPYLQQVQLYDESVDWNGGRG

SEQ ID NO: 98035 - protein, 633 aa, Homo sapiens
  Payload ID: 19560
  Gene Name: X-ray repair complementing defective repair in Chinese hamster cells 1
  Uniprot ID: P18887
  ENSP ID: ENSP00000262887
MPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSQRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQA

SEQ ID NO: 98036 - protein, 602 aa, Homo sapiens
  Payload ID: 19560
  Gene Name: X-ray repair complementing defective repair in Chinese hamster cells 1
  ENSP ID: ENSP00000443671
MPEIRLRHVVSCSSQDSLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSQRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQA

SEQ ID NO: 98037 - protein, 292 aa, Homo sapiens
  Payload ID: 19560
  Gene Name: X-ray repair complementing defective repair in Chinese hamster cells 1
  ENSP ID: ENSP00000470045
MVTPQTSQRGSLAAPLGYFQVLFKTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATA

SEQ ID NO: 98038 - protein, 165 aa, Homo sapiens
  Payload ID: 19560
  Gene Name: X-ray repair complementing defective repair in Chinese hamster cells 1
  ENSP ID: ENSP00000470391
  MOD_RES (1)..(1): Any amino acid
XGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPANHQPSCRHLFPRDLNCQLQLVPQPQPQSLPEHRGQ

SEQ ID NO: 98039 - protein, 172 aa, Homo sapiens
  Payload ID: 19560
  Gene Name: X-ray repair complementing defective repair in Chinese hamster cells 1
  ENSP ID: ENSP00000471159
MPEIRLRHVVSCSSQDSTHCAENLLKADTYRKWRAAKAGEKTISVVLQVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGP

SEQ ID NO: 98040 - protein, 210 aa, Homo sapiens
  Payload ID: 19560
  Gene Name: X-ray repair complementing defective repair in Chinese hamster cells 1
  ENSP ID: ENSP00000472128
  MOD_RES (1)..(1): Any amino acid
XVTPQTSQRGSLAAPLGYFQVLFKLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGS

SEQ ID NO: 98041 - protein, 280 aa, Homo sapiens
  Payload ID: 19561
  Gene Name: X-ray repair complementing defective repair in Chinese hamster cells 2
  Uniprot ID: O43543
  ENSP ID: ENSP00000352271
MCSAFHRAESGTELLARLEGRSSLKEIEPNLFADEDSPVHGDILEFHGPEGTGKTEMLYHLTARCILPKSEGGLEVEVLFIDTDYHFDMLRLVTILEHRLSQSSEEIIKYCLGRFFLVYCSSSTHLLLTLYSLESMFCSHPSLCLLILDSLSAFYWIDRVNGGESVNLQESTLRKCSQCLEKLVNDYRLVLFATTQTIMQKASSSSEEPSHASRRLCDVDIDYRPYLCKAWQQLVKHRMFFSKQDDSQSSNQFSLVSRCLKSNSLKKHFFIIGESGVEFC

SEQ ID NO: 98042 - protein, 346 aa, Homo sapiens
  Payload ID: 19562
  Gene Name: X-ray repair complementing defective repair in Chinese hamster cells 3
  Uniprot ID: O43542
  ENSP ID: ENSP00000343392
MDLDLLDLNPRIIAAIKKAKLKSVKEVLHFSGPDLKRLTNLSSPEVWHLLRTASLHLRGSSILTALQLHQQKERFPTQHQRLSLGCPVLDALLRGGLPLDGITELAGRSSAGKTQLALQLCLAVQFPRQHGGLEAGAVYICTEDAFPHKRLQQLMAQQPRLRTDVPGELLQKLRFGSQIFIEHVADVDTLLECVNKKVPVLLSRGMARLVVIDSVAAPFRCEFDSQASAPRARHLQSLGATLRELSSAFQSPVLCINQVTEAMEEQGAAHGPLGFWDERVSPALGITWANQLLVRLLADRLREEEAALGCPARTLRVLSAPHLPPSSCSYTISAEGVRGTPGTQSH

SEQ ID NO: 98043 - protein, 45 aa, Homo sapiens
  Payload ID: 19562
  Gene Name: X-ray repair complementing defective repair in Chinese hamster cells 3
  ENSP ID: ENSP00000450738
MDLDLLDLNPRIIAAIKKAKLKSVKEVLHFSGPDLKRLTNLSSPE

SEQ ID NO: 98044 - protein, 47 aa, Homo sapiens
  Payload ID: 19562
  Gene Name: X-ray repair complementing defective repair in Chinese hamster cells 3
  ENSP ID: ENSP00000450780
MDLDLLDLNPRIIAAIKKAKLKSVKEVLHFSGPDLKRLTNLSSPEVW

SEQ ID NO: 98045 - protein, 150 aa, Homo sapiens
  Payload ID: 19562
  Gene Name: X-ray repair complementing defective repair in Chinese hamster cells 3
  ENSP ID: ENSP00000451118
MDLDLLDLNPRIIAAIKKAKLKSVKEVLHFSGPDLKRLTNLSSPEVWHLLRTASLHLRGSSILTALQLHQQKERFPTQHQRLSLGCPVLDALLRGGLPLDGITELAGRSSAGKTQLALQLCLAVQFPRQHGGLEAEWQYFFIGGTSEHIC

SEQ ID NO: 98046 - protein, 102 aa, Homo sapiens
  Payload ID: 19562
  Gene Name: X-ray repair complementing defective repair in Chinese hamster cells 3
  ENSP ID: ENSP00000451173
MDLDLLDLNPRIIAAIKKAKLKSVKEVLHFSGPDLKRLTNLSSPEVWHLLRTASLHLRGSSILTALQLHQQKERFPTQHQRLSLGCPVLDALLRGGLPLDGI

SEQ ID NO: 98047 - protein, 112 aa, Homo sapiens
  Payload ID: 19562
  Gene Name: X-ray repair complementing defective repair in Chinese hamster cells 3
  ENSP ID: ENSP00000451252
MDLDLLDLNPRIIAAIKKAKLKSVKEVLHFSGPDLKRLTNLSSPEVWHLLRTASLHLRGSSILTALQLHQQKERFPTQHQRLSLGCPVLDALLRGGLPLDGITELAGRSSAG

SEQ ID NO: 98048 - protein, 141 aa, Homo sapiens
  Payload ID: 19562
  Gene Name: X-ray repair complementing defective repair in Chinese hamster cells 3
  ENSP ID: ENSP00000451361
MARLVVIDSVAAPFRCEFDSQASAPRARHLQSLGATLRELSSAFQSPVLCINQVTEAMEEQGAAHGPLGFWDERVSPALGITWANQLLVRLLADRLREEEAALGCPARTLRVLSAPHLPPSSCSYTISAEGVRGTPGTQSH

SEQ ID NO: 98049 - protein, 346 aa, Homo sapiens; identical to SEQ ID NO: 98042
  Payload ID: 19562
  Gene Name: X-ray repair complementing defective repair in Chinese hamster cells 3
  Uniprot ID: O43542
  ENSP ID: ENSP00000451362

SEQ ID NO: 98050 - protein, 346 aa, Homo sapiens; identical to SEQ ID NO: 98042
  Payload ID: 19562
  Gene Name: X-ray repair complementing defective repair in Chinese hamster cells 3
  Uniprot ID: O43542
  ENSP ID: ENSP00000451974

SEQ ID NO: 98051 - protein, 61 aa, Homo sapiens
  Payload ID: 19562
  Gene Name: X-ray repair complementing defective repair in Chinese hamster cells 3
  ENSP ID: ENSP00000452389
MDLDLLDLNPRIIAAIKKAKLKSVKEVLHFSGPDLKRLTNLSSPEVWHLLRTASLHLRGSS

SEQ ID NO: 98052 - protein, 346 aa, Homo sapiens; identical to SEQ ID NO: 98042
  Payload ID: 19562
  Gene Name: X-ray repair complementing defective repair in Chinese hamster cells 3
  Uniprot ID: O43542
  ENSP ID: ENSP00000452598

SEQ ID NO: 98053 - protein, 150 aa, Homo sapiens; identical to SEQ ID NO: 98045
  Payload ID: 19562
  Gene Name: X-ray repair complementing defective repair in Chinese hamster cells 3
  ENSP ID: ENSP00000473569

SEQ ID NO: 98054 - protein, 334 aa, Homo sapiens
  Payload ID: 19563
  Gene Name: X-ray repair complementing defective repair in Chinese hamster cells 4
  Uniprot ID: Q13426
  ENSP ID: ENSP00000282268
MERKISRIHLVSEPSITHFLQVSWEKTLESGFVITLTDGHSAWTGTVSESEISQEADDMAMEKGKYVGELRKALLSGAGPADVYTFNFSKESCYFFFEKNLKDVSFRLGSFNLEKVENPAEVIRELICYCLDTIAENQAKNEHLQKENERLLRDWNDVQGRFEKCVSAKEALETDLYKRFILVLNEKKTKIRSLHNKLLNAAQEREKDIKQEGETAICSEMTADRDPVYDESTDEESENQTDLSGLASAAVSKDDSIISSLDVTDIAPSRKRRQRMQRNLGTEPKMAPQENQLQEKEKPDSSLPETSKKEHISAENMSLETLRNSSPEDLFDEI

SEQ ID NO: 98055 - protein, 336 aa, Homo sapiens
  Payload ID: 19563
  Gene Name: X-ray repair complementing defective repair in Chinese hamster cells 4
  Uniprot ID: Q13426
  ENSP ID: ENSP00000342011
MERKISRIHLVSEPSITHFLQVSWEKTLESGFVITLTDGHSAWTGTVSESEISQEADDMAMEKGKYVGELRKALLSGAGPADVYTFNFSKESCYFFFEKNLKDVSFRLGSFNLEKVENPAEVIRELICYCLDTIAENQAKNEHLQKENERLLRDWNDVQGRFEKCVSAKEALETDLYKRFILVLNEKKTKIRSLHNKLLNAAQEREKDIKQEGETAICSEMTADRDPVYDESTDEESENQTDLSGLASAAVSKDDSIISSLDVTDIAPSRKRRQRMQRNLGTEPKMAPQENQLQEKENSRPDSSLPETSKKEHISAENMSLETLRNSSPEDLFDEI

SEQ ID NO: 98056 - protein, 334 aa, Homo sapiens; identical to SEQ ID NO: 98054
  Payload ID: 19563
  Gene Name: X-ray repair complementing defective repair in Chinese hamster cells 4
  Uniprot ID: Q13426
  ENSP ID: ENSP00000379344

SEQ ID NO: 98057 - protein, 336 aa, Homo sapiens; identical to SEQ ID NO: 98055
  Payload ID: 19563
  Gene Name: X-ray repair complementing defective repair in Chinese hamster cells 4
  Uniprot ID: Q13426
  ENSP ID: ENSP00000421491

SEQ ID NO: 98058 - protein, 732 aa, Homo sapiens
  Payload ID: 19564
  Gene Name: X-ray repair complementing defective repair in Chinese hamster cells 5 (double-strand-brea k rejoining)
  Uniprot ID: P13010
  ENSP ID: ENSP00000375977
MVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAKKLKTEQGGAHFSVSSLAEGSVTSVGSVNPAENFRVLVKQKKASFEEASNQLINHIEQFLDTNETPYFMKSIDCIRAFREEAIKFSEEQRFNNFLKALQEKVEIKQLNHFWEIVVQDGITLITKEEASGSSVTAEEAKKFLAPKDKPSGDTAAVFEEGGDVDDLLDMI

SEQ ID NO: 98059 - protein, 732 aa, Homo sapiens; identical to SEQ ID NO: 98058
  Payload ID: 19564
  Gene Name: X-ray repair complementing defective repair in Chinese hamster cells 5 (double-strand-brea k rejoining)
  Uniprot ID: P13010
  ENSP ID: ENSP00000375978

SEQ ID NO: 98060 - protein, 19 aa, Homo sapiens
  Payload ID: 19564
  Gene Name: X-ray repair complementing defective repair in Chinese hamster cells 5 (double-strand-brea k rejoining)
  ENSP ID: ENSP00000395108
  MOD_RES (1)..(1): Any amino acid
XAKKVITMFVQRQPSDIFF

SEQ ID NO: 98061 - protein, 131 aa, Homo sapiens
  Payload ID: 19564
  Gene Name: X-ray repair complementing defective repair in Chinese hamster cells 5 (double-strand-brea k rejoining)
  ENSP ID: ENSP00000401318
MDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSK

SEQ ID NO: 98062 - protein, 609 aa, Homo sapiens
  Payload ID: 19565
  Gene Name: X-ray repair complementing defective repair in Chinese hamster cells 6
  Uniprot ID: P12956
  ENSP ID: ENSP00000352257
MSGWESYYKTEGDEEAEEEQEENLEASGDYKYSGRDSLIFLVDASKAMFESQSEDELTPFDMSIQCIQSVYISKIISSDRDLLAVVFYGTEKDKNSVNFKNIYVLQELDNPGAKRILELDQFKGQQGQKRFQDMMGHGSDYSLSEVLWVCANLFSDVQFKMSHKRIMLFTNEDNPHGNDSAKASRARTKAGDLRDTGIFLDLMHLKKPGGFDISLFYRDIISIAEDEDLRVHFEESSKLEDLLRKVRAKETRKRALSRLKLKLNKDIVISVGIYNLVQKALKPPPIKLYRETNEPVKTKTRTFNTSTGGLLLPSDTKRSQIYGSRQIILEKEETEELKRFDDPGLMLMGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPFTEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHDNEGSGSKRPKVEYSEEELKTHISKGTLGKFTVPMLKEACRAYGLKSGLKKQELLEALTKHFQD

SEQ ID NO: 98063 - protein, 609 aa, Homo sapiens; identical to SEQ ID NO: 98062
  Payload ID: 19565
  Gene Name: X-ray repair complementing defective repair in Chinese hamster cells 6
  Uniprot ID: P12956
  ENSP ID: ENSP00000353192

SEQ ID NO: 98064 - protein, 559 aa, Homo sapiens
  Payload ID: 19565
  Gene Name: X-ray repair complementing defective repair in Chinese hamster cells 6
  ENSP ID: ENSP00000384082
MKKQRKNKKRTLKQVCIQSVYISKIISSDRDLLAVVFYGTEKDKNSVNFKNIYVLQELDNPGAKRILELDQFKGQQGQKRFQDMMGHGSDYSLSEVLWVCANLFSDVQFKMSHKRIMLFTNEDNPHGNDSAKASRARTKAGDLRDTGIFLDLMHLKKPGGFDISLFYRDIISIAEDEDLRVHFEESSKLEDLLRKVRAKETRKRALSRLKLKLNKDIVISVGIYNLVQKALKPPPIKLYRETNEPVKTKTRTFNTSTGGLLLPSDTKRSQIYGSRQIILEKEETEELKRFDDPGLMLMGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPFTEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHDNEGSGSKRPKVEYSEEELKTHISKGTLGKFTVPMLKEACRAYGLKSGLKKQELLEALTKHFQD

SEQ ID NO: 98065 - protein, 609 aa, Homo sapiens; identical to SEQ ID NO: 98062
  Payload ID: 19565
  Gene Name: X-ray repair complementing defective repair in Chinese hamster cells 6
  Uniprot ID: P12956
  ENSP ID: ENSP00000384257

SEQ ID NO: 98066 - protein, 568 aa, Homo sapiens
  Payload ID: 19565
  Gene Name: X-ray repair complementing defective repair in Chinese hamster cells 6
  Uniprot ID: P12956
  ENSP ID: ENSP00000384941
MSGWESYYKTEGDEEAEEEQEENLEASGDYKYSGRDSLIFLVDASKAMFESQSEDELTPFDMSIQELDNPGAKRILELDQFKGQQGQKRFQDMMGHGSDYSLSEVLWVCANLFSDVQFKMSHKRIMLFTNEDNPHGNDSAKASRARTKAGDLRDTGIFLDLMHLKKPGGFDISLFYRDIISIAEDEDLRVHFEESSKLEDLLRKVRAKETRKRALSRLKLKLNKDIVISVGIYNLVQKALKPPPIKLYRETNEPVKTKTRTFNTSTGGLLLPSDTKRSQIYGSRQIILEKEETEELKRFDDPGLMLMGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPFTEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHDNEGSGSKRPKVEYSEEELKTHISKGTLGKFTVPMLKEACRAYGLKSGLKKQELLEALTKHFQD

SEQ ID NO: 98067 - protein, 559 aa, Homo sapiens; identical to SEQ ID NO: 98064
  Payload ID: 19565
  Gene Name: X-ray repair complementing defective repair in Chinese hamster cells 6
  ENSP ID: ENSP00000403679

SEQ ID NO: 98068 - protein, 246 aa, Homo sapiens
  Payload ID: 19566
  Gene Name: XRCC6 binding protein 1
  Uniprot ID: Q9Y6H3
  ENSP ID: ENSP00000300145
MAGAPDERRRGPAAGEQLQQQHVSCQVFPERLAQGNPQQGFFSSFFTSNQKCQLRLLKTLETNPYVKLLLDAMKHSGCAVNKDRHFSCEDCNGNVSGGFDASTSQIVLCQNNIHNQAHMNRVVTHELIHAFDHCRAHVDWFTNIRHLACSEVRAANLSGDCSLVNEIFRLHFGLKQHHQTCVRDRATLSILAVRNISKEVAKKAVDEVFESCFNDHEPFGRIPHNKTYARYAHRDFENRDRYYSNI

SEQ ID NO: 98069 - protein, 37 aa, Homo sapiens
  Payload ID: 19566
  Gene Name: XRCC6 binding protein 1
  ENSP ID: ENSP00000449550
  MOD_RES (1)..(1): Any amino acid
XAQGNPQQGFFSSFFTSNQKCQLRLLKTLETNSFVPE

SEQ ID NO: 98070 - protein, 246 aa, Homo sapiens; identical to SEQ ID NO: 98068
  Payload ID: 19566
  Gene Name: XRCC6 binding protein 1
  Uniprot ID: Q9Y6H3
  ENSP ID: ENSP00000460944

SEQ ID NO: 98071 - protein, 37 aa, Homo sapiens; identical to SEQ ID NO: 98069
  Payload ID: 19566
  Gene Name: XRCC6 binding protein 1
  ENSP ID: ENSP00000461300
  MOD_RES (1)..(1): Any amino acid

SEQ ID NO: 98072 - protein, 65 aa, Homo sapiens
  Payload ID: 19567
  Gene Name: XXbac-B562F10.12
  ENSP ID: ENSP00000392268
  MOD_RES (1)..(1): Any amino acid
XRGEDYLKETHCYDPGSNTWHTLADGPVRRAWHGMATLLNKLYVIGGSNNDAGYRRDVHQVRDQV

SEQ ID NO: 98073 - protein, 301 aa, Homo sapiens
  Payload ID: 19568
  Gene Name: XXbac-BCX105D18.9
  ENSP ID: ENSP00000454948
MLGLWGQRLPAAWVLLLLPFLPLLLLAAPAPHRESYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLPARPTHQSELLLLRLVCLKPPRRKKPACRVQRQSESWGPGLSCALS

SEQ ID NO: 98074 - protein, 301 aa, Homo sapiens; identical to SEQ ID NO: 98073
  Payload ID: 19568
  Gene Name: XXbac-BCX105D18.9
  ENSP ID: ENSP00000456236

SEQ ID NO: 98075 - protein, 127 aa, Homo sapiens; identical to SEQ ID NO: 22457
  Payload ID: 19568
  Gene Name: XXbac-BCX105D18.9
  ENSP ID: ENSP00000456424
  MOD_RES (1)..(1): Any amino acid

SEQ ID NO: 98076 - protein, 1266 aa, Homo sapiens
  Payload ID: 19569
  Gene Name: XXbac-BPG116M5.17
  ENSP ID: ENSP00000410815
MGPLMVLFCLLFLYPGLADSAPSCPQNVNISGGTFTLSHGWAPGSLLTYSCPQGLYPSPASRLCKSSGQWQTPGATRSLSKAVCKPGHCPNPGISLGAVRTGFRFGHGDKVRYRCSSNLVLTGSSERECQGNGVWSGTEPICRQPYSYDFPEDVAPALGTSFSHMLGATNPTQKTKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 98077 - protein, 1115 aa, Homo sapiens
  Payload ID: 19569
  Gene Name: XXbac-BPG116M5.17
  ENSP ID: ENSP00000418996
MGPLMVLFCLLFLYPGLADSAPSCPQNVNISGGTFTLSHGWAPGSLLTYSCPQGLYPSPASRLCKSSGQWQTPGATRSLSKAVCKPVRCPAPVSFENGIYTPRLGSYPVGGNVSFECEDGFILRGSPVRQCRPNGMWDGETAVCDNGDHENGTGTNTYAALNSVYLMMNNQMRLLGMETMAWQEIRHAIILLTDGKSNMGGSPKTAVDHIREILNINQKRNDYLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGGSAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 98078 - protein, 175 aa, Homo sapiens; identical to SEQ ID NO: 48494
  Payload ID: 19570
  Gene Name: XXbac-BPG181M17.5
  ENSP ID: ENSP00000412457

SEQ ID NO: 98079 - protein, 843 aa, Homo sapiens
  Payload ID: 19571
  Gene Name: XXbac-BPG246D15.9
  ENSP ID: ENSP00000391806
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLVRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNIAYGLQSCEDDKVMAAAQAAHADDFIQEMEHGIYTDVGEKGSQLAAGQKQRLAIARALVRDPRVLILDEATSALDVQCEQANGFWVGPLGGGSASESDPTGFLHDSRHRLSSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQEERAGVMSTGPIRNGDWTFQTVVMLEMTPELGHVYTCLVDHSSLLSPVSVEWRAQSEYSWRKMLSGIAAFLLGL

SEQ ID NO: 98080 - protein, 382 aa, Homo sapiens; identical to SEQ ID NO: 22401
  Payload ID: 19572
  Gene Name: XXbac-BPG32J3.19
  ENSP ID: ENSP00000421232

SEQ ID NO: 98081 - protein, 63 aa, Homo sapiens
  Payload ID: 19573
  Gene Name: XXbac-BPG32J3.20
  ENSP ID: ENSP00000475702
MGTSSIFLCVLFLCGALGLTMSPARGRLRCYICGFTKPCHPVPTECRDDEACGISIGTSDAHC

SEQ ID NO: 98082 - protein, 228 aa, Homo sapiens; identical to SEQ ID NO: 12141
  Payload ID: 19574
  Gene Name: XXbac-BPG32J3.22
  ENSP ID: ENSP00000365040

SEQ ID NO: 98083 - protein, 212 aa, Homo sapiens; identical to SEQ ID NO: 22403
  Payload ID: 19574
  Gene Name: XXbac-BPG32J3.22
  ENSP ID: ENSP00000387322

SEQ ID NO: 98084 - protein, 304 aa, Homo sapiens; identical to SEQ ID NO: 12174
  Payload ID: 19574
  Gene Name: XXbac-BPG32J3.22
  ENSP ID: ENSP00000483989

SEQ ID NO: 98085 - protein, 50 aa, Homo sapiens
  Payload ID: 19575
  Gene Name: XXcos-LUCA11.5
  ENSP ID: ENSP00000476225
MALSAETESHIYRALRTASGAAAHLVALGFTIFVAVLARPGSTPGILHHQ

SEQ ID NO: 98086 - protein, 393 aa, Homo sapiens
  Payload ID: 19576
  Gene Name: xyloside xylosyltransferase 1
  Uniprot ID: Q8NBI6
  ENSP ID: ENSP00000309640
MGLLRGGLPCARAMARLGAVRSHYCALLLAAALAVCAFYYLGSGRETFSSATKRLKEARAGAPAAPSPPALELARGSVAPAPGAKAKSLEGGGAGPVDYHLLMMFTKAEHNAALQAKARVALRSLLRLAKFEAHEVLNLHFVSEEASREVAKGLLRELLPPAAGFKCKVIFHDVAVLTDKLFPIVEAMQKHFSAGLGTYYSDSIFFLSVAMHQIMPKEILQIIQLDLDLKFKTNIRELFEEFDSFLPGAIIGIAREMQPVYRHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 98087 - protein, 187 aa, Homo sapiens
  Payload ID: 19576
  Gene Name: xyloside xylosyltransferase 1
  Uniprot ID: Q8NBI6
  ENSP ID: ENSP00000349179
MNGMSVLMKETLKSSVTPSPYEETGERQPSVNWAVSPHQTQNQWARWSWTSQPLELHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 98088 - protein, 84 aa, Homo sapiens
  Payload ID: 19576
  Gene Name: xyloside xylosyltransferase 1
  ENSP ID: ENSP00000393989
MVRCVPSAVIVCFLRPPQPGRTVIFHDVAVLTDKLFPIVEAMQKHFSAGLGTYYSDSIFFLSVAMHQIMPKECTPLVQGRTSCT

SEQ ID NO: 98089 - protein, 247 aa, Homo sapiens
  Payload ID: 19576
  Gene Name: xyloside xylosyltransferase 1
  ENSP ID: ENSP00000399422
MVRCVPSAVIVCFLRPPQPGRTVIFHDVAVLTDKLFPIVEAMQKHFSAGLGTYYSDSIFFLSVAMHQIMPKEILQIIQLDLDLKFKTNIRELFEEFDSFLPGAIIGIAREMQPVYRHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 98090 - protein, 114 aa, Homo sapiens
  Payload ID: 19576
  Gene Name: xyloside xylosyltransferase 1
  ENSP ID: ENSP00000405583
  MOD_RES (1)..(1): Any amino acid
XSPPALELARGSVAPAPGAKAKSLEGGGAGPVDYHLLMMFTKAEHNAALQAKARVALRSLLRLAKFEAHEVLNLHFVSEEASREVAKGLLRELLPPAAGFKCKFLTSEDGTGHQ

SEQ ID NO: 98091 - protein, 190 aa, Homo sapiens
  Payload ID: 19576
  Gene Name: xyloside xylosyltransferase 1
  Uniprot ID: Q8NBI6
  ENSP ID: ENSP00000409865
MWPPRCKDPGRQSAEILQIIQLDLDLKFKTNIRELFEEFDSFLPGAIIGIAREMQPVYRHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 98092 - protein, 327 aa, Homo sapiens
  Payload ID: 19577
  Gene Name: xylosylprotein beta 1,4-galactosyltransferase, polypeptide 7
  Uniprot ID: Q9UBV7
  ENSP ID: ENSP00000029410
MFPSRRKAAQLPWEDGRSGLLSGGLPRKCSVFHLFVACLSLGFFSLLWLQLSCSGDVARAVRGQGQETSGPPRACPPEPPPEHWEEDASWGPHRLAVLVPFRERFEELLVFVPHMRRFLSRKKIRHHIYVLNQVDHFRFNRAALINVGFLESSNSTDYIAMHDVDLLPLNEELDYGFPEAGPFHVASPELHPLYHYKTYVGGILLLSKQHYRLCNGMSNRFWGWGREDDEFYRRIKGAGLQLFRPSGITTGYKTFRHLHDPAWRKRDQKRIAAQKQEQFKVDREGGLNTVKYHVASRTALSVGGAPCTVLNIMLDCDKTATPWCTFS

SEQ ID NO: 98093 - protein, 36 aa, Homo sapiens
  Payload ID: 19577
  Gene Name: xylosylprotein beta 1,4-galactosyltransferase, polypeptide 7
  ENSP ID: ENSP00000420886
MRRFLSRKKIRHHIYVLNQVDHFRFNRAALINVGFL

SEQ ID NO: 98094 - protein, 42 aa, Homo sapiens
  Payload ID: 19577
  Gene Name: xylosylprotein beta 1,4-galactosyltransferase, polypeptide 7
  ENSP ID: ENSP00000423438
MRRFLSRKKIRHHIYVLNQVDHFRFNRAALINVGFLESSNST

SEQ ID NO: 98095 - protein, 77 aa, Homo sapiens
  Payload ID: 19577
  Gene Name: xylosylprotein beta 1,4-galactosyltransferase, polypeptide 7
  ENSP ID: ENSP00000423868
RGQGQETSGPPRACPPEPPPEHWEEDASWGPHRLAVLVPFRERFEELLVFVPHMRRFLSRKKIRHHIYVLNQVDHFR

SEQ ID NO: 98096 - protein, 170 aa, Homo sapiens
  Payload ID: 19577
  Gene Name: xylosylprotein beta 1,4-galactosyltransferase, polypeptide 7
  ENSP ID: ENSP00000425591
MFPSRRKAAQLPWEDGRSGLLSGGLPRKCSVFHLFVACLSLGFFSLLWLQLSCSGDVARAVRGQGQETSGPPRACPPEPPPEHWEEDASWGPHRLAVLVPFRERFEELLVFVPHMRRFLSRKKIRHHIYVLNQVDHFSLAHPAQVQPGSAHQRGLPGEQQQHGLHCHARR

SEQ ID NO: 98097 - protein, 959 aa, Homo sapiens
  Payload ID: 19578
  Gene Name: xylosyltransferase I
  Uniprot ID: Q86Y38
  ENSP ID: ENSP00000261381
MVAAPCARRLARRSHSALLAALTVLLLQTLVVWNFSSLDSGAGERRGGAAVGGGEQPPPAPAPRRERRDLPAEPAAARGGGGGGGGGGGGRGPQARARGGGPGEPRGQQPASRGALPARALDPHPSPLITLETQDGYFSHRPKEKVRTDSNNENSVPKDFENVDNSNFAPRTQKQKHQPELAKKPPSRQKELLKRKLEQQEKGKGHTFPGKGPGEVLPPGDRAAANSSHGKDVSRPPHARKTGGSSPETKYDQPPKCDISGKEAISALSRAKSKHCRQEIGETYCRHKLGLLMPEKVTRFCPLEGKANKNVQWDEDSVEYMPANPVRIAFVLVVHGRASRQLQRMFKAIYHKDHFYYIHVDKRSNYLHRQVLQVSRQYSNVRVTPWRMATIWGGASLLSTYLQSMRDLLEMTDWPWDFFINLSAADYPIRTNDQLVAFLSRYRDMNFLKSHGRDNARFIRKQGLDRLFLECDAHMWRLGDRRIPEGIAVDGGSDWFLLNRRFVEYVTFSTDDLVTKMKQFYSYTLLPAESFFHTVLENSPHCDTMVDNNLRITNWNRKLGCKCQYKHIVDWCGCSPNDFKPQDFHRFQQTARPTFFARKFEAVVNQEIIGQLDYYLYGNYPAGTPGLRSYWENVYDEPDGIHSLSDVTLTLYHSFARLGLRRAETSLHTDGENSCRYYPMGHPASVHLYFLADRFQGFLIKHHATNLAVSKLETLETWVMPKKVFKIASPPSDFGRLQFSEVGTDWDAKERLFRNFGGLLGPMDEPVGMQKWGKGPNVTVTVIWVDPVNVIAATYDILIESTAEFTHYKPPLNLPLRPGVWTVKILHHWVPVAETKFLVAPLTFSNRQPIKPEEALKLHNGPLRNAYMEQSFQSLNPVLSLPINPAQVEQARRNAASTGTALEGWLDSLVGGMWTAMDICATGPTACPVMQTCSQTAWSSFSPDPKSELGAVKPDGRLR

SEQ ID NO: 98098 - protein, 865 aa, Homo sapiens [sequence omitted]

SEQ ID NO: 98099 - protein, 639 aa, Homo sapiens
  Payload ID: 19579
  Gene Name: xylosyltransferase II
  ENSP ID: ENSP00000365733
MVASARVQKLVRRYKLAIATALAILLLQGLVVWSFSGLEEDEAGEKGRQRKPRPLDPGEGSKDTDSSAGRRGSTGRRHGRWRGRAESPGVPVAKVVRAVTSRQRASRRVPPAPPPEAPGRQNLSGAAAGEALVGAAGFPPHGDTGSVEGAPQPTDNGFTPKCEIVGKDALSALARASTKQCQQEIANVVCLHQAGSLMPKAVPRHCQLTGKMSPGIQWDESQAQQPMDGPPVRIAYMLVVHGRAIRQLKRLLKAVYHEQHFFYIHVDKRSDYLHREVVELAQGYDNVRVTPWRMVTIWGGASLLRMYLRSMRDLLEVPGWAWDFFINLSATDYPTRTNEELVAFLSKNRDKNFLKSHGRDNSRFIKKQGLDRLFHECDSHMWRLGERQIPAGIVVDGGSDWFVLTRSFVEYVVYTDDPLVAQLRQFYTYTLLPAESFFHTVLENSLACETLVDNNLRVTNWNRKLGCKCQYKHIVDWCGCSPNDFKPQDFLRLQQVSRPTFFARKFESTVNQEVLEILDFHLYGSYPPGTPALKAYWENTYDAADGPSGLSDVMLTAYTAFARLSLHHAATAAPPMGTPLCRLALIGTPKSVFSGTLGGYWGRWTSLWPCSAGPGAPTSQPQWSGSTQPMWWPHLMTSQ

SEQ ID NO: 98100 - protein, 45 aa, Homo sapiens
  Payload ID: 19579
  Gene Name: xylosyltransferase II
  ENSP ID: ENSP00000425511
MVASARVQKLVRRYKLAIATALAILLLQGLKGRQRKPRPLDPGEG

SEQ ID NO: 98101 - protein, 676 aa, Homo sapiens
  Payload ID: 19579
  Gene Name: xylosyltransferase II
  ENSP ID: ENSP00000426501
MVASARVQKLVRRYKLAIATALAILLLQGLVVWSFSGLEEDEAGEKGRQRKPRPLDPGEGSKDTDSSAGRRGSTGRRHGRWRGRAESPGVPVAKVVRAVTSRQRASRRVPPAPPPEAPGRQNLSGAAAGEALVGAAGFPPHGDTGSVEGAPQPTDNGFTPKCEIVGKDALSALARASTKQCQQEIANVVCLHQAGSLMPKAVPRHCQLTGKMSPGIQWDESQAQQPMDGPPVRIAYMLVVHGRAIRQLKRLLKAVYHEQHFFYIHVDKRSDYLHREVVELAQGYDNVRVTPWRMVTIWGGASLLRMYLRSMRDLLEVPGWAWDFFINLSATDYPTRTNEELVAFLSKNRDKNFLKSHGRDNSRFIKKQGLDRLFHECDSHMWRLGERQIPAGIVVDGGSDWFVLTRSFVEYVVYTDDPLVAQLRQFYTYTLLPAESFFHTVLENSLACETLVDNNLRVTNWNRKLGCKCQYKHIVDWCGCSPNDFKPQDFLRLQQVSRPTFFARKFESTVNQEVLEILDFHLYGSYPPGTPALKAYWENTYDAADGPSGLSDVMLTAYTAFARLSLHHAATAAPPMGTPLCRFEPRGLPSSVHLYFYDDHFQGYLVTQAVQPSAQGPAETLEMWLMPQGSLKLLGRSDQASRLQSLENRGLSMLPRLVSNSWPQAVLPLQPPKALG

SEQ ID NO: 98102 - protein, 117 aa, Homo sapiens
  Payload ID: 19579
  Gene Name: xylosyltransferase II
  ENSP ID: ENSP00000428350
CQYKHIVDWCGCSPNDFKPQDFLRLQQVSRPTFFARKFESTVNQEVLEILDFHLYGSYPPGTPALKAYWENTYDAADGPSGLSDVMLTAYTAFARLSLHHAATAAPPMGTPLCRATW

SEQ ID NO: 98103 - protein, 46 aa, Homo sapiens
  Payload ID: 19579
  Gene Name: xylosyltransferase II
  ENSP ID: ENSP00000460517
ETLEMWLMPQGSLKLLGRSDQASRLQSLEVGQVPHLLSPNPHPDLG

SEQ ID NO: 98104 - protein, 536 aa, Homo sapiens
  Payload ID: 19580
  Gene Name: xylulokinase homolog (H. influenzae)
  Uniprot ID: O75191
  ENSP ID: ENSP00000207870
MAEHAPRRCCLGWDFSTQQVKVVAVDAELNVFYEESVHFDRDLPEFGTQGGVHVHKDGLTVTSPVLMWVQALDIILEKMKASGFDFSQVLALSGAGQQHGSIYWKAGAQQALTSLSPDLRLHQQLQDCFSISDCPVWMDSSTTAQCRQLEAAVGGAQALSCLTGSRAYERFTGNQIAKIYQQNPEAYSHTERISLVSSFAASLFLGSYSPIDYSDGSGMNLLQIQDKVWSQACLGACAPHLEEKLSPPVPSCSVVGAISSYYVQRYGFPPGCKVVAFTGDNPASLAGMRLEEGDIAVSLGTSDTLFLWLQEPMPALEGHIFCNPVDSQHYMALLCFKNGSLMREKIRNESVSRSWSDFSKALQSTEMGNGGNLGFYFDVMEITPEIIGRHRFNTENHKVAAFPGDVEVRALIEGQFMAKRIHAEGLGYRVMSKTKILATGGASHNREILQVLADVFDAPVYVIDTANSACVGSAYRAFHGLAGGTDVPFSEVVKLAPNPRLAATPSPGASQVYEALLPQYAKLEQRILSQTRGPPE

SEQ ID NO: 98105 - protein, 61 aa, Homo sapiens
  Payload ID: 19580
  Gene Name: xylulokinase homolog (H. influenzae)
  ENSP ID: ENSP00000398845
MAEHAPRRCCLGWDFSTQQVKVVAVDAELNVFYEESVHFDRDLPEFGNTEVYTGRLEPSRH

SEQ ID NO: 98106 - protein, 66 aa, Homo sapiens
  Payload ID: 19580
  Gene Name: xylulokinase homolog (H. influenzae)
  ENSP ID: ENSP00000412282
MAEHAPRRCCLGWDFSTQQVKVVAVDAELNVFYEESVHFDRDLPEFGATLEAHVEHDRATINLVPE

SEQ ID NO: 98107 - protein, 324 aa, Homo sapiens
  Payload ID: 19581
  Gene Name: Y box binding protein 1
  Uniprot ID: P67809
  ENSP ID: ENSP00000361626
MSSEAETQQPPAAPPAAPALSAADTKPGTTGSGAGSGGPGGLTSAAPAGGDKKVIATKVLGTVKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 98108 - protein, 374 aa, Homo sapiens
  Payload ID: 19581
  Gene Name: Y box binding protein 1
  ENSP ID: ENSP00000389639
  MOD_RES (1)..(1): Any amino acid
XRVRRGPLPADRPRALGPARRCSRHPHPAPFRVCSEGAAHRLRRPERLPLPSRALRPRPAHTPILGPAPRACPGAPRASDSPTCAAAAATAWPRTRAVERKGCQVAAAAGVRGTGCPSRADLEKDSWNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 98109 - protein, 216 aa, Homo sapiens
  Payload ID: 19581
  Gene Name: Y box binding protein 1
  ENSP ID: ENSP00000405937
MSSEAETQQPPAAPPAAPALSAADTKPGTTGSGAGSGGPGGLTSAAPAGGDKKVIATKVLGTVKWFNVRNGYGFINRNDTKEDVFVHQGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFR

SEQ ID NO: 98110 - protein, 320 aa, Homo sapiens
  Payload ID: 19581
  Gene Name: Y box binding protein 1
  ENSP ID: ENSP00000484416
MSSEAETQQPPAAPPAAPALSAADTKPGTTGAAQGAVARAAHIGGAGGDKKVIATKVLGTVKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEARPNNAGPTQAKVPTLLHAETYGRRPQYSNPPVQGEVMEGADNQGAGEQGRPVRQICIGDIDHDSAGALRQRQPREDGNEEDKENQGDETQGQQPPQRRYRRNFNYRRRRPENPKPQDGKETKAADPPAENSSAPEAEQGGAE

SEQ ID NO: 98111 - protein, 364 aa, Homo sapiens
  Payload ID: 19582
  Gene Name: Y box binding protein 2
  Uniprot ID: Q9Y2T7
  ENSP ID: ENSP00000007699
MSEVEAAAGATAVPAATVPATAAGVVAVVVPVPAGEPQKGGGAGGGGGAASGPAAGTPSAPGSRTPGNPATAVSGTPAPPARSQADKPVLAIQVLGTVKWFNVRNGYGFINRNDTKEDVFVHQTAIKRNNPRKFLRSVGDGETVEFDVVEGEKGAEATNVTGPGGVPVKGSRYAPNRRKSRRFIPRPPSVAPPPMVAEIPSAGTGPGSKGERAEDSGQRPRRWCPPPFFYRRRFVRGPRPPNQQQPIEGTDRVEPKETAPLEGHQQQGDERVPPPRFRPRYRRPFRPRPRQQPTTEGGDGETKPSQGPADGSRPEPQRPRNRPYFQRRRQQAPGPQQAPGPRQPAAPETSAPVNSGDPTTTILE

SEQ ID NO: 98112 - protein, 164 aa, Homo sapiens
  Payload ID: 19582
  Gene Name: Y box binding protein 2
  ENSP ID: ENSP00000459587
  MOD_RES (1)..(1): Any amino acid
XAGTGPGSKGERAEDSGQRPRRWCPPPFFYRRRFVRGPRPPNQQQPIEGTDRVEPKETAPLEGHQQQGDERVPPPRFRPRYRRPFRPRPRQQPTTEGGDGETKPSQGPADGSRPEPQRPRNRPYFQRRRQQAPGPQQAPGPRQPAAPETSAPVNSGDPTTTILE

SEQ ID NO: 98113 - protein, 372 aa, Homo sapiens
  Payload ID: 19583
  Gene Name: Y box binding protein 3
  Uniprot ID: P16989
  ENSP ID: ENSP00000228251
MSEAGEATTTTTTTLPQAPTEAAAAAPQDPAPKSPVGSGAPQAAAPAPAAHVAGNPGGDAAPAATGTAAAASLATAAGSEDAEKKVLATKVLGTVKWFNVRNGYGFINRNDTKEDVFVHQTAIKKNNPRKYLRSVGDGETVEFDVVEGEKGAEAANVTGPDGVPVEGSRYAADRRRYRRGYYGRRRGPPRNYAGEEEEEGSGSSEGFDPPATDRQFSGARNQLRRPQYRPQYRQRRFPPYHVGQTFDRRSRVLPHPNRIQAGEIGEMKDGVPEGAQLQGPVHRNPTYRPRYRSRGPPRPRPAPAVGEAEDKENQQATSGPNQPSVRRGYRRPYNYRRRPRPPNAPSQDGKEAKAGEAPTENPAPPTQQSSAE

SEQ ID NO: 98114 - protein, 303 aa, Homo sapiens
  Payload ID: 19583
  Gene Name: Y box binding protein 3
  Uniprot ID: P16989
  ENSP ID: ENSP00000279550
MSEAGEATTTTTTTLPQAPTEAAAAAPQDPAPKSPVGSGAPQAAAPAPAAHVAGNPGGDAAPAATGTAAAASLATAAGSEDAEKKVLATKVLGTVKWFNVRNGYGFINRNDTKEDVFVHQTAIKKNNPRKYLRSVGDGETVEFDVVEGEKGAEAANVTGPDGVPVEGSRYAADRRRYRRGYYGRRRGPPRNAGEIGEMKDGVPEGAQLQGPVHRNPTYRPRYRSRGPPRPRPAPAVGEAEDKENQQATSGPNQPSVRRGYRRPYNYRRRPRPPNAPSQDGKEAKAGEAPTENPAPPTQQSSAE

SEQ ID NO: 98115 - protein, 92 aa, Homo sapiens
  Payload ID: 19583
  Gene Name: Y box binding protein 3
  ENSP ID: ENSP00000485718
  MOD_RES (1)..(1): Any amino acid
XNDTKEDVFVHQTAIKKNNPRKYLRSVGDGETVEFDVVEGEKGAEAANVTGPDGVPVEGSRYAADRRRYRRGYYGRRRGPPRNISDVWFNRR

SEQ ID NO: 98116 - protein, 226 aa, Homo sapiens
  Payload ID: 19584
  Gene Name: Yae1 domain containing 1
  Uniprot ID: Q9NRH1
  ENSP ID: ENSP00000223273
MSWVQAASLIQGPGDKGDVFDEEADESLLAQREWQSNMQRRVKEGYRDGIDAGKAVTLQQGFNQGYKKGAEVILNYGRLRGTLSALLSWCHLHNNNSTLINKINNLLDAVGQCEEYVLKHLKSITPPSHVVDLLDSIEDMDLCHVVPAEKKIDEAKDERLCENNAEFNKNCSKSHSGIDCSYVECCRTQEHAHSENPSPTWILEQTASLVKQLGLSVDVLQHLKQL

SEQ ID NO: 98117 - protein, 206 aa, Homo sapiens
  Payload ID: 19584
  Gene Name: Yae1 domain containing 1
  Uniprot ID: Q9NRH1
  ENSP ID: ENSP00000395777
MSWVQAASLIQGPGDKGDVFDEEADESLLAQREWQSNMQRRVKEGYRDGIDAGKAVTLQQGFNQGYKKGAEVILNYGRLRGTLRNSTDWSLLGLRAPLRSPEVGTQLLPRPLPVPGHMASGATPKQPTELEATLLSLVPQSGRATPRFPARLRAPGPGTPSHRRRFRRKPHRDPAAACPAWPPEAPSNSETHFSTYNRIIIRGGHI

SEQ ID NO: 98118 - protein, 87 aa, Homo sapiens
  Payload ID: 19584
  Gene Name: Yae1 domain containing 1
  ENSP ID: ENSP00000400511
MSWVQAASLIQGPGDKGDVFDEEADESLLAQREWQSNMQRRVKEGYRDGIDAGKAVTLQQGFNQGYKKGAEVILNYGRLRGTLSWPV

SEQ ID NO: 98119 - protein, 167 aa, Homo sapiens
  Payload ID: 19585
  Gene Name: ybeY metallopeptidase (putative)
  Uniprot ID: P58557
  ENSP ID: ENSP00000329614
MSLVIRNLQRVIPIRRAPLRSKIEIVRRILGVQKFDLGIICVDNKNIQHINRIYRDRNVPTDVLSFPFHEHLKAGEFPQPDFPDDYNLGDIFLGVEYIFHQCKENEDYNDVLTVTATHGLCHLLGFTHGTEAEWQQMFQKEKAVLDELGRRTGTRLQPLTRGLFGGS

SEQ ID NO: 98120 - protein, 124 aa, Homo sapiens
  Payload ID: 19585
  Gene Name: ybeY metallopeptidase (putative)
  Uniprot ID: P58557
  ENSP ID: ENSP00000340675
MSLVIRNLQRVIPIRRAPLRSKIEIVRRILGVQKFDLGIICVDNKNIQHINRIYRDRNVPTDVLSFPFHEVTATHGLCHLLGFTHGTEAEWQQMFQKEKAVLDELGRRTGTRLQPLTRGLFGGS

SEQ ID NO: 98121 - protein, 167 aa, Homo sapiens; identical to SEQ ID NO: 98119
  Payload ID: 19585
  Gene Name: ybeY metallopeptidase (putative)
  Uniprot ID: P58557
  ENSP ID: ENSP00000380805

SEQ ID NO: 98122 - protein, 79 aa, Homo sapiens
  Payload ID: 19585
  Gene Name: ybeY metallopeptidase (putative)
  Uniprot ID: P58557
  ENSP ID: ENSP00000380806
MSLVIRNLQRVIPIRRAPLRSKIEIVTATHGLCHLLGFTHGTEAEWQQMFQKEKAVLDELGRRTGTRLQPLTRGLFGGS

SEQ ID NO: 98123 - protein, 122 aa, Homo sapiens
  Payload ID: 19585
  Gene Name: ybeY metallopeptidase (putative)
  Uniprot ID: P58557
  ENSP ID: ENSP00000380808
MSLVIRNLQRVIPIRRAPLRSKIEIHLKAGEFPQPDFPDDYNLGDIFLGVEYIFHQCKENEDYNDVLTVTATHGLCHLLGFTHGTEAEWQQMFQKEKAVLDELGRRTGTRLQPLTRGLFGGS

SEQ ID NO: 98124 - protein, 167 aa, Homo sapiens; identical to SEQ ID NO: 98119
  Payload ID: 19585
  Gene Name: ybeY metallopeptidase (putative)
  Uniprot ID: P58557
  ENSP ID: ENSP00000380813

SEQ ID NO: 98125 - protein, 323 aa, Homo sapiens
  Payload ID: 19586
  Gene Name: YdjC homolog (bacterial)
  Uniprot ID: A8MPS7
  ENSP ID: ENSP00000292778
MSRPRMRLVVTADDFGYCPRRDEGIVEAFLAGAVTSVSLLVNGAATESAAELARRHSIPTGLHANLSEGRPVGPARRGASSLLGPEGFFLGKMGFREAVAAGDVDLPQVREELEAQLSCFRELLGRAPTHADGHQHVHVLPGVCQVFAEALQAYGVRFTRLPLERGVGGCTWLEAPARAFACAVERDARAAVGPFSRHGLRWTDAFVGLSTCGRHMSAHRVSGALARVLEGTLAGHTLTAELMAHPGYPSVPPTGGCGEGPDAFSCSWERLHELRVLTAPTLRAQLAQDGVQLCALDDLDSKRPGEEVPCEPTLEPFLEPSLL

SEQ ID NO: 98126 - protein, 149 aa, Homo sapiens
  Payload ID: 19586
  Gene Name: YdjC homolog (bacterial)
  Uniprot ID: A8MPS7
  ENSP ID: ENSP00000381847
MSRPRMRLVVTADDFGYCPRRDEGIVEAFLAGAVTSVSLLVNGAATESAAELARRHSIPTGLHANLSEGRPVGPARRGASSLLGPEGFFLGKMGFREAVAAGDVDLPQVREELEAQLSCFRELLGRAPTHADGHQHVHVLPGGQTPSWA

SEQ ID NO: 98127 - protein, 136 aa, Homo sapiens
  Payload ID: 19586
  Gene Name: YdjC homolog (bacterial)
  Uniprot ID: A8MPS7
  ENSP ID: ENSP00000402481
MSRPRMRLVVTADDFGYCPRRDEGIVEAFLAGAVTSVSLLVNGAATESAAELARRHSIPTGLHANLSEGRPVGPARRGASSLLGPEGFFLGKMGFREAVAAGDVDLPQVRSRSYRRMLARTPRAPPGGCGRSSRPN

SEQ ID NO: 98128 - protein, 1422 aa, Homo sapiens
  Payload ID: 19587
  Gene Name: YEATS domain containing 2
  Uniprot ID: Q9ULM3
  ENSP ID: ENSP00000306983
MSGIKRTIKETDPDYEDVSVALPNKRHKAIENSARDAAVQKIETIIKEQFALEMKNKEHEIEVIDQRLIEARRMMDKLRACIVANYYASAGLLKVSEGSKTCDTMVFNHPAIKKFLESPSRSSSPANQRAETPSANHSESDSLSQHNDFLSDKDNNSNMDIEERLSNNMEQRPSRNTGRDTSRITGSHKTEQRNADLTDETSRLFVKKTIVVGNVSKYIPPDKREENDQSTHKWMVYVRGSRREPSINHFVKKVWFFLHPSYKPNDLVEVREPPFHLTRRGWGEFPVRVQVHFKDSQNKRIDIIHNLKLDRTYTGLQTLGAETVVDVELHRHSLGEDCIYPQSSESDISDAPPSLPLTIPAPVKASSPIKQSHEPVPDTSVEKGFPASTEAERHTPFYALPSSLERTPTKMTTSQKVTFCSHGNSAFQPIASSCKIVPQSQVPNPESPGKSFQPITMSCKIVSGSPISTPSPSPLPRTPTSTPVHVKQGTAGSVINNPYVIMDKQPGQVIGATTPSTGSPTNKISTASQVSQGTGSPVPKIHGSSFVTSTVKQEDSLFASMPPLCPIGSHPKVQSPKPITGGLGAFTKVIIKQEPGEAPHVPATGAASQSPLPQYVTVKGGHMIAVSPQKQVITPGEGIAQSAKVQPSKVVGVPVGSALPSTVKQAVAISGGQILVAKASSSVSKAVGPKQVVTQGVAKAIVSGGGGTIVAQPVQTLTKAQVTAAGPQKSGSQGSVMATLQLPATNLANLANLPPGTKLYLTTNSKNPSGKGKLLLIPQGAILRATNNANLQSGSAASGGSGAGGGGGGGGGGGSGSGGGGSTGGGGGTAGGGTQSTAGPGGISQHLTYTSYILKQTPQGTFLVGQPSPQTSGKQLTTGSVVQGTLGVSTSSAQGQQTLKVISGQKTTLFTQAAHGGQASLMKISDSTLKTVPATSQLSKPGTTMLRVAGGVITTATSPAVALSANGPAQQSEGMAPVSSSTVSSVTKTSGQQQVCVSQATVGTCKAATPTVVSATSLVPTPNPISGKATVSGLLKIHSSQSSPQQAVLTIPSQLKPLSVNTSGGVQTILMPVNKVVQSFSTSKPPAILPVAAPTPVVPSSAPAAVAKVKTEPETPGPSCLSQEGQTAVKTEESSELGNYVIKIDHLETIQQLLTAVVKKIPLITAKSEDASCFSAKSVEQYYGWNIGKRRAAEWQRAMTMRKVLQEILEKNPRFHHLTPLKTKHIAHWCRCHGYTPPDPESLRNDGDSIEDVLTQIDSEPECPSSFSSADNLCRKLEDLQQFQKREPENEEEVDILSLSEPVKINIKKEQEEKQEEVKFYLPPTPGSEFIGDVTQKIGITLQPVALHRNVYASVVEDMILKATEQLVNDILRQALAVGYQTASHNRIPKEITVSNIHQAICNIPFLDFLTNKHMGILNEDQ

SEQ ID NO: 98129 - protein, 219 aa, Homo sapiens
  Payload ID: 19587
  Gene Name: YEATS domain containing 2
  ENSP ID: ENSP00000406477
  MOD_RES (1)..(1): Any amino acid
XGSGGGGSTGGGGGTAGGGTQSTAGPGGISQHLTYTSYILKQTPQGTFLVGQPSPQTSGKQLTTGSVVQGTLGVSTSSAQGQQTLKVISGQKTTLFTQAAHGGQASLMKISDSTLKTVPATSQLSKPGTTMLRVAGGVITTATSPAVALSANGPAQQSEGMAPVSSSTVSSVTKTSGQQQVCVSQATVGTCKAATPTVVSATSLVPTPNPISGKATVSD

SEQ ID NO: 98130 - protein, 227 aa, Homo sapiens
  Payload ID: 19588
  Gene Name: YEATS domain containing 4
  Uniprot ID: O95619
  ENSP ID: ENSP00000247843
MFKRMAEFGPDSGGRVKGVTIVKPIVYGNVARYFGKKREEDGHTHQWTVYVKPYRNEDMSAYVKKIQFKLHESYGNPLRVVTKPPYEITETGWGEFEIIIKIFFIDPNERPVTLYHLLKLFQSDTNAMLGKKTVVSEFYDEMIFQDPTAMMQQLLTTSRQLTLGAYKHETEFAELEVKTREKLEAAKKKTSFEIAELKERLKASRETINCLKNEIRKLEEDDQAKDI

SEQ ID NO: 98131 - protein, 211 aa, Homo sapiens
  Payload ID: 19588
  Gene Name: YEATS domain containing 4
  ENSP ID: ENSP00000446985
MFKRMAEFGPDSGGRVKGVTIVKPIVYGNVARYFGKKREEDGHTHQWTVYVKPYRNEAKWLIPVISALWEAQAGGSLEPRSLRPDWQHSKTPSLQKKKDMSAYVKKIQFKLHESYGNPLRVVTKPPYEITETGWGEFEIIIKIFFIDPNERPVTLYHLLKLFQSDTNAMLGKKTVVSEFYDEMIFQDPTAMMQQLLTTSRQLTLGAYKHET

SEQ ID NO: 98132 - protein, 173 aa, Homo sapiens
  Payload ID: 19588
  Gene Name: YEATS domain containing 4
  ENSP ID: ENSP00000447199
MFKRMAEFGPDSGGRVKGVTIVKPIVYGNVARYFGKKREEDGHTHQWTVYVKPYRNEVTLYHLLKLFQSDTNAMLGKKTVVSEFYDEMIFQDPTAMMQQLLTTSRQLTLGAYKHETEFAELEVKTREKLEAAKKKTSFEIAELKERLKASRETINCLKNEIRKLEEDDQAKDI

SEQ ID NO: 98133 - protein, 113 aa, Homo sapiens
  Payload ID: 19588
  Gene Name: YEATS domain containing 4
  ENSP ID: ENSP00000448106
MSAYVKKIQFKLHESYGNPLRVVTKPPYEITETGWGEFEIIIKIFFIDPNERPVTLYHLLKLFQSDTNAMLGKKTVVSEFYDEMIFQDPTAMMQQLLTTSRQLTLGAYKHETE

SEQ ID NO: 98134 - protein, 543 aa, Homo sapiens
  Payload ID: 19589
  Gene Name: YES proto-oncogene 1, Src family tyrosine kinase
  Uniprot ID: P07947
  ENSP ID: ENSP00000324740
MGCIKSKENKSPAIKYRPENTPEPVSTSVSHYGAEPTTVSPCPSSSAKGTAVNFSSLSMTPFGGSSGVTPFGGASSSFSVVPSSYPAGLTGGVTIFVALYDYEARTTEDLSFKKGERFQIINNTEGDWWEARSIATGKNGYIPSNYVAPADSIQAEEWYFGKMGRKDAERLLLNPGNQRGIFLVRESETTKGAYSLSIRDWDEIRGDNVKHYKIRKLDNGGYYITTRAQFDTLQKLVKHYTEHADGLCHKLTTVCPTVKPQTQGLAKDAWEIPRESLRLEVKLGQGCFGEVWMGTWNGTTKVAIKTLKPGTMMPEAFLQEAQIMKKLRHDKLVPLYAVVSEEPIYIVTEFMSKGSLLDFLKEGDGKYLKLPQLVDMAAQIADGMAYIERMNYIHRDLRAANILVGENLVCKIADFGLARLIEDNEYTARQGAKFPIKWTAPEAALYGRFTIKSDVWSFGILQTELVTKGRVPYPGMVNREVLEQVERGYRMPCPQGCPESLHELMNLCWKKDPDERPTFEYIQSFLEDYFTATEPQYQPGENL

SEQ ID NO: 98135 - protein, 543 aa, Homo sapiens; identical to SEQ ID NO: 98134
  Payload ID: 19589
  Gene Name: YES proto-oncogene 1, Src family tyrosine kinase
  Uniprot ID: P07947
  ENSP ID: ENSP00000462468

SEQ ID NO: 98136 - protein, 548 aa, Homo sapiens
  Payload ID: 19589
  Gene Name: YES proto-oncogene 1, Src family tyrosine kinase
  ENSP ID: ENSP00000464380
MLDLIMGCIKSKENKSPAIKYRPENTPEPVSTSVSHYGAEPTTVSPCPSSSAKGTAVNFSSLSMTPFGGSSGVTPFGGASSSFSVVPSSYPAGLTGGVTIFVALYDYEARTTEDLSFKKGERFQIINNTEGDWWEARSIATGKNGYIPSNYVAPADSIQAEEWYFGKMGRKDAERLLLNPGNQRGIFLVRESETTKGAYSLSIRDWDEIRGDNVKHYKIRKLDNGGYYITTRAQFDTLQKLVKHYTEHADGLCHKLTTVCPTVKPQTQGLAKDAWEIPRESLRLEVKLGQGCFGEVWMGTWNGTTKVAIKTLKPGTMMPEAFLQEAQIMKKLRHDKLVPLYAVVSEEPIYIVTEFMSKGSLLDFLKEGDGKYLKLPQLVDMAAQIADGMAYIERMNYIHRDLRAANILVGENLVCKIADFGLARLIEDNEYTARQGAKFPIKWTAPEAALYGRFTIKSDVWSFGILQTELVTKGRVPYPGMVNREVLEQVERGYRMPCPQGCPESLHELMNLCWKKDPDERPTFEYIQSFLEDYFTATEPQYQPGENL

SEQ ID NO: 98137 - protein, 504 aa, Homo sapiens
  Payload ID: 19590
  Gene Name: Yes-associated protein 1
  Uniprot ID: P46937
  ENSP ID: ENSP00000282441
MDPGQQPPPQPAPQGQGQPPSQPPQGQGPPSGPGQPAPAATQAAPQAPPAGHQIVHVRGDSETDLEALFNAVMNPKTANVPQTVPMRLRKLPDSFFKPPEPKSHSRQASTDAGTAGALTPQHVRAHSSPASLQLGAVSPGTLTPTGVVSGPAATPTAQHLRQSSFEIPDDVPLPAGWEMAKTSSGQRYFLNHIDQTTTWQDPRKAMLSQMNVTAPTSPPVQQNMMNSASGPLPDGWEQAMTQDGEIYYINHKNKTTSWLDPRLDPRFAMNQRISQSAPVKQPPPLAPQSPQGGVMGGSNSNQQQQMRLQQLQMEKERLRLKQQELLRQAMRNINPSTANSPKCQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 98138 - protein, 470 aa, Homo sapiens
  Payload ID: 19590
  Gene Name: Yes-associated protein 1
  Uniprot ID: P46937
  ENSP ID: ENSP00000331023
MDPGQQPPPQPAPQGQGQPPSQPPQGQGPPSGPGQPAPAATQAAPQAPPAGHQIVHVRGDSETDLEALFNAVMNPKTANVPQTVPMRLRKLPDSFFKPPEPKSHSRQASTDAGTAGALTPQHVRAHSSPASLQLGAVSPGTLTPTGVVSGPAATPTAQHLRQSSFEIPDDVPLPAGWEMAKTSSGQRYFLNHIDQTTTWQDPRKAMLSQMNVTAPTSPPVQQNMMNSASAMNQRISQSAPVKQPPPLAPQSPQGGVMGGSNSNQQQQMRLQQLQMEKERLRLKQQELLRQVRPQAMRNINPSTANSPKCQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 98139 - protein, 488 aa, Homo sapiens
  Payload ID: 19590
  Gene Name: Yes-associated protein 1
  Uniprot ID: P46937
  ENSP ID: ENSP00000431574
MDPGQQPPPQPAPQGQGQPPSQPPQGQGPPSGPGQPAPAATQAAPQAPPAGHQIVHVRGDSETDLEALFNAVMNPKTANVPQTVPMRLRKLPDSFFKPPEPKSHSRQASTDAGTAGALTPQHVRAHSSPASLQLGAVSPGTLTPTGVVSGPAATPTAQHLRQSSFEIPDDVPLPAGWEMAKTSSGQRYFLNHIDQTTTWQDPRKAMLSQMNVTAPTSPPVQQNMMNSASGPLPDGWEQAMTQDGEIYYINHKNKTTSWLDPRLDPRFAMNQRISQSAPVKQPPPLAPQSPQGGVMGGSNSNQQQQMRLQQLQMEKERLRLKQQELLRQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 98140 - protein, 258 aa, Homo sapiens
  Payload ID: 19590
  Gene Name: Yes-associated protein 1
  ENSP ID: ENSP00000431626
  MOD_RES (1)..(1): Any amino acid
XKNKTTSWLDPRLDPRFAMNQRISQSAPVKQPPPLAPQSPQGGVMGGSNSNQQQQMRLQQLQMEKERLRLKQQELLRQVRPQAMRNINPSTANSPKCQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 98141 - protein, 450 aa, Homo sapiens
  Payload ID: 19590
  Gene Name: Yes-associated protein 1
  Uniprot ID: P46937
  ENSP ID: ENSP00000434134
MDPGQQPPPQPAPQGQGQPPSQPPQGQGPPSGPGQPAPAATQAAPQAPPAGHQIVHVRGDSETDLEALFNAVMNPKTANVPQTVPMRLRKLPDSFFKPPEPKSHSRQASTDAGTAGALTPQHVRAHSSPASLQLGAVSPGTLTPTGVVSGPAATPTAQHLRQSSFEIPDDVPLPAGWEMAKTSSGQRYFLNHIDQTTTWQDPRKAMLSQMNVTAPTSPPVQQNMMNSASAMNQRISQSAPVKQPPPLAPQSPQGGVMGGSNSNQQQQMRLQQLQMEKERLRLKQQELLRQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 98142 - protein, 326 aa, Homo sapiens
  Payload ID: 19590
  Gene Name: Yes-associated protein 1
  Uniprot ID: P46937
  ENSP ID: ENSP00000435602
MAKTSSGQRYFLNHIDQTTTWQDPRKAMLSQMNVTAPTSPPVQQNMMNSASGPLPDGWEQAMTQDGEIYYINHKNKTTSWLDPRLDPRFAMNQRISQSAPVKQPPPLAPQSPQGGVMGGSNSNQQQQMRLQQLQMEKERLRLKQQELLRQAMRNINPSTANSPKCQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 98143 - protein, 492 aa, Homo sapiens
  Payload ID: 19590
  Gene Name: Yes-associated protein 1
  Uniprot ID: P46937
  ENSP ID: ENSP00000445635
MDPGQQPPPQPAPQGQGQPPSQPPQGQGPPSGPGQPAPAATQAAPQAPPAGHQIVHVRGDSETDLEALFNAVMNPKTANVPQTVPMRLRKLPDSFFKPPEPKSHSRQASTDAGTAGALTPQHVRAHSSPASLQLGAVSPGTLTPTGVVSGPAATPTAQHLRQSSFEIPDDVPLPAGWEMAKTSSGQRYFLNHIDQTTTWQDPRKAMLSQMNVTAPTSPPVQQNMMNSASGPLPDGWEQAMTQDGEIYYINHKNKTTSWLDPRLDPRFAMNQRISQSAPVKQPPPLAPQSPQGGVMGGSNSNQQQQMRLQQLQMEKERLRLKQQELLRQVRPQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 98144 - protein, 508 aa, Homo sapiens
  Payload ID: 19590
  Gene Name: Yes-associated protein 1
  Uniprot ID: P46937
  ENSP ID: ENSP00000478927
MDPGQQPPPQPAPQGQGQPPSQPPQGQGPPSGPGQPAPAATQAAPQAPPAGHQIVHVRGDSETDLEALFNAVMNPKTANVPQTVPMRLRKLPDSFFKPPEPKSHSRQASTDAGTAGALTPQHVRAHSSPASLQLGAVSPGTLTPTGVVSGPAATPTAQHLRQSSFEIPDDVPLPAGWEMAKTSSGQRYFLNHIDQTTTWQDPRKAMLSQMNVTAPTSPPVQQNMMNSASGPLPDGWEQAMTQDGEIYYINHKNKTTSWLDPRLDPRFAMNQRISQSAPVKQPPPLAPQSPQGGVMGGSNSNQQQQMRLQQLQMEKERLRLKQQELLRQVRPQAMRNINPSTANSPKCQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 98145 - protein, 454 aa, Homo sapiens
  Payload ID: 19590
  Gene Name: Yes-associated protein 1
  Uniprot ID: P46937
  ENSP ID: ENSP00000487519
MDPGQQPPPQPAPQGQGQPPSQPPQGQGPPSGPGQPAPAATQAAPQAPPAGHQIVHVRGDSETDLEALFNAVMNPKTANVPQTVPMRLRKLPDSFFKPPEPKSHSRQASTDAGTAGALTPQHVRAHSSPASLQLGAVSPGTLTPTGVVSGPAATPTAQHLRQSSFEIPDDVPLPAGWEMAKTSSGQRYFLNHIDQTTTWQDPRKAMLSQMNVTAPTSPPVQQNMMNSASAMNQRISQSAPVKQPPPLAPQSPQGGVMGGSNSNQQQQMRLQQLQMEKERLRLKQQELLRQVRPQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 98146 - protein, 306 aa, Homo sapiens
  Payload ID: 19591
  Gene Name: Yip1 domain family, member 1
  Uniprot ID: Q9Y548
  ENSP ID: ENSP00000072644
MAAVDDLQFEEFGNAATSLTANPDATTVNIEDPGETPKHQPGSPRGSGREEDDELLGNDDSDKTELLAGQKKSSPFWTFEYYQTFFDVDTYQVFDRIKGSLLPIPGKNFVRLYIRSNPDLYGPFWICATLVFAIAISGNLSNFLIHLGEKTYHYVPEFRKVSIAATIIYAYAWLVPLALWGFLMWRNSKVMNIVSYSFLEIVCVYGYSLFIYIPTAILWIIPQKAVRWILVMIALGISGSLLAMTFWPAVREDNRRVALATIVTIVLLHMLLSVGCLAYFFDAPEMDHLPTTTATPNQTVAAAKSS

SEQ ID NO: 98147 - protein, 123 aa, Homo sapiens
  Payload ID: 19591
  Gene Name: Yip1 domain family, member 1
  Uniprot ID: Q9Y548
  ENSP ID: ENSP00000360452
MWRNSKVMNIVSYSFLEIVCVYGYSLFIYIPTAILWIIPQKAVRWILVMIALGISGSLLAMTFWPAVREDNRRVALATIVTIVLLHMLLSVGCLAYFFDAPEMDHLPTTTATPNQTVAAAKSS

SEQ ID NO: 98148 - protein, 217 aa, Homo sapiens
  Payload ID: 19591
  Gene Name: Yip1 domain family, member 1
  ENSP ID: ENSP00000416507
MAAVDDLQFEEFGNAATSLTANPDATTVNIEDPGETPKHQPGSPRGSGREEDDELLGNDDSDKTELLAGQKKSSPFWTFEYYQTFFDVDTYQVFDRIKGSLLPIPGKNFVRLYIRSNPDLYGPFWICATLVFAIAISGNLSNFLIHLGEKTYHYVPEFRKVSIAATIIYAYAWLVPLALWGFLMWRNSKVMNIVSYSFLEIVCVYGYSLFIYIPTAV

SEQ ID NO: 98149 - protein, 306 aa, Homo sapiens; identical to SEQ ID NO: 98146
  Payload ID: 19591
  Gene Name: Yip1 domain family, member 1
  Uniprot ID: Q9Y548
  ENSP ID: ENSP00000432266

SEQ ID NO: 98150 - protein, 316 aa, Homo sapiens
  Payload ID: 19592
  Gene Name: Yip1 domain family, member 2
  Uniprot ID: Q9BWQ6
  ENSP ID: ENSP00000253031
MASADELTFHEFEEATNLLADTPDAATTSRSDQLTPQGHVAVAVGSGGSYGAEDEVEEESDKAALLQEQQQQQQPGFWTFSYYQSFFDVDTSQVLDRIKGSLLPRPGHNFVRHHLRNRPDLYGPFWICATLAFVLAVTGNLTLVLAQRRDPSIHYSPQFHKVTVAGISIYCYAWLVPLALWGFLRWRKGVQERMGPYTFLETVCIYGYSLFVFIPMVVLWLIPVPWLQWLFGALALGLSAAGLVFTLWPVVREDTRLVATVLLSVVVLLHALLAMGCKLYFFQSLPPENVAPPPQITSLPSNIALSPTLPQSLAPS

SEQ ID NO: 98151 - protein, 186 aa, Homo sapiens
  Payload ID: 19592
  Gene Name: Yip1 domain family, member 2
  ENSP ID: ENSP00000464839
MASADELTFHEFEEATNLLADTPDAATTSRSDQLTPQGHVAVAVGSGGSYGAEDEVEEESDKAAVLDRIKGSLLPRPGHNFVRHHLRNRPDLYGPFWICATLAFVLAVTGNLTLVLAQRRDPSIHYSPQFHKVTVAGISIYCYAWLVPLALWGFLRWRKGVQERMGPYTFLETVCIYGYSLFVFIP

SEQ ID NO: 98152 - protein, 79 aa, Homo sapiens
  Payload ID: 19592
  Gene Name: Yip1 domain family, member 2
  ENSP ID: ENSP00000465257
LSAAGLVFTLWPVVREDTRLVATVLLSVVVLLHALLAMGCKLYFFQSLPPENVAPPPQITSLPSNIALSPTLPQSLAPS

SEQ ID NO: 98153 - protein, 84 aa, Homo sapiens
  Payload ID: 19592
  Gene Name: Yip1 domain family, member 2
  ENSP ID: ENSP00000465943
MGPYTFLETVCIYGYSLFVFIPMVVLWLIPVPWLQWLFGALALGLSAAGLVFTLWPVVREDTRLVATVLLSVVVLLHALLAMGC

SEQ ID NO: 98154 - protein, 316 aa, Homo sapiens; identical to SEQ ID NO: 98150
  Payload ID: 19592
  Gene Name: Yip1 domain family, member 2
  Uniprot ID: Q9BWQ6
  ENSP ID: ENSP00000466055

SEQ ID NO: 98155 - protein, 103 aa, Homo sapiens
  Payload ID: 19592
  Gene Name: Yip1 domain family, member 2
  ENSP ID: ENSP00000466408
MGPYTFLETVCIYGYSLFVFIPMVVLWLIPVPWLQWLFGALALGLSAAGLVFTLWPVVREDTRLVATVLLSVVVLLHALLAMGCKLYFFQSLPPENVAPPPQI

SEQ ID NO: 98156 - protein, 277 aa, Homo sapiens
  Payload ID: 19592
  Gene Name: Yip1 domain family, member 2
  ENSP ID: ENSP00000467019
MASADELTFHEFEEATNLLADTPDAATTSRSDQLTPQGHVAVAVGSGGSYGAEDEVEEESDKAALLQEQQQQQQPGFWTFSYYQSFFDVDTSQVLDRIKGSLLPRPGHNFVRHHLRNRPDLYVTVAGISIYCYAWLVPLALWGFLRWRKGVQERMGPYTFLETVCIYGYSLFVFIPMVVLWLIPVPWLQWLFGALALGLSAAGLVFTLWPVVREDTRLVATVLLSVVVLLHALLAMGCKLYFFQSLPPENVAPPPQITSLPSNIALSPTLPQSLAPS

SEQ ID NO: 98157 - protein, 206 aa, Homo sapiens
  Payload ID: 19592
  Gene Name: Yip1 domain family, member 2
  ENSP ID: ENSP00000467156
  MOD_RES (1)..(1): Any amino acid
XGNLTLVLAQRRDPSIHYSPQFHKASTAMRGWCPWPCGASCGGARVSRSAWGPTPSWRLCASTATPSLSSSPWWSCGSSLCLGCSGSLGRWPWACQPPGWYSPSGPWSVRTPGWWPQCCCPWSCCSTPSWPWAVSCTSSSRCLRRTWLLHPKSHLCPQTSRCPLPCRSPWPPPRKARVPQATPKWTNPSACPAPQTMTEGSFDTLR

SEQ ID NO: 98158 - protein, 169 aa, Homo sapiens
  Payload ID: 19592
  Gene Name: Yip1 domain family, member 2
  ENSP ID: ENSP00000467829
  MOD_RES (1)..(1): Any amino acid
XRDPSIHYSPQFHKVTVAGISIYCYAWLVPLALWGFLRWRKGVQERMGPYTFLETVCIYGYSLFVFIPMVVLWLIPVPWLQWLFGALALGLSAAGLVFTLWPVVREDTRLVATVLLSVVVLLHALLAMGCKLYFFQSLPPENVAPPPQITSLPSNIALSPTLPQSLAPS

SEQ ID NO: 98159 - protein, 217 aa, Homo sapiens
  Payload ID: 19592
  Gene Name: Yip1 domain family, member 2
  ENSP ID: ENSP00000468436
MASADELTFHEFEEATNLLADTPDAATTSRSDQLTPQGHVAVAVGSGGSYGAEDEVEEESDKAALLQEQQQQQQPGFWTFSYYQSFFDVDTSQVLDRIKGSLLPRPGHNFVRHHLRNRPDLYGPFWICATLAFVLAVTGNLTLVLAQRRDPSIHYSPQFHKVTVAGISIYCYAWLVPLALWGFLRWRKGVQERMGPYTFLETVCIYGYSLFVFIPMV

SEQ ID NO: 98160 - protein, 350 aa, Homo sapiens
  Payload ID: 19593
  Gene Name: Yip1 domain family, member 3
  Uniprot ID: Q9GZM5
  ENSP ID: ENSP00000361499
MATTAAPAGGARNGAGPEWGGFEENIQGGGSAVIDMENMDDTSGSSFEDMGELHQRLREEEVDADAADAAAAEEEDGEFLGMKGFKGQLSRQVADQMWQAGKRQASRAFSLYANIDILRPYFDVEPAQVRSRLLESMIPIKMVNFPQKIAGELYGPLMLVFTLVAILLHGMKTSDTIIREGTLMGTAIGTCFGYWLGVSSFIYFLAYLCNAQITMLQMLALLGYGLFGHCIVLFITYNIHLHALFYLFWLLVGGLSTLRMVAVLVSRTVGPTQRLLLCGTLAALHMLFLLYLHFAYHKVVEGILDTLEGPNIPPIQRVPRDIPAMLPAARLPTTVLNATAKAVAVTLQSH

SEQ ID NO: 98161 - protein, 63 aa, Homo sapiens
  Payload ID: 19593
  Gene Name: Yip1 domain family, member 3
  ENSP ID: ENSP00000390056
MATTAAPAGGARNGAGPEWGGFEENIQWKNKALNPGMSRGLNGWNRKVLHSRSHCLHRAEAQL

SEQ ID NO: 98162 - protein, 45 aa, Homo sapiens
  Payload ID: 19593
  Gene Name: Yip1 domain family, member 3
  ENSP ID: ENSP00000392699
MATTAAPAGGARNGAGPEWGGFEENIQALASRIWVSCISACARKK

SEQ ID NO: 98163 - protein, 63 aa, Homo sapiens; identical to SEQ ID NO: 98161
  Payload ID: 19593
  Gene Name: Yip1 domain family, member 3
  ENSP ID: ENSP00000421053

SEQ ID NO: 98164 - protein, 109 aa, Homo sapiens
  Payload ID: 19593
  Gene Name: Yip1 domain family, member 3
  ENSP ID: ENSP00000421094
MENMDDTSGSSFEDMGELHQRLREEEVDADAADAAAAEEEDGEFLGMKGFKGQLSRQVADQMWQAGKRQASRAFSLYANIDILRPYFDVEPAQVRSRLLESMIPIKMVN

SEQ ID NO: 98165 - protein, 262 aa, Homo sapiens
  Payload ID: 19593
  Gene Name: Yip1 domain family, member 3
  ENSP ID: ENSP00000421461
MATTAAPAGGARNGAGPEWGGFEENIQGGGSAVIDMENMDDTSGSSFEDMGELHQRLREEEVDADAADAAAAEEEDGEFLGMKGFKGQLSRQVADQMWQAGKRQASRAFSLYANIDILRPYFDVEPAQVRSRLLESMIPIKMVNFPQKIAGELYGPLMLVFTLVAILLHGMKTSDTIIITMLQMLALLGYGLFGHCIVLFITYNIHLHALFYLFWLLVGGLSTLRMVAVLVSRTVGPTQRLLLCGTLAALHMLFLLYLHFAY

SEQ ID NO: 98166 - protein, 135 aa, Homo sapiens
  Payload ID: 19593
  Gene Name: Yip1 domain family, member 3
  ENSP ID: ENSP00000423544
  MOD_RES (1)..(1): Any amino acid
XKRQASRAFSLYANIDILRPYFDVEPAQVRSRTLCLPAGHGGSRLESQHFGRPRRADHKVRRSRPSWLTRLLESMIPIKMVNFPQKIAGELYGPLMLVFTLVAILLHGMKTSDTIIREGTLMGTAIGTCFGYWLG

SEQ ID NO: 98167 - protein, 64 aa, Homo sapiens
  Payload ID: 19593
  Gene Name: Yip1 domain family, member 3
  ENSP ID: ENSP00000424629
MATTAAPAGGARNGAGPEWGGFEENIQQWKNKALNPGMSRGLNGWNRKVLHSRSHCLHRAEAQL

SEQ ID NO: 98168 - protein, 356 aa, Homo sapiens
  Payload ID: 19593
  Gene Name: Yip1 domain family, member 3
  ENSP ID: ENSP00000425494
MATTAAPAGGARNGAGPEWGGFEENIQEPLSSQGGGSAVIDMENMDDTSGSSFEDMGELHQRLREEEVDADAADAAAAEEEDGEFLGMKGFKGQLSRQVADQMWQAGKRQASRAFSLYANIDILRPYFDVEPAQVRSRLLESMIPIKMVNFPQKIAGELYGPLMLVFTLVAILLHGMKTSDTIIREGTLMGTAIGTCFGYWLGVSSFIYFLAYLCNAQITMLQMLALLGYGLFGHCIVLFITYNIHLHALFYLFWLLVGGLSTLRMVAVLVSRTVGPTQRLLLCGTLAALHMLFLLYLHFAYHKVVEGILDTLEGPNIPPIQRVPRDIPAMLPAARLPTTVLNATAKAVAVTLQSH

SEQ ID NO: 98169 - protein, 63 aa, Homo sapiens; identical to SEQ ID NO: 98161
  Payload ID: 19593
  Gene Name: Yip1 domain family, member 3
  ENSP ID: ENSP00000427207

SEQ ID NO: 98170 - protein, 244 aa, Homo sapiens
  Payload ID: 19594
  Gene Name: Yip1 domain family, member 4
  Uniprot ID: Q9BSR8
  ENSP ID: ENSP00000238831
MQPPGPPPAYAPTNGDFTFVSSADAEDLSGSIASPDVKLNLGGDFIKESTATTFLRQRGYGWLLEVEDDDPEDNKPLLEELDIDLKDIYYKIRCVLMPMPSLGFNRQVVRDNPDFWGPLAVVLFFSMISLYGQFRVVSWIITIWIFGSLTIFLLARVLGGEVAYGQVLGVIGYSLLPLIVIAPVLLVVGSFEVVSTLIKLFGVFWAAYSAASLLVGEEFKTKKPLLIYPIFLLYIYFLSLYTGV

SEQ ID NO: 98171 - protein, 58 aa, Homo sapiens
  Payload ID: 19594
  Gene Name: Yip1 domain family, member 4
  ENSP ID: ENSP00000394339
EDLSGSIASPDVKLNLGGDFIKESTATTFLRQRGYGWLLEVEDDDPEDNKPLLWSHGL

SEQ ID NO: 98172 - protein, 33 aa, Homo sapiens
  Payload ID: 19594
  Gene Name: Yip1 domain family, member 4
  ENSP ID: ENSP00000414267
  MOD_RES (1)..(1): Any amino acid
XPVLLVVGSFEVVSTLIKVRSTRGTGLLEVRII

SEQ ID NO: 98173 - protein, 257 aa, Homo sapiens
  Payload ID: 19595
  Gene Name: Yip1 domain family, member 5
  Uniprot ID: Q969M3
  ENSP ID: ENSP00000274496
MSGFENLNTDFYQTSYSIDDQSQQSYDYGGSGGPYSKQYAGYDYSQQGRFVPPDMMQPQQPYTGQIYQPTQAYTPASPQPFYGNNFEDEPPLLEELGINFDHIWQKTLTVLHPLKVADGSIMNETDLAGPMVFCLAFGATLLLAGKIQFGYVYGISAIGCLGMFCLLNLMSMTGVSFGCVASVLGYCLLPMILLSSFAVIFSLQGMVGIILTAGIIGWCSFSASKIFISALAMEGQQLLVAYPCALLYGVFALISVF

SEQ ID NO: 98174 - protein, 257 aa, Homo sapiens; identical to SEQ ID NO: 98173
  Payload ID: 19595
  Gene Name: Yip1 domain family, member 5
  Uniprot ID: Q969M3
  ENSP ID: ENSP00000397704

SEQ ID NO: 98175 - protein, 203 aa, Homo sapiens
  Payload ID: 19595
  Gene Name: Yip1 domain family, member 5
  Uniprot ID: Q969M3
  ENSP ID: ENSP00000425422
MMQPQQPYTGQIYQPTQAYTPASPQPFYGNNFEDEPPLLEELGINFDHIWQKTLTVLHPLKVADGSIMNETDLAGPMVFCLAFGATLLLAGKIQFGYVYGISAIGCLGMFCLLNLMSMTGVSFGCVASVLGYCLLPMILLSSFAVIFSLQGMVGIILTAGIIGWCSFSASKIFISALAMEGQQLLVAYPCALLYGVFALISVF

SEQ ID NO: 98176 - protein, 101 aa, Homo sapiens
  Payload ID: 19595
  Gene Name: Yip1 domain family, member 5
  ENSP ID: ENSP00000428715
MMQPQQPYTGQIYQPTQAYTPASPQPFYGNNFEDEPPLLEELGINFDHIWQKTLTVLHPLKVADGSIMNETDLAGPMVFCLAFGATLLLAGKIQFGYVYGI

SEQ ID NO: 98177 - protein, 177 aa, Homo sapiens
  Payload ID: 19595
  Gene Name: Yip1 domain family, member 5
  ENSP ID: ENSP00000429777
MMQPQQPYTGQIYQPTQAYTPASPQPFYGNNFEDEPPLLEELGINFDHIWQKTLTVLHPLKVADGSIMNETDLAGPMVFCLAFGATLLLAGKIQFGYVYGISAIGCLGMFCLLNLMSMTGVSFGCVASVLGYCLLPMILLSSFAVIFSLQGMVGIILTAGIIGWCSFSASKIFISAL

SEQ ID NO: 98178 - protein, 193 aa, Homo sapiens
  Payload ID: 19596
  Gene Name: Yip1 domain family, member 6
  Uniprot ID: Q96EC8
  ENSP ID: ENSP00000363751
MAEAEESPGDPGTASPRPLMRDLKAVGKKFMHVLYPRKSNTLLRDWDLWGPLILCVTLALMLQRDSADSEKDGGPQFAEVFVIVWFGAVTITLNSKLLGGNISFFQSLCVLGYCILPLTVAMLICRLVLLADPGPVNFMVRLFVVIVMFAWSIVASTAFLADSQPPNRRALAVYPVFLFYFVISWMILTFTPQ

SEQ ID NO: 98179 - protein, 188 aa, Homo sapiens
  Payload ID: 19596
  Gene Name: Yip1 domain family, member 6
  ENSP ID: ENSP00000401799
MAEAEESPGDPGTASPRPLMRDLKAVGKKFMHVLYPRKSNTLLRDWDLWGPLILCVTLALMLQRDSADSEKDGGPQFAEVFVIVWFGAVTITLNSKLLGGNISFFQSLCVLGYCILPLTVAMLICRLVLLADPGPVNFMVRLFVVIVMFAWSIVASTAFLADSQPPNRRALAVYPVFLFYFVISWMIL

SEQ ID NO: 98180 - protein, 236 aa, Homo sapiens
  Payload ID: 19596
  Gene Name: Yip1 domain family, member 6
  Uniprot ID: Q96EC8
  ENSP ID: ENSP00000417573
MAEAEESPGDPGTASPRPLFAGLSDISISQDIPVEGEITIPMRSRIREFDSSTLNESVRNTIMRDLKAVGKKFMHVLYPRKSNTLLRDWDLWGPLILCVTLALMLQRDSADSEKDGGPQFAEVFVIVWFGAVTITLNSKLLGGNISFFQSLCVLGYCILPLTVAMLICRLVLLADPGPVNFMVRLFVVIVMFAWSIVASTAFLADSQPPNRRALAVYPVFLFYFVISWMILTFTPQ

SEQ ID NO: 98181 - protein, 280 aa, Homo sapiens
  Payload ID: 19597
  Gene Name: Yip1 domain family, member 7
  Uniprot ID: Q8N8F6
  ENSP ID: ENSP00000332772
MDLLKISHTKLHLLEDLSIKNKQRMSNLAQFDSDFYQSNFTIDNQEQSGNDSNAYGNLYGSRKQQAGEQPQPASFVPSEMLMSSGYAGQFFQPASNSDYYSQSPYIDSFDEEPPLLEELGIHFDHIWQKTLTVLNPMKPVDGSIMNETDLTGPILFCVALGATLLLAGKVQFGYVYGMSAIGCLVIHALLNLMSSSGVSYGCVASVLGYCLLPMVILSGCAMFFSLQGIFGIMSSLVIIGWCSLSASKIFIAALHMEGQQLLVAYPCAILYGLFALLTIF

SEQ ID NO: 98182 - protein, 256 aa, Homo sapiens
  Payload ID: 19597
  Gene Name: Yip1 domain family, member 7
  ENSP ID: ENSP00000412696
MSNLAQFDSDFYQSNFTIDNQEQSGNDSNAYGNLYGSRKQQAGEQPQPASFVPSEMLMSSGYAGQFFQPASNSDYYSQSPYIDSFDEEPPLLEELGIHFDHIWQKTLTVLNPMKPVDGSIMNETDLTGPILFCVALGATLLLAGKVQFGYVYGMSAIGCLVIHALLNLMSSSGVSYGCVASVLGYCLLPMVILSGCAMFFSLQGIFGIMSSLVIIGWCSLSASKIFIAALHMEGQQLLVAYPCAILYGLFALLTIF

SEQ ID NO: 98183 - protein, 39 aa, Homo sapiens
  Payload ID: 19597
  Gene Name: Yip1 domain family, member 7
  ENSP ID: ENSP00000477355
MSNLAQFDSDFYQSNFTIDNQEQSGNDSNAYGNLYGSRK

SEQ ID NO: 98184 - protein, 241 aa, Homo sapiens
  Payload ID: 19598
  Gene Name: Yip1 interacting factor homolog A (S. cerevisiae)
  ENSP ID: ENSP00000352437
MAYHSGYGAHGSKHRARAAPDPPPLFDDTSGGYSSQPGGYPATGADVAFSVNHLLGDPMANVAMAYGSSIASHGKDMVHKELHRFVSVSKLKYFFAVDTAYVAKKLGLLVFPYTHQNWEVQYSRDAPLPPRQDLNAPDLYIPTMAFITYVLLAGMALGIQKRMILSVLTGLLFGSDGYYVALAWTSSALMYFIVRSLRTAALGPDSMGGPVPRQRLQLYLTLGAAAFQPLIIYWLTFHLVR

SEQ ID NO: 98185 - protein, 293 aa, Homo sapiens
  Payload ID: 19598
  Gene Name: Yip1 interacting factor homolog A (S. cerevisiae)
  Uniprot ID: O95070
  ENSP ID: ENSP00000366098
MAYHSGYGAHGSKHRARAAPDPPPLFDDTSGGYSSQPGGYPATGADVAFSVNHLLGDPMANVAMAYGSSIASHGKDMVHKELHRFVSVSKLKYFFAVDTAYVAKKLGLLVFPYTHQNWEVQYSRDAPLPPRQDLNAPDLYIPTMAFITYVLLAGMALGIQKRFSPEVLGLCASTALVWVVMEVLALLLGLYLATVRSDLSTFHLLAYSGYKYVGMILSVLTGLLFGSDGYYVALAWTSSALMYFIVRSLRTAALGPDSMGGPVPRQRLQLYLTLGAAAFQPLIIYWLTFHLVR

SEQ ID NO: 98186 - protein, 199 aa, Homo sapiens
  Payload ID: 19598
  Gene Name: Yip1 interacting factor homolog A (S. cerevisiae)
  ENSP ID: ENSP00000401953
MAYHSGYGAHGSKHRARAAPDPPPLFDDTSGGYSSQPGGYPATGADVAFSVNHLLGDPMANVAMAYGSSIASHGKDMVHKELHRFVSVSKLKYFFAVDTAYVAKKLGLLVFPYTHQNWEVQYSRDAPLPPRQDLNAPDLYIPTMAFITYVLLAGMALGIQKRMPGSEPPLLWRRFSPEVLGLCASTALVWVVMEVLALL

SEQ ID NO: 98187 - protein, 53 aa, Homo sapiens
  Payload ID: 19598
  Gene Name: Yip1 interacting factor homolog A (S. cerevisiae)
  ENSP ID: ENSP00000431665
MAYHSGYGAHAAPFCVCEQTQVFFCCGHSLRGQEARAAGLPLHTPELGSAVQS

SEQ ID NO: 98188 - protein, 160 aa, Homo sapiens
  Payload ID: 19598
  Gene Name: Yip1 interacting factor homolog A (S. cerevisiae)
  ENSP ID: ENSP00000431935
MAYHSGYGAHGSKHRARAAPDPPPLFDDTSGGYSSQPGGYPATGADVAFSVNHLLGDPMANVAMAYGSSIASHGKDMVHKELHRFVSVSKLKYFFAVDTAYVAKKLGLLVFPYTHQNWEVQYSRDAPLPPRQDLNAPDLYIPSSPRRCWACVQAQRWCGW

SEQ ID NO: 98189 - protein, 79 aa, Homo sapiens
  Payload ID: 19598
  Gene Name: Yip1 interacting factor homolog A (S. cerevisiae)
  ENSP ID: ENSP00000432185
MILSVLTGLLFGSDGYYVALAWTSSALMYFIVRSLRTAALGPDSMGGPVPRQRLQLYLTLGAAAFQPLIIYWLTFHLVR

SEQ ID NO: 98190 - protein, 158 aa, Homo sapiens
  Payload ID: 19598
  Gene Name: Yip1 interacting factor homolog A (S. cerevisiae)
  ENSP ID: ENSP00000437042
MAFITYVLLAGMALGIQKRFSPEVLGLCASTALVWVVMEVLALLLGLYLATVRSDLSTFHLLAYSGYKYVGMILSVLTGLLFGSDGYYVALAWTSSALMYFIVSLVHPPIPLPSLEGKPPPPGQASVLLSSRCALCGQQPWAPTAWGAPSPGSVSSST

SEQ ID NO: 98191 - protein, 118 aa, Homo sapiens
  Payload ID: 19598
  Gene Name: Yip1 interacting factor homolog A (S. cerevisiae)
  ENSP ID: ENSP00000478815
GSKHRARAAPDPPPLFDDTSGGYSSQPGGYPATGADVAFSVNHLLGDPMANVAMAYGSSIASHGKDMVHKELHRFVSVSKLKYFFAVDTAYVAEARAAGLPYTHPELGSAVQSMLLCP

SEQ ID NO: 98192 - protein, 299 aa, Homo sapiens
  Payload ID: 19599
  Gene Name: Yip1 interacting factor homolog B (S. cerevisiae)
  Uniprot ID: Q5BJH7
  ENSP ID: ENSP00000329559
MPGSASKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVAIFVFMIRTLRLKILADAAAEGVPVRGARNQLRMYLTMAVAAAQPMLMYWLTFHLVR

SEQ ID NO: 98193 - protein, 291 aa, Homo sapiens
  Payload ID: 19599
  Gene Name: Yip1 interacting factor homolog B (S. cerevisiae)
  Uniprot ID: Q5BJH7
  ENSP ID: ENSP00000337411
MHPAGLAAAAAGTPRLPSKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVAIFVFMFPLLPGAVAHACNPSTLGGRGGRITRSGRCG

SEQ ID NO: 98194 - protein, 314 aa, Homo sapiens
  Payload ID: 19599
  Gene Name: Yip1 interacting factor homolog B (S. cerevisiae)
  Uniprot ID: Q5BJH7
  ENSP ID: ENSP00000343435
MHPAGLAAAAAGTPRLRKWPSKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVAIFVFMIRTLRLKILADAAAEGVPVRGARNQLRMYLTMAVAAAQPMLMYWLTFHLVR

SEQ ID NO: 98195 - protein, 283 aa, Homo sapiens
  Payload ID: 19599
  Gene Name: Yip1 interacting factor homolog B (S. cerevisiae)
  Uniprot ID: Q5BJH7
  ENSP ID: ENSP00000375971
MADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVAIFVFMIRTLRLKILADAAAEGVPVRGARNQLRMYLTMAVAAAQPMLMYWLTFHLVR

SEQ ID NO: 98196 - protein, 283 aa, Homo sapiens; identical to SEQ ID NO: 98195
  Payload ID: 19599
  Gene Name: Yip1 interacting factor homolog B (S. cerevisiae)
  Uniprot ID: Q5BJH7
  ENSP ID: ENSP00000465230

SEQ ID NO: 98197 - protein, 103 aa, Homo sapiens
  Payload ID: 19599
  Gene Name: Yip1 interacting factor homolog B (S. cerevisiae)
  ENSP ID: ENSP00000465277
MADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQ

SEQ ID NO: 98198 - protein, 294 aa, Homo sapiens
  Payload ID: 19599
  Gene Name: Yip1 interacting factor homolog B (S. cerevisiae)
  Uniprot ID: Q5BJH7
  ENSP ID: ENSP00000465446
MHPAGLAAAAAGTPRLPSKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVAIFVFMFPLLPGAVAHACNPSTLGGRGGRITRSGDQDHPG

SEQ ID NO: 98199 - protein, 283 aa, Homo sapiens; identical to SEQ ID NO: 98195
  Payload ID: 19599
  Gene Name: Yip1 interacting factor homolog B (S. cerevisiae)
  Uniprot ID: Q5BJH7
  ENSP ID: ENSP00000466428

SEQ ID NO: 98200 - protein, 248 aa, Homo sapiens
  Payload ID: 19599
  Gene Name: Yip1 interacting factor homolog B (S. cerevisiae)
  ENSP ID: ENSP00000467489
MADPHQLFDDTSSAQSRGYGAQRAPGGLSYPAASPTPHAAFLADPVSNMAMAYGSSLAAQGKELVDKNDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVAIFVFMIRTLRLKILADAAAEGVPVRGARNQLRMYLTMAVAAAQPMLMYWLTFHLVR

SEQ ID NO: 98201 - protein, 192 aa, Homo sapiens
  Payload ID: 19599
  Gene Name: Yip1 interacting factor homolog B (S. cerevisiae)
  ENSP ID: ENSP00000468358
  MOD_RES (1)..(1): Any amino acid
XSKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRMIGGVLMGLLFGKIGYYLVLGWCCVAIFVFM

SEQ ID NO: 98202 - protein, 231 aa, Homo sapiens
  Payload ID: 19599
  Gene Name: Yip1 interacting factor homolog B (S. cerevisiae)
  ENSP ID: ENSP00000468463
MPASKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGY

SEQ ID NO: 98203 - protein, 119 aa, Homo sapiens
  Payload ID: 19600
  Gene Name: yippee-like 1
  Uniprot ID: O60688
  ENSP ID: ENSP00000342832
MVKMTKSKTFQAYLPNCHRTYSCIHCRAHLANHDELISKSFQGSQGRAYLFNSVVNVGCGPAEERVLLTGLHAVADIYCENCKTTLGWKYEHAFESSQKYKEGKFIIELAHMIKDNGWE

SEQ ID NO: 98204 - protein, 44 aa, Homo sapiens
  Payload ID: 19600
  Gene Name: yippee-like 1
  ENSP ID: ENSP00000386014
MVKMTKSKTFQAYLPNCHRTYSCIHCRAHLANHDELISKSLAEC

SEQ ID NO: 98205 - protein, 119 aa, Homo sapiens
  Payload ID: 19601
  Gene Name: yippee-like 2
  Uniprot ID: Q96QA6
  ENSP ID: ENSP00000312272
MVKMTRSKTFQAYLPSCHRTYSCIHCRAHLANHDELISKSFQGSQGRAYLFNSVVNVGCGPAEERVLLTGLHAVADIYCENCKTTLGWKYEHAFESSQKYKEGKYIIELAHMIKDNGWD

SEQ ID NO: 98206 - protein, 119 aa, Homo sapiens; identical to SEQ ID NO: 98205
  Payload ID: 19601
  Gene Name: yippee-like 2
  Uniprot ID: Q96QA6
  ENSP ID: ENSP00000464285

SEQ ID NO: 98207 - protein, 119 aa, Homo sapiens
  Payload ID: 19602
  Gene Name: yippee-like 3
  Uniprot ID: P61236
  ENSP ID: ENSP00000381818
MVRISKPKTFQAYLDDCHRRYSCAHCRAHLANHDDLISKSFQGSQGRAYLFNSVVNVGCGPAEERVLLTGLHAVADIHCENCKTTLGWKYEQAFESSQKYKEGKYIIELNHMIKDNGWD

SEQ ID NO: 98208 - protein, 157 aa, Homo sapiens
  Payload ID: 19602
  Gene Name: yippee-like 3
  Uniprot ID: P61236
  ENSP ID: ENSP00000381821
MCVAQVLTAHLLPPRQALGSLCSPWAAPRVGPLPPAPAMVRISKPKTFQAYLDDCHRRYSCAHCRAHLANHDDLISKSFQGSQGRAYLFNSVVNVGCGPAEERVLLTGLHAVADIHCENCKTTLGWKYEQAFESSQKYKEGKYIIELNHMIKDNGWD

SEQ ID NO: 98209 - protein, 103 aa, Homo sapiens
  Payload ID: 19602
  Gene Name: yippee-like 3
  ENSP ID: ENSP00000454350
MVRISKPKTFQAYLDDCHRRYSCAHCRAHLANHDDLISKSFQGSQGRAYLFNSVVNVGCGPAEERVLLTGLHAVADIHCENCKTTLGWKYEQAFESSQKYKEG

SEQ ID NO: 98210 - protein, 31 aa, Homo sapiens
  Payload ID: 19602
  Gene Name: yippee-like 3
  ENSP ID: ENSP00000454949
  MOD_RES (1)..(1): Any amino acid
XPAEERVLLTGLHAVADIHCENCKTTLGWKY

SEQ ID NO: 98211 - protein, 54 aa, Homo sapiens
  Payload ID: 19602
  Gene Name: yippee-like 3
  ENSP ID: ENSP00000456212
MVRISKPKTFQAYLDDCHRRYSCAHCRAHLANHDDLISKSFQGSQGRAYLFNSV

SEQ ID NO: 98212 - protein, 119 aa, Homo sapiens; identical to SEQ ID NO: 98207
  Payload ID: 19602
  Gene Name: yippee-like 3
  Uniprot ID: P61236
  ENSP ID: ENSP00000456427

SEQ ID NO: 98213 - protein, 137 aa, Homo sapiens
  Payload ID: 19602
  Gene Name: yippee-like 3
  ENSP ID: ENSP00000456825
MCVAQVLTAHLLPPRQALGSLCSPWAAPRVGPLPPAPAMVRISKPKTFQAYLDDCHRRYSCAHCRAHLANHDDLISKSFQGSQGRAYLFNSVVNVGCGPAEERVLLTGLHAVADIHCENCKTTLGWKYVSHPPLTPG

SEQ ID NO: 98214 - protein, 75 aa, Homo sapiens
  Payload ID: 19602
  Gene Name: yippee-like 3
  ENSP ID: ENSP00000457598
MVRISKPKTFQAYLDDCHRRYSCAHCRAHLANHDDLISKSFQGSQGRAYLFNSVNRPLRAARSTKRGSTSLNSTT

SEQ ID NO: 98215 - protein, 119 aa, Homo sapiens; identical to SEQ ID NO: 98207
  Payload ID: 19602
  Gene Name: yippee-like 3
  Uniprot ID: P61236
  ENSP ID: ENSP00000457976

SEQ ID NO: 98216 - protein, 127 aa, Homo sapiens
  Payload ID: 19603
  Gene Name: yippee-like 4
  Uniprot ID: Q96NS1
  ENSP ID: ENSP00000300022
MPSCDPGPGPACLPTKTFRSYLPRCHRTYSCVHCRAHLAKHDELISKSFQGSHGRAYLFNSVVNVGCGPAEQRLLLTGLHSVADIFCESCKTTLGWKYEQAFETSQKYKEGKYIIEMSHMVKDNGWD

SEQ ID NO: 98217 - protein, 127 aa, Homo sapiens; identical to SEQ ID NO: 98216
  Payload ID: 19603
  Gene Name: yippee-like 4
  Uniprot ID: Q96NS1
  ENSP ID: ENSP00000432165

SEQ ID NO: 98218 - protein, 127 aa, Homo sapiens; identical to SEQ ID NO: 98216
  Payload ID: 19603
  Gene Name: yippee-like 4
  Uniprot ID: Q96NS1
  ENSP ID: ENSP00000432648

SEQ ID NO: 98219 - protein, 80 aa, Homo sapiens
  Payload ID: 19603
  Gene Name: yippee-like 4
  ENSP ID: ENSP00000432826
MPSCDPGPGPACLPTKTFRSYLPRCHRTYSCVHCRAHLAKHDELISKSFQGSHGRAYLFNSVVNVGCGPAEQRLLLTGLH

SEQ ID NO: 98220 - protein, 55 aa, Homo sapiens
  Payload ID: 19603
  Gene Name: yippee-like 4
  ENSP ID: ENSP00000434238
MPSCDPGPGPACLPTKTFRSYLPRCHRTYSCVHCRAHLAKHDELISKGQRGLRAS

SEQ ID NO: 98221 - protein, 121 aa, Homo sapiens
  Payload ID: 19604
  Gene Name: yippee-like 5
  Uniprot ID: P62699
  ENSP ID: ENSP00000261353
MGRIFLDHIGGTRLFSCANCDTILTNRSELISTRFTGATGRAFLFNKVVNLQYSEVQDRVMLTGRHMVRDVSCKNCNSKLGWIYEFATEDSQRYKEGRVILERALVRESEGFEEHVPSDNS

SEQ ID NO: 98222 - protein, 121 aa, Homo sapiens; identical to SEQ ID NO: 98221
  Payload ID: 19604
  Gene Name: yippee-like 5
  Uniprot ID: P62699
  ENSP ID: ENSP00000368834

SEQ ID NO: 98223 - protein, 121 aa, Homo sapiens; identical to SEQ ID NO: 98221
  Payload ID: 19604
  Gene Name: yippee-like 5
  Uniprot ID: P62699
  ENSP ID: ENSP00000368835

SEQ ID NO: 98224 - protein, 121 aa, Homo sapiens; identical to SEQ ID NO: 98221
  Payload ID: 19604
  Gene Name: yippee-like 5
  Uniprot ID: P62699
  ENSP ID: ENSP00000383974

SEQ ID NO: 98225 - protein, 121 aa, Homo sapiens; identical to SEQ ID NO: 98221
  Payload ID: 19604
  Gene Name: yippee-like 5
  Uniprot ID: P62699
  ENSP ID: ENSP00000385278

SEQ ID NO: 98226 - protein, 249 aa, Homo sapiens
  Payload ID: 19605
  Gene Name: YjeF N-terminal domain containing 3
  Uniprot ID: A6XGL0
  ENSP ID: ENSP00000398520
MSSAAGPDPSEAPEERHFLSTAEAAALERELLEDYRFGRQQLVELCGHASAVAVTKAFPLPALSRKQRTVLVVCGPEQNGAVGLVCARHLRVFEYEPTIFYPTRSLDLLHRDLTTQCEKMDIPFLSYLPTEVQLINEAYGLVVDAVLGPGVEPGEVGGPCTRALATLKLLSIPLVSLDIPSGWDAETGSDSEDGLRPDVLVSLAAPKRCAGRFSGRHHFVAGRFVPDDVRRKFALRLPGYTGTDCVAAL

SEQ ID NO: 98227 - protein, 299 aa, Homo sapiens
  Payload ID: 19605
  Gene Name: YjeF N-terminal domain containing 3
  Uniprot ID: A6XGL0
  ENSP ID: ENSP00000426964
MSSAAGPDPSEAPEERHFLRALELQPPLADMGRAELSSNATTSLVQRRKQAWGRQSWLEQIWNAGPVCQSTAEAAALERELLEDYRFGRQQLVELCGHASAVAVTKAFPLPALSRKQRTVLVVCGPEQNGAVGLVCARHLRVFEYEPTIFYPTRSLDLLHRDLTTQCEKMDIPFLSYLPTEVQLINEAYGLVVDAVLGPGVEPGEVGGPCTRALATLKLLSIPLVSLDIPSGWDAETGSDSEDGLRPDVLVSLAAPKRCAGRFSGRHHFVAGRFVPDDVRRKFALRLPGYTGTDCVAAL

SEQ ID NO: 98228 - protein, 98 aa, Homo sapiens
  Payload ID: 19605
  Gene Name: YjeF N-terminal domain containing 3
  ENSP ID: ENSP00000478505
MSSAAGPDPSEAPEERHFLSTAEAAALERELLEDYRFGRQQLVELCGHASAVAVTKVGKLKLRGGEGPALGQRGMEAELQPRCVWLWSKPPHLEGPGG

SEQ ID NO: 98229 - protein, 198 aa, Homo sapiens
  Payload ID: 19606
  Gene Name: YKT6 v-SNARE homolog (S. cerevisiae)
  Uniprot ID: O15498
  ENSP ID: ENSP00000223369
MKLYSLSVLYKGEAKVVLLKAAYDVSSFSFFQRSSVQEFMTFTSQLIVERSSKGTRASVKEQDYLCHVYVRNDSLAGVVIADNEYPSRVAFTLLEKVLDEFSKQVDRIDWPVGSPATIHYPALDGHLSRYQNPREADPMTKVQAELDETKIILHNTMESLLERGEKLDDLVSKSEVLGTQSKAFYKTARKQNSCCAIM

SEQ ID NO: 98230 - protein, 29 aa, Homo sapiens
  Payload ID: 19606
  Gene Name: YKT6 v-SNARE homolog (S. cerevisiae)
  ENSP ID: ENSP00000412414
PREADPMTKVQAELDETKIILVLFHPLGQ

SEQ ID NO: 98231 - protein, 164 aa, Homo sapiens
  Payload ID: 19606
  Gene Name: YKT6 v-SNARE homolog (S. cerevisiae)
  Uniprot ID: O15498
  ENSP ID: ENSP00000420805
MKLYSLSVLYKGEAKVVLLKAAYDVSSFSFFQRSSVQEFMTFTSQLIVERSSKGTRASVKEQDYLCHVYVRNDSLAGVVIADNEYPSRVAFTLLEKVLDEFSKQVDRIDWPVGSPATIHYPALDGHLSRYQNPREADPMTKVQAELDETKIILARKQNSCCAIM

SEQ ID NO: 98232 - protein, 2146 aa, Homo sapiens
  Payload ID: 19607
  Gene Name: YLP motif containing 1
  Uniprot ID: P49750
  ENSP ID: ENSP00000324463
MYPNWGRYGGSSHYPPPPVPPPPPVALPEASPGPGYSSSTTPAAPSSSGFMSFREQHLAQLQQLQQMHQKQMQCVLQPHHLPPPPLPPPPVMPGGGYGDWQPPPPPMPPPPGPALSYQKQQQYKHQMLHHQRDGPPGLVPMELESPPESPPVPPGSYMPPSQSYMPPPQPPPSYYPPTSSQPYLPPAQPSPSQSPPSQSYLAPTPSYSSSSSSSQSYLSHSQSYLPSSQASPSRPSQGHSKSQLLAPPPPSAPPGNKTTVQQEPLESGAKNKSTEQQQAAPEPDPSTMTPQEQQQYWYRQHLLSLQQRTKVHLPGHKKGPVVAKDTPEPVKEEVTVPATSQVPESPSSEEPPLPPPNEEVPPPLPPEEPQSEDPEEDARLKQLQAAAAHWQQHQQHRVGFQYQGIMQKHTQLQQILQQYQQIIQPPPHIQTMSVDMQLRHYEMQQQQFQHLYQEWEREFQLWEEQLHSYPHKDQLQEYEKQWKTWQGHMKATQSYLQEKVNSFQNMKNQYMGNMSMPPPFVPYSQMPPPLPTMPPPVLPPSLPPPVMPPALPATVPPPGMPPPVMPPSLPTSVPPPGMPPSLSSAGPPPVLPPPSLSSAGPPPVLPPPSLSSTAPPPVMPLPPLSSATPPPGIPPPGVPQGIPPQLTAAPVPPASSSQSSQVPEKPRPALLPTPVSFGSAPPTTYHPPLQSAGPSEQVNSKAPLSKSALPYSSFSSDQGLGESSAAPSQPITAVKDMPVRSGGLLPDPPRSSYLESPRGPRFDGPRRFEDLGSRCEGPRPKGPRFEGNRPDGPRPRYEGHPAEGTKSKWGMIPRGPASQFYITPSTSLSPRQSGPQWKGPKPAFGQQHQQQPKSQAEPLSGNKEPLADTSSNQQKNFKMQSAAFSIAADVKDVKAAQSNENLSDSQQEPPKSEVSEGPVEPSNWDQNVQSMETQIDKAQAVTQPVPLANKPVPAQSTFPSKTGGMEGGTAVATSSLTADNDFKPVGIGLPHSENNQDKGLPRPDNRDNRLEGNRGNSSSYRGPGQSRMEDTRDKGLVNRGRGQAISRGPGLVKQEDFRDKMMGRREDSREKMNRGEGSRDRGLVRPGSSREKVPGGLQGSQDRGAAGSRERGPPRRAGSQERGPLRRAGSRERIPPRRAGSRERGPPRGPGSRERGLGRSDFGRDRGPFRPEPGDGGEKMYPYHRDEPPRAPWNHGEERGHEEFPLDGRNAPMERERLDDWDRERYWRECERDYQDDTLELYNREDRFSAPPSRSHDGDRRGPWWDDWERDQDMDEDYNREMERDMDRDVDRISRPMDMYDRSLDNEWDRDYGRPLDEQESQFRERDIPSLPPLPPLPPLPPLDRYRDDRWREERNREHGYDRDFRDRGELRIREYPERGDTWREKRDYVPDRMDWERERLSDRWYPSDVDRHSPMAEHMPSSHHSSEMMGSDASLDSDQGLGGVMVLSQRQHEIILKAAQELKMLREQKEQLQKMKDFGSEPQMADHLPPQESRLQNTSSRPGMYPPPGSYRPPPPMGKPPGSIVRPSAPPARSSVPVTRPPVPIPPPPPPPPLPPPPPVIKPQTSAVEQERWDEDSFYGLWDTNDEQGLNSEFKSETAAIPSAPVLPPPPVHSSIPPPGPVPMGMPPMSKPPPVQQTVDYGHGRDISTNKVEQIPYGERITLRPDPLPERSTFETEHAGQRDRYDRERDREPYFDRQSNVIADHRDFKRDRETHRDRDRDRGVIDYDRDRFDRERRPRDDRAQSYRDKKDHSSSRRGGFDRPSYDRKSDRPVYEGPSMFGGERRTYPEERMPLPAPSLSHQPPPAPRVEKKPESKNVDDILKPPGRESRPERIVVIMRGLPGSGKTHVAKLIRDKEVEFGGPAPRVLSLDDYFITEVEKEEKDPDSGKKVKKKVMEYEYEAEMEETYRTSMFKTFKKTLDDGFFPFIILDAINDRVRHFDQFWSAAKTKGFEVYLAEMSADNQTCGKRNIHGRKLKEINKMADHWETAPRHMMRLDIRSLLQDAAIEEVEMEDFDANIEEQKEEKKDAEEEESELGYIPKSKWEMDTSEAKLDKLDGLRTGTKRKRDWEAIASRMEDYLQLPDDYDTRASEPGKKRVRWADLEEKKDADRKRAIGFVVGQTDWEKITDESGHLAEKALNRTKYI

SEQ ID NO: 98233 - protein, 1440 aa, Homo sapiens
  Payload ID: 19607
  Gene Name: YLP motif containing 1
  ENSP ID: ENSP00000447921
MYPNWGRYGGSSHYPPPPVPPPPPVALPEASPGPGYSSSTTPAAPSSSGFMSFREQHLAQLQQLQQMHQKQMQCVLQPHHLPPPPLPPPPVMPGGGYGDWQPPPPPMPPPPGPALSYQKQQQYKHQMLHHQRDGPPGLVPMELESPPESPPVPPGSYMPPSQSYMPPPQPPPSYYPPTSSQPYLPPAQPSPSQSPPSQSYLAPTPSYSSSSSSSQSYLSHSQSYLPSSQASPSRPSQGHSKSQLLAPPPPSAPPGNKTTVQQEPLESGAKNKSTEQQQAAPEPDPSTMTPQEQQQYWYRQHLLSLQQRTKVHLPGHKKGPVVAKDTPEPVKEEVTVPATSQVPESPSSEEPPLPPPNEEVPPPLPPEEPQSEDPEEDARLKQLQAAAAHWQQHQQHRVGFQYQGIMQKHTQLQQILQQYQQIIQPPPHIQTMSVDMQLRHYEMQQQQFQHLYQEWEREFQLWEEQLHSYPHKDQLQEYEKQWKTWQGHMKATQSYLQEKVNSFQNMKNQYMGNMSMPPPFVPYSQMPPPLPTMPPPVLPPSLPPPVMPPALPATVPPPGMPPPVMPPSLPTSVPPPGMPPSLSSAGPPPVLPPPSLSSAGPPPVLPPPSLSSTAPPPVMPLPPLSSATPPPGIPPPGVPQGIPPQLTAAPVPPASSSQSSQVPEKPRPALLPTPVSFGSAPPTTYHPPLQSAGPSEQVNSKAPLSKSALPYSSFSSDQGLGESSAAPSQPITAVKDMPVRSGGLLPDPPRSSYLESPRGPREQKEQLQKMKDFGSEPQMADHLPPQESRLQNTSSRPGMYPPPGSYRPPPPMGKPPGSIVRPSAPPARSSVPVTRPPVPIPPPPPPPPLPPPPPVIKPQTSAVEQERWDEDSFYGLWDTNDEQGLNSEFKSETAAIPSAPVLPPPPVHSSIPPPGPVPMGMPPMSKPPPVQQTVDYGHGRDISTNKVEQIPYGERITLRPDPLPERSTFETEHAGQRDRYDRERDREPYFDRQSNVIADHRDFKRDRETHRDRDRDRGVIDYDRDRFDRERRPRDDRAQSYRDKKDHSSSRRGGFDRPSYDRKSDRPVYEGPSMFGGERRTYPEERMPLPAPSLSHQPPPAPRVEKKPESKNVDDILKPPGRESRPERIVVIMRGLPGSGKTHVAKLIRDKEVEFGGPAPRVLSLDDYFITEVEKEEKDPDSGKKVKKKVMEYEYEAEMEETYRTSMFKTFKKTLDDGFFPFIILDAINDRVRHFDQFWSAAKTKGFEVYLAEMSADNQTCGKRNIHGRKLKEINKMADHWETAPRHMMRLDIRSLLQDAAIEEVEMEDFDANIEEQKEEKKDAEEEESELGYIPKSKWEMDTSEAKLDKLDGLRTGTKRKRDWEAIASRMEDYLQLPDDYDTRASEPGKKRVRWADLEEKKDADRKRAIGFVVGQTDWEKITDESGHLAEKALNRTKYI

SEQ ID NO: 98234 - protein, 466 aa, Homo sapiens
  Payload ID: 19607
  Gene Name: YLP motif containing 1
  ENSP ID: ENSP00000448367
NSEFKSETAAIPSAPVLPPPPVHSSIPPPGPVPMGMPPMSKPPPVQQTVDYGHGRDISTNKVEQIPYGERITLRPDPLPERSTFETEHAGQRDRYDRERDREPYFDRQSNVIADHRDFKRDRETHRDRDRDRGVIDYDRDRFDRERRPRDDRAQSYRDKKDHSSSRRGGFDRPSYDRKSDRPVYEGPSMFGGERRTYPEERMPLPAPSLSHQPPPAPRVEKKPESKNVDDILKPPGRESRPERIVVIMRGLPGSGKTHVAKLIRDKEVEFGGPAPRVLSLDDYFITEVEKEEKDPDSGKKVKKKVMEYEYEAEMEETYRTSMFKTFKKTLDDGFFPFIILDAINDRVRHFDQFWSAAKTKGFEVYLAEMSADNQTCGKRNIHGRKLKEINKMADHWETAPRHMMRLDIRSLLQDAAIEEVEMEDFDANIEEQKEEKKDAEEEESELVGDRPTTLNSVSLLKFLKKV

SEQ ID NO: 98235 - protein, 1595 aa, Homo sapiens
  Payload ID: 19607
  Gene Name: YLP motif containing 1
  ENSP ID: ENSP00000449860
FQHLYQEWEREFQLWEEQLHSYPHKDQLQEYEKQWKTWQGHMKATQSYLQEKVNSFQNMKNQYMGNMSMPPPFVPYSQMPPPLPTMPPPVLPPSLPPPVMPPALPATVPPPGMPPPVMPPSLPTSVPPPGMPPSLSSAGPPPVLPPPSLSSAGPPPVLPPPSLSSTAPPPVMPLPPLSSATPPPGIPPPGVPQGIPPQLTAAPVPPASSSQSSQVPEKPRPALLPTPVSFGSAPPTTYHPPLQSAGPSEQVNSKAPLSKSALPYSSFSSDQGLGESSAAPSQPITAVKDMPVRSGGLLPDPPRSSYLESPRGPRFDGPRRFEDLGSRCEGPRPKGPRFEGNRPDGPRPRYEGHPAEGTKSKWGMIPRGPASQFYITPSTSLSPRQSGPQWKGPKPAFGQQHQQQPKSQAEPLSGNKEPLADTSSNQQKNFKMQSAAFSIAADVKDVKAAQSNENLSDSQQEPPKSEVSEGPVEPSNWDQNVQSMETQIDKAQAVTQPVPLANKPVPAQSTFPSKTGGMEGGTAVATSSLTADNDFKPVGIGLPHSENNQDKGLPRPDNRDNRLEGNRGNSSSYRGPGQSRMEDTRDKGLVNRGRGQAISRGPGLVKQEDFRDKMMGRREDSREKMNRGEGSRDRGLVRPGSSREKVPGGLQGSQDRGAAGSRERGPPRRAGSQERGPLRRAGSRERIPPRRAGSRERGPPRGPGSRERGLGRSDFGRDRGPFRPEPGDGGEKMYPYHRDEPPRAPWNHGEERGHEEFPLDGRNAPMERERLDDWDRERYWRECERDYQDDTLELYNREDRFSAPPSRSHDGDRRGPWWDDWERDQDMDEDYNREMERDMDRDVDRISRPMDMYDRSLDNEWDRDYGRPLDEQESQFRERDIPSLPPLPPLPPLPPLDRYRDDRWREERNREHGYDRDFRDRGELRIREYPERGDTWREKRDYVPDRMDWERERLSDRWYPSDVDRHSPMAEHMPSSHHSSEMMGSDASLDSDQGLGGVMVLSQRQHEIILKAAQELKMLREQKEQLQKMKDFGSEPQMADHLPPQESRLQNTSSRPGMYPPPGSYRPPPPMGKPPGSIVRPSAPPARSSVPVTRPPVPIPPPPPPPPLPPPPPVIKPQTSAVEQERWDEDSFYGLWDTNDEQGLNSEFKSETAAIPSAPVLPPPPVHSSIPPPGPVPMGMPPMSKPPPVQQTVDYGHGRDISTNKVEQIPYGERITLRPDPLPERSTFETEHAGQRDRYDRERDREPYFDRQSNVIADHRDFKRDRETHRDRDRDRGVIDYDRDRFDRERRPRDDRAQSYRDKKDHSSSRRGGFDRPSYDRKSDRPVYEGPSMFGGERRTYPEERMPLPAPSLSHQPPPAPRVEKKPESKNVDDILKPPGRESRPERIVVIMRGLPGSGKTHVAKLIRDKEVEFGGPAPRVLSLDDYFITEVEKEEKDPDSGKKVKKKVMEYEYEAEMEETYRTSMFKTFKKTLDDGFFPFIILDAINDRVRHFDQFWSAAKTKGFEVYLAEMSADNQTCGKRNIHGRKLKEINKMADHWETAPRHMMRLDIRSLLQDAAIEEVEMEDFDANIEEQKEEKKDAEEEESELTSWMA

SEQ ID NO: 98236 - protein, 110 aa, Homo sapiens
  Payload ID: 19607
  Gene Name: YLP motif containing 1
  ENSP ID: ENSP00000476212
  MOD_RES (1)..(1): Any amino acid
XRNIHGRKLKEINKMADHWETAPRHMMRLDIRSLLQDAAIEEVEMEDFDANIEEQKEEKKDAEEEESELEGSESLPAETALKNSCNVKLAISKKQSGTCISKETHKKEKT

SEQ ID NO: 98237 - protein, 773 aa, Homo sapiens
  Payload ID: 19608
  Gene Name: YME1-like 1 ATPase
  Uniprot ID: Q96TA2
  ENSP ID: ENSP00000318480
MFSLSSTVQPQVTVPLSHLINAFHTPKNTSVSLSGVSVSQNQHRDVVPEHEAPSSECMFSDFLTKLNIVSIGKGKIFEGYRSMFMEPAKRMKKSLDTTDNWHIRPEPFSLSIPPSLNLRDLGLSELKIGQIDQLVENLLPGFCKGKNISSHWHTSHVSAQSFFENKYGNLDIFSTLRSSCLYRHHSRALQSICSDLQYWPVFIQSRGFKTLKSRTRRLQSTSERLAETQNIAPSFVKGFLLRDRGSDVESLDKLMKTKNIPEAHQDAFKTGFAEGFLKAQALTQKTNDSLRRTRLILFVLLLFGIYGLLKNPFLSVRFRTTTGLDSAVDPVQMKNVTFEHVKGVEEAKQELQEVVEFLKNPQKFTILGGKLPKGILLVGPPGTGKTLLARAVAGEADVPFYYASGSEFDEMFVGVGASRIRNLFREAKANAPCVIFIDELDSVGGKRIESPMHPYSRQTINQLLAEMDGFKPNEGVIIIGATNFPEALDNALIRPGRFDMQVTVPRPDVKGRTEILKWYLNKIKFDQSVDPEIIARGTVGFSGAELENLVNQAALKAAVDGKEMVTMKELEFSKDKILMGPERRSVEIDNKNKTITAYHESGHAIIAYYTKDAMPINKATIMPRGPTLGHVSLLPENDRWNETRAQLLAQMDVSMGGRVAEELIFGTDHITTGASSDFDNATKIAKRMVTKFGMSEKLGVMTYSDTGKLSPETQSAIEQEIRILLRDSYERAKHILKTHAKEHKNLAEALLTYETLDAKEIQIVLEGKKLEVR

SEQ ID NO: 98238 - protein, 740 aa, Homo sapiens
  Payload ID: 19608
  Gene Name: YME1-like 1 ATPase
  ENSP ID: ENSP00000365139
MFSLSSTVQPQVTVPLSHLINAFHTPKNTSVSLSGVSVSQNQHRDVVPEHEAPSSECMFSDFLTKLNIVSIGKGKIFEGYRSMFMEPAKRMKKSLDTTDNWHIRPEPFSLSIPPSLNLRDLGLSELKIGQIDQLVENLLPGFCKGKNISSHWHTSHVSAQSFFENKYGNLDIFSTLRSSCLYRHHSRALQSICSDLQYWPVFIQSRGFKTLKSRTRRLQSTSERLAETQNIAPSFVKGFLLRDRGSDVESLDKLMKTKNIPEAHQDAFKTGFAEGFLKAQALTQKTNDSLRRTRLILFVLLLFGIYGLLKNPFLSVRFRTTTGLDSAVDPVQMKNVTFEHVKGVEEAKQELQEVVEFLKNPQKFTILGGKLPKGILLVGPPGTGKTLLARAVAGEADVPFYYASGSEFDEMFVGVGASRIRNLFREAKANAPCVIFIDELDSVGGKRIESPMHPYSRQTINQLLAEMDGFKPNEGVIIIGATNFPEALDNALIRPGRFDMQVTVPRPDVKGRTEILKWYLNKIKFDQSVDPEIIARGTVGFSGAELENLVNQAALKAAVDGKEMVTMKELEFSKDKILMGPERRSVEIDNKNKTITAYHESGHAIIAYYTKDAMPINKATIMPRGPTLGHVSLLPENDRWNETRAQLLAQMDVSMGGRVAEELIFGTDHITTGASSDFDNATKIAKRMVTKFGMSEKLGVMTYSDTGKLSPETQSAIEQEIRILLRDSYERAKHILKTHS

SEQ ID NO: 98239 - protein, 716 aa, Homo sapiens
  Payload ID: 19608
  Gene Name: YME1-like 1 ATPase
  Uniprot ID: Q96TA2
  ENSP ID: ENSP00000365184
MFSLSSTVQPQVTVPLSHLINAFHTPKNTSVSLSGVSVSQNQHRDVVPEHEAPSSEPSLNLRDLGLSELKIGQIDQLVENLLPGFCKGKNISSHWHTSHVSAQSFFENKYGNLDIFSTLRSSCLYRHHSRALQSICSDLQYWPVFIQSRGFKTLKSRTRRLQSTSERLAETQNIAPSFVKGFLLRDRGSDVESLDKLMKTKNIPEAHQDAFKTGFAEGFLKAQALTQKTNDSLRRTRLILFVLLLFGIYGLLKNPFLSVRFRTTTGLDSAVDPVQMKNVTFEHVKGVEEAKQELQEVVEFLKNPQKFTILGGKLPKGILLVGPPGTGKTLLARAVAGEADVPFYYASGSEFDEMFVGVGASRIRNLFREAKANAPCVIFIDELDSVGGKRIESPMHPYSRQTINQLLAEMDGFKPNEGVIIIGATNFPEALDNALIRPGRFDMQVTVPRPDVKGRTEILKWYLNKIKFDQSVDPEIIARGTVGFSGAELENLVNQAALKAAVDGKEMVTMKELEFSKDKILMGPERRSVEIDNKNKTITAYHESGHAIIAYYTKDAMPINKATIMPRGPTLGHVSLLPENDRWNETRAQLLAQMDVSMGGRVAEELIFGTDHITTGASSDFDNATKIAKRMVTKFGMSEKLGVMTYSDTGKLSPETQSAIEQEIRILLRDSYERAKHILKTHAKEHKNLAEALLTYETLDAKEIQIVLEGKKLEVR

SEQ ID NO: 98240 - protein, 248 aa, Homo sapiens
  Payload ID: 19608
  Gene Name: YME1-like 1 ATPase
  ENSP ID: ENSP00000379590
MYQVTVPLSHLINAFHTPKNTSVSLSGVSVSQNQHRDVVPEHEAPSSEPSLNLRDLGLSELKIGQIDQLVENLLPGFCKGKNISSHWHTSHVSAQSFFENKYGNLDIFSTLRSSCLYRHHSRALQSICSDLQYWPVFIQSRGFKTLKSRTRRLQSTSERLAETQNIAPSFVKGFLLRDRGSDVESLDKLMKTKNIPEAHQDAFKTGFAEGFLKAQALTQKTNDSLRRTRLILFVLLLFGIYGLLKNPF

SEQ ID NO: 98241 - protein, 253 aa, Homo sapiens
  Payload ID: 19608
  Gene Name: YME1-like 1 ATPase
  ENSP ID: ENSP00000398713
MFSLSSTVQPQVTVPLSHLINAFHTPKNTSVSLSGVSVSQNQHRDVVPEHEAPSSEPSLNLRDLGLSELKIGQIDQLVENLLPGFCKGKNISSHWHTSHVSAQSFFENKYVFIQSRGFKTLKSRTRRLQSTSERLAETQNIAPSFVKGFLLRDRGSDVESLDKLMKTKNIPEAHQDAFKTGFAEGFLKAQALTQKTNDSLRRTRLILFVLLLFGIYGLLKNPFLSVRFRTTTGLDSAVDPVQMKNVTFEHVKG

SEQ ID NO: 98242 - protein, 136 aa, Homo sapiens
  Payload ID: 19608
  Gene Name: YME1-like 1 ATPase
  ENSP ID: ENSP00000473302
MFSLSSTVQPQVTVPLSHLINAFHTPKNTSVSLSGVSVSQNQHRDVVPEHEAPSSECMFSDFLTKLNIVSIGKGKIFEGYRSMFMEPAKRMKKSLDTTDNWHIRPEPFSLSIPVHCGFLQMPIVYDLFCPSFLVTA

SEQ ID NO: 98243 - protein, 243 aa, Homo sapiens
  Payload ID: 19608
  Gene Name: YME1-like 1 ATPase
  ENSP ID: ENSP00000473557
MFSLSSTVQPQVTVPLSHLINAFHTPKNTSVSLSGVSVSQNQHRDVVPEHEAPSSEGFLLRDRGSDVESLDKLMKTKNIPEAHQDAFKTGFAEGFLKAQALTQKTNDSLRRTRLILFVLLLFGIYGLLKNPFLSVRFRTTTGLDSAVDPVQMKNVTFEHVKGVEEAKQELQEVVEFLKNPQKFTILGGKLPKGILLVGPPGTGKTLLARAVAGEADVPFYYASGSEFDEMFVGVGASRIRNLF

SEQ ID NO: 98244 - protein, 683 aa, Homo sapiens
  Payload ID: 19608
  Gene Name: YME1-like 1 ATPase
  Uniprot ID: Q96TA2
  ENSP ID: ENSP00000481724
MFSLSSTVQPQVTVPLSHLINAFHTPKNTSVSLSGVSVSQNQHRDVVPEHEAPSSEPSLNLRDLGLSELKIGQIDQLVENLLPGFCKGKNISSHWHTSHVSAQSFFENKYVFIQSRGFKTLKSRTRRLQSTSERLAETQNIAPSFVKGFLLRDRGSDVESLDKLMKTKNIPEAHQDAFKTGFAEGFLKAQALTQKTNDSLRRTRLILFVLLLFGIYGLLKNPFLSVRFRTTTGLDSAVDPVQMKNVTFEHVKGVEEAKQELQEVVEFLKNPQKFTILGGKLPKGILLVGPPGTGKTLLARAVAGEADVPFYYASGSEFDEMFVGVGASRIRNLFREAKANAPCVIFIDELDSVGGKRIESPMHPYSRQTINQLLAEMDGFKPNEGVIIIGATNFPEALDNALIRPGRFDMQVTVPRPDVKGRTEILKWYLNKIKFDQSVDPEIIARGTVGFSGAELENLVNQAALKAAVDGKEMVTMKELEFSKDKILMGPERRSVEIDNKNKTITAYHESGHAIIAYYTKDAMPINKATIMPRGPTLGHVSLLPENDRWNETRAQLLAQMDVSMGGRVAEELIFGTDHITTGASSDFDNATKIAKRMVTKFGMSEKLGVMTYSDTGKLSPETQSAIEQEIRILLRDSYERAKHILKTHAKEHKNLAEALLTYETLDAKEIQIVLEGKKLEVR

SEQ ID NO: 98245 - protein, 348 aa, Homo sapiens
  Payload ID: 19609
  Gene Name: YOD1 deubiquitinase
  Uniprot ID: Q5VVQ6
  ENSP ID: ENSP00000326813
MFGPAKGRHFGVHPAPGFPGGVSQQAAGTKAGPAGAWPVGSRTDTMWRLRCKAKDGTHVLQGLSSRTRVRELQGQIAAITGIAPGGQRILVGYPPECLDLSNGDTILEDLPIQSGDMLIIEEDQTRPRSSPAFTKRGASSYVRETLPVLTRTVVPADNSCLFTSVYYVVEGGVLNPACAPEMRRLIAQIVASDPDFYSEAILGKTNQEYCDWIKRDDTWGGAIEISILSKFYQCEICVVDTQTVRIDRFGEDAGYTKRVLLIYDGIHYDPLQRNFPDPDTPPLTIFSSNDDIVLVQALELADEARRRRQFTDVNRFTLRCMVCQKGLTGQAEAREHAKETGHTNFGEV

SEQ ID NO: 98246 - protein, 304 aa, Homo sapiens
  Payload ID: 19609
  Gene Name: YOD1 deubiquitinase
  Uniprot ID: Q5VVQ6
  ENSP ID: ENSP00000356051
METLHIIYSEAKSFTVEGLSSRTRVRELQGQIAAITGIAPGGQRILVGYPPECLDLSNGDTILEDLPIQSGDMLIIEEDQTRPRSSPAFTKRGASSYVRETLPVLTRTVVPADNSCLFTSVYYVVEGGVLNPACAPEMRRLIAQIVASDPDFYSEAILGKTNQEYCDWIKRDDTWGGAIEISILSKFYQCEICVVDTQTVRIDRFGEDAGYTKRVLLIYDGIHYDPLQRNFPDPDTPPLTIFSSNDDIVLVQALELADEARRRRQFTDVNRFTLRCMVCQKGLTGQAEAREHAKETGHTNFGEV

SEQ ID NO: 98247 - protein, 279 aa, Homo sapiens
  Payload ID: 19610
  Gene Name: yrdC N(6)-threonylcarbamoyltransferase domain containing
  Uniprot ID: Q86U90
  ENSP ID: ENSP00000362135
MSPARRCRGMRAAVAASVGLSEGPAGSRSGRLFRPPSPAPAAPGARLLRLPGSGAVQAASPERAGWTEALRAAVAELRAGAVVAVPTDTLYGLACAASCSAALRAVYRLKGRSEAKPLAVCLGRVADVYRYCRVRVPEGLLKDLLPGPVTLVMERSEELNKDLNPFTPLVGIRIPDHAFMQDLAQMFEGPLALTSANLSSQASSLNVEEFQDLWPQLSLVIDGGQIGDGQSPECRLGSTVVDLSVPGKFGIIRPGCALESTTAILQQKYGLLPSHASYL

SEQ ID NO: 98248 - protein, 727 aa, Homo sapiens
  Payload ID: 19611
  Gene Name: YTH domain containing 1
  Uniprot ID: Q96MU7
  ENSP ID: ENSP00000339245
MAADSREEKDGELNVLDDILTEVPEQDDELYNPESEQDKNEKKGSKRKSDRMESTDTKRQKPSVHSRQLVSKPLSSSVSNNKRIVSTKGKSATEYKNEEYQRSERNKRLDADRKIRLSSSASREPYKNQPEKTCVRKRDPERRAKSPTPDGSERIGLEVDRRASRSSQSSKEEVNSEEYGSDHETGSSGSSDEQGNNTENEEEGVEEDVEEDEEVEEDAEEDEEVDEDGEEEEEEEEEEEEEEEEEEEEYEQDERDQKEEGNDYDTRSEASDSGSESVSFTDGSVRSGSGTDGSDEKKKERKRARGISPIVFDRSGSSASESYAGSEKKHEKLSSSVRAVRKDQTSKLKYVLQDARFFLIKSNNHENVSLAKAKGVWSTLPVNEKKLNLAFRSARSVILIFSVRESGKFQGFARLSSESHHGGSPIHWVLPAGMSAKMLGGVFKIDWICRRELPFTKSAHLTNPWNEHKPVKIGRDGQEIELECGTQLCLLFPPDESIDLYQVIHKMRHKRRMHSQPRSRGRPSRREPVRDVGRRRPEDYDIHNSRKKPRIDYPPEFHQRPGYLKDPRYQEVDRRFSGVRRDVFLNGSYNDYVREFHNMGPPPPWQGMPPYPGMEQPPHHPYYQHHAPPPQAHPPYSGHHPVPHEARYRDKRVHDYDMRVDDFLRRTQAVVSGRRSRPRERDRERERDRPRDNRRDRERDRGRDRERERERLCDRDRDRGERGRYRR

SEQ ID NO: 98249 - protein, 709 aa, Homo sapiens
  Payload ID: 19611
  Gene Name: YTH domain containing 1
  Uniprot ID: Q96MU7
  ENSP ID: ENSP00000347888
MAADSREEKDGELNVLDDILTEVPEQDDELYNPESEQDKNEKKGSKRKSDRMESTDTKRQKPSVHSRQLVSKPLSSSVSNNKRIVSTKGKSATEYKNEEYQRSERNKRLDADRKIRLSSSASREPYKNQPEKTCVRKRDPERRAKSPTPDGSERIGLEVDRRASRSSQSSKEEVNSEEYGSDHETGSSGSSDEQGNNTENEEEGVEEDVEEDEEVEEDAEEDEEVDEDGEEEEEEEEEEEEEEEEEEEEYEQDERDQKEEGNDYDTRSEASDSGSESVSFTDGSVRSGSGTDGSDEKKKERKRARGISPIVFDRSGSSASESYADQTSKLKYVLQDARFFLIKSNNHENVSLAKAKGVWSTLPVNEKKLNLAFRSARSVILIFSVRESGKFQGFARLSSESHHGGSPIHWVLPAGMSAKMLGGVFKIDWICRRELPFTKSAHLTNPWNEHKPVKIGRDGQEIELECGTQLCLLFPPDESIDLYQVIHKMRHKRRMHSQPRSRGRPSRREPVRDVGRRRPEDYDIHNSRKKPRIDYPPEFHQRPGYLKDPRYQEVDRRFSGVRRDVFLNGSYNDYVREFHNMGPPPPWQGMPPYPGMEQPPHHPYYQHHAPPPQAHPPYSGHHPVPHEARYRDKRVHDYDMRVDDFLRRTQAVVSGRRSRPRERDRERERDRPRDNRRDRERDRGRDRERERERLCDRDRDRGERGRYRR

SEQ ID NO: 98250 - protein, 93 aa, Homo sapiens
  Payload ID: 19611
  Gene Name: YTH domain containing 1
  ENSP ID: ENSP00000461990
  MOD_RES (1)..(1): Any amino acid
XGVRRDVFLNGSYNDYVREFHNMGPPPPWQGMPPYPGMEQPPHHPYYQHHAPPPQAHPPYSGHHPVPHEARYRDKRVVSAQGGKGVRELLRIL

SEQ ID NO: 98251 - protein, 12 aa, Homo sapiens
  Payload ID: 19611
  Gene Name: YTH domain containing 1
  ENSP ID: ENSP00000462186
MESTDTKRQKPS

SEQ ID NO: 98252 - protein, 37 aa, Homo sapiens
  Payload ID: 19611
  Gene Name: YTH domain containing 1
  ENSP ID: ENSP00000462238
MESTDTKRQKPSVHSRQLVSKPLSSSVSNNKRIVSTK

SEQ ID NO: 98253 - protein, 735 aa, Homo sapiens
  Payload ID: 19611
  Gene Name: YTH domain containing 1
  ENSP ID: ENSP00000463982
MAADSREEKDGELNVLDDILTEVPEQDDELYNPESEQDKNEKKGSKRKSDRMESTDTKRQKPSVHSRQLVSKPLSSSVSNNKRIVSTKGKSATEYKNEEYQRSERNKRLDADRKIRLSSSASREPYKNQPEKTCVRKRDPERRAKSPTPDGSERIGLEVDRRASRSSQSSKEEVNSEEYGSDHETGSSGSSDEQGNNTENEEEGVEEDVEEDEEVEEDAEEDEEVDEDGEEEEEEEEEEEEEEEEEEEEYEQDERDQKEEGNDYDTRSEASDSGSESVSFTDGSVRSGSGTDGSDEKKKERKRARGISPIVFDRSGSSASESYAGSEKKHEKLSSSVRAVRKDQTSKLKYVLQDARFFLIKSNNHENVSLAKAKGVWSTLPVNEKKLNLAFRSARSVILIFSVRESGKFQGFARLSSESHHGGSPIHWVLPAGMSAKMLGGVFKIDWICRRELPFTKSAHLTNPWNEHKPVKIGRDGQEIELECGTQLCLLFPPDESIDLYQVIHKMRHKRRMHSQPRSRGRPSRREPVRDVGRRRPEDYDIHNSRKKPRIDYPPEFHQRPGYLKDPRYQEVDSFTNLIPNRRFSGVRRDVFLNGSYNDYVREFHNMGPPPPWQGMPPYPGMEQPPHHPYYQHHAPPPQAHPPYSGHHPVPHEARYRDKRVHDYDMRVDDFLRRTQAVVSGRRSRPRERDRERERDRPRDNRRDRERDRGRDRERERERLCDRDRDRGERGRYRR

SEQ ID NO: 98254 - protein, 727 aa, Homo sapiens; identical to SEQ ID NO: 98248
  Payload ID: 19611
  Gene Name: YTH domain containing 1
  Uniprot ID: Q96MU7
  ENSP ID: ENSP00000479213

SEQ ID NO: 98255 - protein, 709 aa, Homo sapiens; identical to SEQ ID NO: 98249
  Payload ID: 19611
  Gene Name: YTH domain containing 1
  Uniprot ID: Q96MU7
  ENSP ID: ENSP00000484604

SEQ ID NO: 98256 - protein, 12 aa, Homo sapiens
  Payload ID: 19611
  Gene Name: YTH domain containing 1
  ENSP ID: ENSP00000486413
MESTDTKRQKPS

SEQ ID NO: 98257 - protein, 93 aa, Homo sapiens; identical to SEQ ID NO: 98250
  Payload ID: 19611
  Gene Name: YTH domain containing 1
  ENSP ID: ENSP00000486660
  MOD_RES (1)..(1): Any amino acid

SEQ ID NO: 98258 - protein, 735 aa, Homo sapiens; identical to SEQ ID NO: 98253
  Payload ID: 19611
  Gene Name: YTH domain containing 1
  ENSP ID: ENSP00000486746

SEQ ID NO: 98259 - protein, 37 aa, Homo sapiens; identical to SEQ ID NO: 98252
  Payload ID: 19611
  Gene Name: YTH domain containing 1
  ENSP ID: ENSP00000486929

SEQ ID NO: 98260 - protein, 1430 aa, Homo sapiens
  Payload ID: 19612
  Gene Name: YTH domain containing 2
  Uniprot ID: Q9H6S0
  ENSP ID: ENSP00000161863
MSRPSSVSPRQPAPGGGGGGGPSPCGPGGGGRAKGLKDIRIDEEVKIAVNIALERFRYGDQREMEFPSSLTSTERAFIHRLSQSLGLVSKSKGKGANRYLTVKKKDGSETAHAMMTCNLTHNTKHAVRSLIQRFPVTNKERTELLPKTERGNVFAVEAENREMSKTSGRLNNGIPQIPVKRGESEFDSFRQSLPVFEKQEEIVKIIKENKVVLIVGETGSGKTTQIPQFLLDDCFKNGIPCRIFCTQPRRLAAIAVAERVAAERRERIGQTIGYQIRLESRVSPKTLLTFCTNGVLLRTLMAGDSTLSTVTHVIVDEVHERDRFSDFLLTKLRDLLQKHPTLKLILSSAALDVNLFIRYFGSCPVIYIQGRPFEVKEMFLEDILRTTGYTNKEMLKYKKEKQQEEKQQTTLTEWYSAQENSFKPESQRQRTVLNVTDEYDLLDDGGDAVFSQLTEKDVNCLEPWLIKEMDACLSDIWLHKDIDAFAQVFHLILTENVSVDYRHSETSATALMVAAGRGFASQVEQLISMGANVHSKASNGWMALDWAKHFGQTEIVDLLESYSATLEFGNLDESSLVQTNGSDLSAEDRELLKAYHHSFDDEKVDLDLIMHLLYNICHSCDAGAVLIFLPGYDEIVGLRDRILFDDKRFADSTHRYQVFMLHSNMQTSDQKKVLKNPPAGVRKIILSTNIAETSITVNDVVFVIDSGKVKEKSFDALNFVTMLKMVWISKASAIQRKGRAGRCRPGICFRLFSRLRFQNMLEFQTPELLRMPLQELCLHTKLLAPVNCPIADFLMKAPEPPPALIVRNAVQMLKTIDAMDTWEDLTELGYHLADLPVEPHLGKMVLCAVVLKCLDPILTIACTLAYRDPFVLPTQASQKRAAMLCRKRFTAGAFSDHMALLRAFQAWQKARSDGWERAFCEKNFLSQATMEIIIGMRTQLLGQLRASGFVRARGGGDIRDVNTNSENWAVVKAALVAGMYPNLVHVDRENLVLTGPKEKKVRFHPASVLSQPQYKKIPPANGQAAAIKALPTDWLIYDEMTRAHRIANIRCCSAVTPVTILVFCGPARLASNALQEPSSFRVDGIPNDSSDSEMEDKTTANLAALKLDEWLHFTLEPEAASLLLQLRQKWHSLFLRRMRAPSKPWSQVDEATIRAIIAVLSTEEQSAGLQQPSGIGQRPRPMSSEELPLASSWRSNNSRKSSADTEFSDECTTAERVLMKSPSPALHPPQKYKDRGILHPKRGTEDRSDQSSLKSTDSSSYPSPCASPSPPSSGKGSKSPSPRPNMPVRYFIMKSSNLRNLEISQQKGIWSTTPSNERKLNRAFWESSIVYLVFSVQGSGHFQGFSRMSSEIGREKSQDWGSAGLGGVFKVEWIRKESLPFQFAHHLLNPWNDNKKVQISRDGQELEPLVGEQLLQLWERLPLGEKNTTD

SEQ ID NO: 98261 - protein, 137 aa, Homo sapiens
  Payload ID: 19612
  Gene Name: YTH domain containing 2
  ENSP ID: ENSP00000422916
MREMEFPSSLTSTERAFIHRLSQSLGLVSKSKGKGANRYLTVKKKDGSETAHAMMTCNLTHNTKHAVRSLIQRFPVTNKERTELLPKTERGNVFAVEAENREMSKTSGRLNNGIPQIPVKRGESEFDSFRQSLPVFE

SEQ ID NO: 98262 - protein, 739 aa, Homo sapiens
  Payload ID: 19612
  Gene Name: YTH domain containing 2
  ENSP ID: ENSP00000423101
MSRPSSVSPRQPAPGGGGGGGPSPCGPGGGGRAKGLKDIRIDEEVKIAVNIALERFRYGDQREMEFPSSLTSTERAFIHRLSQSLGLVSKSKGKGANRYLTVKKKDGSETAHAMMTCNLTHNTKHAVRSLIQRFPVTNKERTELLPKTERGNVFAVEAENREMSKTSGRLNNGIPQIPVKRGESEFDSFRQSLPVFEKQEEIVKIIKENKVVLIVGETGSGKTTQIPQFLLDDCFKNGIPCRIFCTQPRRLAAIAVAERVAAERRERIGQTIGYQIRLESRVSPKTLLTFCTNGVLLRTLMAGDSTLSTVTHVIVDEVHERDRFSDFLLTKLRDLLQKHPTLKLILSSAALDVNLFIRYFGSCPVIYIQGRPFEVKEMFLEDILRTTGYTNKEMLKYKKEKQQEEKQQTTLTEWYSAQENSFKPESQRQRTVLNVTDEYDLLDDGGDAVFSQLTEKDVNCLEPWLIKEMDACLSDIWLHKDIDAFAQVFHLILTENVSVDYRHSETSATALMVAAGRGFASQVEQLISMGANVHSKASNGWMALDWAKHFGQTEIVDLLESYSATLEFGNLDESSLVQTNGSDLSAEDRELLKAYHHSFDDEKVDLDLIMHLLYNICHSCDAGAVLIFLPGYDEIVGLRDRILFDDKRFADSTHRYQVFMLHSNMQTSDQKKVLKNPPAGVRKIILSTNIAETSITVNDVVFVIDSGKVKEKSFDALNFVTMLKMVWISKASAIQRKGR

SEQ ID NO: 98263 - protein, 98 aa, Homo sapiens
  Payload ID: 19612
  Gene Name: YTH domain containing 2
  ENSP ID: ENSP00000426644
MSRPSSVSPRQPAPGGGGGGGPSPCGPGGGGRAKGLKDIRIDEEVKIAVNIALERFRYGDQREMEFPSSLTSTERAFIHRLSQSLGLVSKSKGFLSSF

SEQ ID NO: 98264 - protein, 52 aa, Homo sapiens
  Payload ID: 19613
  Gene Name: YTH N(6)-methyladenosine RNA binding protein 1
  ENSP ID: ENSP00000359359
MSATSVDTQRTKGQDNKVQNGSLHQKDTVHDNDFEPYLTGQSNQERQSRNKQ

SEQ ID NO: 98265 - protein, 559 aa, Homo sapiens
  Payload ID: 19613
  Gene Name: YTH N(6)-methyladenosine RNA binding protein 1
  Uniprot ID: Q9BYJ9
  ENSP ID: ENSP00000359364
MSATSVDTQRTKGQDNKVQNGSLHQKDTVHDNDFEPYLTGQSNQSNSYPSMSDPYLSSYYPPSIGFPYSLNEAPWSTAGDPPIPYLTTYGQLSNGDHHFMHDAVFGQPGGLGNNIYQHRFNFFPENPAFSAWGTSGSQGQQTQSSAYGSSYTYPPSSLGGTVVDGQPGFHSDTLSKAPGMNSLEQGMVGLKIGDVSSSAVKTVGSVVSSVALTGVLSGNGGTNVNMPVSKPTSWAAIASKPAKPQPKMKTKSGPVMGGGLPPPPIKHNMDIGTWDNKGPVPKAPVPQQAPSPQAAPQPQQVAQPLPAQPPALAQPQYQSPQQPPQTRWVAPRNRNAAFGQSGGAGSDSNSPGNVQPNSAPSVESHPVLEKLKAAHSYNPKEFEWNLKSGRVFIIKSYSEDDIHRSIKYSIWCSTEHGNKRLDSAFRCMSSKGPVYLLFSVNGSGHFCGVAEMKSPVDYGTSAGVWSQDKWKGKFDVQWIFVKDVPNNQLRHIRLENNDNKPVTNSRDTQEVPLEKAKQVLKIISSYKHTTSIFDDFAHYEKRQEEEEVVRKERQSRNKQ

SEQ ID NO: 98266 - protein, 579 aa, Homo sapiens
  Payload ID: 19614
  Gene Name: YTH N(6)-methyladenosine RNA binding protein 2
  Uniprot ID: Q9Y5A9
  ENSP ID: ENSP00000362918
MSASSLLEQRPKGQGNKVQNGSVHQKDGLNDDDFEPYLSPQARPNNAYTAMSDSYLPSYYSPSIGFSYSLGEAAWSTGGDTAMPYLTSYGQLSNGEPHFLPDAMFGQPGALGSTPFLGQHGFNFFPSGIDFSAWGNNSSQGQSTQSSGYSSNYAYAPSSLGGAMIDGQSAFANETLNKAPGMNTIDQGMAALKLGSTEVASNVPKVVGSAVGSGSITSNIVASNSLPPATIAPPKPASWADIASKPAKQQPKLKTKNGIAGSSLPPPPIKHNMDIGTWDNKGPVAKAPSQALVQNIGQPTQGSPQPVGQQANNSPPVAQASVGQQTQPLPPPPPQPAQLSVQQQAAQPTRWVAPRNRGSGFGHNGVDGNGVGQSQAGSGSTPSEPHPVLEKLRSINNYNPKDFDWNLKHGRVFIIKSYSEDDIHRSIKYNIWCSTEHGNKRLDAAYRSMNGKGPVYLLFSVNGSGHFCGVAEMKSAVDYNTCAGVWSQDKWKGRFDVRWIFVKDVPNSQLRHIRLENNENKPVTNSRDTQEVPLEKAKQVLKIIASYKHTTSIFDDFSHYEKRQEEEESVKKERQGRGK

SEQ ID NO: 98267 - protein, 529 aa, Homo sapiens
  Payload ID: 19614
  Gene Name: YTH N(6)-methyladenosine RNA binding protein 2
  Uniprot ID: Q9Y5A9
  ENSP ID: ENSP00000439394
MSDSYLPSYYSPSIGFSYSLGEAAWSTGGDTAMPYLTSYGQLSNGEPHFLPDAMFGQPGALGSTPFLGQHGFNFFPSGIDFSAWGNNSSQGQSTQSSGYSSNYAYAPSSLGGAMIDGQSAFANETLNKAPGMNTIDQGMAALKLGSTEVASNVPKVVGSAVGSGSITSNIVASNSLPPATIAPPKPASWADIASKPAKQQPKLKTKNGIAGSSLPPPPIKHNMDIGTWDNKGPVAKAPSQALVQNIGQPTQGSPQPVGQQANNSPPVAQASVGQQTQPLPPPPPQPAQLSVQQQAAQPTRWVAPRNRGSGFGHNGVDGNGVGQSQAGSGSTPSEPHPVLEKLRSINNYNPKDFDWNLKHGRVFIIKSYSEDDIHRSIKYNIWCSTEHGNKRLDAAYRSMNGKGPVYLLFSVNGSGHFCGVAEMKSAVDYNTCAGVWSQDKWKGRFDVRWIFVKDVPNSQLRHIRLENNENKPVTNSRDTQEVPLEKAKQVLKIIASYKHTTSIFDDFSHYEKRQEEEESVKKERQGRGK

SEQ ID NO: 98268 - protein, 579 aa, Homo sapiens; identical to SEQ ID NO: 98266
  Payload ID: 19614
  Gene Name: YTH N(6)-methyladenosine RNA binding protein 2
  Uniprot ID: Q9Y5A9
  ENSP ID: ENSP00000444660

SEQ ID NO: 98269 - protein, 200 aa, Homo sapiens
  Payload ID: 19614
  Gene Name: YTH N(6)-methyladenosine RNA binding protein 2
  ENSP ID: ENSP00000474446
MSASSLLEQRPKGQGNKVQNGSVHQKDGLNDDDFEPYLSPQARPNNAYTAMSDSYLPSYYSPSIGFSYSLGEAAWSTGGDTAMPYLTSYGQLSNGEPHFLPDAMFGQPGALGSTPFLGQHGFNFFPSGIDFSAWGNNSSQGQSTQSSGYSSNYAYAPSSLGGAMIDGQSAFANETLNKAPGMNTIDQGMAALKLGSTEVA

SEQ ID NO: 98270 - protein, 241 aa, Homo sapiens
  Payload ID: 19614
  Gene Name: YTH N(6)-methyladenosine RNA binding protein 2
  ENSP ID: ENSP00000474784
MSASSLLEQRPKGQGNKVQNGSVHQKDGLNDDDFEPYLSPQNNAYTAMSDSYLPSYYSPSIGFSYSLGEAAWSTGGDTAMPYLTSYGQLSNGEPHFLPDAMFGQPGALGSTPFLGQHGFNFFPSGIDFSAWGNNSSQGQSTQSSGYSSNYAYAPSSLGGAMIDGQSAFANETLNKAPGMNTIDQGMAALKLGSTEVASNVPKVVGSAVGSGSITSNIVASNSLPPATIAPPKPASWADIAS

SEQ ID NO: 98271 - protein, 569 aa, Homo sapiens
  Payload ID: 19614
  Gene Name: YTH N(6)-methyladenosine RNA binding protein 2
  ENSP ID: ENSP00000481408
MSASSLLEQRPKGQGNKVQNGSVHQKDGLNDDDFEPYLSPQARPNNAYTAMSDSYLPSYYSPSIGFSYSLGEAAWSTGGDTAMPYLTSYGQLSNGEPHFLPDAMFGQPGALGSTPFLGQHGFNFFPSGIDFSAWGNNSSQGQSTQSSGYSSNYAYAPSSLGGAMIDGQSAFANETLNKAPGMNTIDQGMAALKLGSTEVASNVPKVVGSAVGSGSITSNIVASNSLPPATIAPPKPASWADIASKPAKQQPKLKTKNGIAGSSLPPPPIKHNMDIGTWDNKGPVAKAPSQALVQNIGQPTQGSPQPVGQQANNSPPVAQASVGQQTQPLPPPPPQPAQLSVQQQAAQPTRWVAPRNRGSGFGHNGVDGNGVGQSQAGSGSTPSEPHPVLEKLRSINNYNPKDFDWNLKHGRVFIIKSYSEDDIHRSIKYNIWCSTEHGNKRLDAAYRSMNGKGPVYLLFSVNGSGHFCGVAEMKSAVDYNTCAGVWSQDKWKGRFDVRWIFVKDVPNSQLRHIRLENNENKPVTNSRDTQEVPLEKAKQVLKIIASYKHTTSIFDDFSHYEKRQGRRKC

SEQ ID NO: 98272 - protein, 585 aa, Homo sapiens
  Payload ID: 19615
  Gene Name: YTH N(6)-methyladenosine RNA binding protein 3
  Uniprot ID: Q7Z739
  ENSP ID: ENSP00000473496
MSATSVDQRPKGQGNKVSVQNGSIHQKDAVNDDDFEPYLSSQTNQSNSYPPMSDPYMPSYYAPSIGFPYSLGEAAWSTAGDQPMPYLTTYGQMSNGEHHYIPDGVFSQPGALGNTPPFLGQHGFNFFPGNADFSTWGTSGSQGQSTQSSAYSSSYGYPPSSLGRAITDGQAGFGNDTLSKVPGISSIEQGMTGLKIGGDLTAAVTKTVGTALSSSGMTSIATNSVPPVSSAAPKPTSWAAIARKPAKPQPKLKPKGNVGIGGSAVPPPPIKHNMNIGTWDEKGSVVKAPPTQPVLPPQTIIQQPQPLIQPPPLVQSQLPQQQPQPPQPQQQQGPQPQAQPHQVQPQQQQLQNRWVAPRNRGAGFNQNNGAGSENFGLGVVPVSASPSSVEVHPVLEKLKAINNYNPKDFDWNLKNGRVFIIKSYSEDDIHRSIKYSIWCSTEHGNKRLDAAYRSLNGKGPLYLLFSVNGSGHFCGVAEMKSVVDYNAYAGVWSQDKWKGKFEVKWIFVKDVPNNQLRHIRLENNDNKPVTNSRDTQEVPLEKAKQVLKIIATFKHTTSIFDDFAHYEKRQEEEEAMRRERNRNKQ

SEQ ID NO: 98273 - protein, 52 aa, Homo sapiens
  Payload ID: 19615
  Gene Name: YTH N(6)-methyladenosine RNA binding protein 3
  ENSP ID: ENSP00000473986
MSATSVDQRPKGQGNKVSVQNGSIHQKDAVNDDDFEPYLSSQTNQERNRNKQ

SEQ ID NO: 98274 - protein, 86 aa, Homo sapiens
  Payload ID: 19615
  Gene Name: YTH N(6)-methyladenosine RNA binding protein 3
  ENSP ID: ENSP00000478356
MFYLDLTLFHRAEETGEESFSVQNGSIHQKDAVNDDDFEPYLSSQTNQSNSYPPMSDPYMPSYYAPSIGFPYSLGEAAWSTAGDQP

SEQ ID NO: 98275 - protein, 102 aa, Homo sapiens
  Payload ID: 19615
  Gene Name: YTH N(6)-methyladenosine RNA binding protein 3
  ENSP ID: ENSP00000478398
MSDPYMPSYYAPSIGFPYSLGEAAWSTAGDQPMPYLTTYGQMSNGEHHYIPDGVFSQPGALGNTPPFLGQHGFNFFPGNADFSTWGTSGSQGQSTQSSAYSS

SEQ ID NO: 98276 - protein, 588 aa, Homo sapiens
  Payload ID: 19615
  Gene Name: YTH N(6)-methyladenosine RNA binding protein 3
  ENSP ID: ENSP00000478490
MFYLDLTLFHRAEETGEESFSVQNGSIHQKDAVNDDDFEPYLSSQTNQSNSYPPMSDPYMPSYYAPSIGFPYSLGEAAWSTAGDQPMPYLTTYGQMSNGEHHYIPDGVFSQPGALGNTPPFLGQHGFNFFPGNADFSTWGTSGSQGQSTQSSAYSSSYGYPPSSLGRAITDGQAGFGNDTLSKVPGISSIEQGMTGLKIGGDLTAAVTKTVGTALSSSGMTSIATNSVPPVSSAAPKPTSWAAIARKPAKPQPKLKPKGNVGIGGSAVPPPPIKHNMNIGTWDEKGSVVKAPPTQPVLPPQTIIQQPQPLIQPPPLVQSQLPQQQPQPPQPQQQQGPQPQAQPHQVQPQQQQLQNRWVAPRNRGAGFNQNNGAGSENFGLGVVPVSASPSSVEVHPVLEKLKAINNYNPKDFDWNLKNGRVFIIKSYSEDDIHRSIKYSIWCSTEHGNKRLDAAYRSLNGKGPLYLLFSVNGSGHFCGVAEMKSVVDYNAYAGVWSQDKWKGKFEVKWIFVKDVPNNQLRHIRLENNDNKPVTNSRDTQEVPLEKAKQVLKIIATFKHTTSIFDDFAHYEKRQEEEEAMRRERNRNKQ

SEQ ID NO: 98277 - protein, 534 aa, Homo sapiens
  Payload ID: 19615
  Gene Name: YTH N(6)-methyladenosine RNA binding protein 3
  ENSP ID: ENSP00000478825
MSDPYMPSYYAPSIGFPYSLGEAAWSTAGDQPMPYLTTYGQMSNGEHHYIPDGVFSQPGALGNTPPFLGQHGFNFFPGNADFSTWGTSGSQGQSTQSSAYSSSYGYPPSSLGRAITDGQAGFGNDTLSKVPGISSIEQGMTGLKIGGDLTAAVTKTVGTALSSSGMTSIATNSVPPVSSAAPKPTSWAAIARKPAKPQPKLKPKGNVGIGGSAVPPPPIKHNMNIGTWDEKGSVVKAPPTQPVLPPQTIIQQPQPLIQPPPLVQSQLPQQQPQPPQPQQQQGPQPQAQPHQVQPQQQQLQNRWVAPRNRGAGFNQNNGAGSENFGLGVVPVSASPSSVEVHPVLEKLKAINNYNPKDFDWNLKNGRVFIIKSYSEDDIHRSIKYSIWCSTEHGNKRLDAAYRSLNGKGPLYLLFSVNGSGHFCGVAEMKSVVDYNAYAGVWSQDKWKGKFEVKWIFVKDVPNNQLRHIRLENNDNKPVTNSRDTQEVPLEKAKQVLKIIATFKHTTSIFDDFAHYEKRQEEEEAMRRERNRNKQ

SEQ ID NO: 98278 - protein, 111 aa, Homo sapiens
  Payload ID: 19615
  Gene Name: YTH N(6)-methyladenosine RNA binding protein 3
  ENSP ID: ENSP00000480086
MSDPYMPSYYAPSIGFPYSLGEAAWSTAGDQPMPYLTTYGQMSNGEHHYIPDGVFSQPGALGNTPPFLGQHGFNFFPGNADFSTWGTSGSQGQSTQSSAYSSSYGYPPSSL

SEQ ID NO: 98279 - protein, 588 aa, Homo sapiens; identical to SEQ ID NO: 98276
  Payload ID: 19615
  Gene Name: YTH N(6)-methyladenosine RNA binding protein 3
  ENSP ID: ENSP00000481476

SEQ ID NO: 98280 - protein, 534 aa, Homo sapiens; identical to SEQ ID NO: 98277
  Payload ID: 19615
  Gene Name: YTH N(6)-methyladenosine RNA binding protein 3
  ENSP ID: ENSP00000481497

SEQ ID NO: 98281 - protein, 41 aa, Homo sapiens
  Payload ID: 19615
  Gene Name: YTH N(6)-methyladenosine RNA binding protein 3
  ENSP ID: ENSP00000483267
MSATSVDQRPKGQGNKGAVKPVSEENSFSTKRFDSSKRCCK

SEQ ID NO: 98282 - protein, 583 aa, Homo sapiens
  Payload ID: 19615
  Gene Name: YTH N(6)-methyladenosine RNA binding protein 3
  ENSP ID: ENSP00000483580
MSATSVDQRPKGQGNKVQNGSIHQKDAVNDDDFEPYLSSQTNQSNSYPPMSDPYMPSYYAPSIGFPYSLGEAAWSTAGDQPMPYLTTYGQMSNGEHHYIPDGVFSQPGALGNTPPFLGQHGFNFFPGNADFSTWGTSGSQGQSTQSSAYSSSYGYPPSSLGRAITDGQAGFGNDTLSKVPGISSIEQGMTGLKIGGDLTAAVTKTVGTALSSSGMTSIATNSVPPVSSAAPKPTSWAAIARKPAKPQPKLKPKGNVGIGGSAVPPPPIKHNMNIGTWDEKGSVVKAPPTQPVLPPQTIIQQPQPLIQPPPLVQSQLPQQQPQPPQPQQQQGPQPQAQPHQVQPQQQQLQNRWVAPRNRGAGFNQNNGAGSENFGLGVVPVSASPSSVEVHPVLEKLKAINNYNPKDFDWNLKNGRVFIIKSYSEDDIHRSIKYSIWCSTEHGNKRLDAAYRSLNGKGPLYLLFSVNGSGHFCGVAEMKSVVDYNAYAGVWSQDKWKGKFEVKWIFVKDVPNNQLRHIRLENNDNKPVTNSRDTQEVPLEKAKQVLKIIATFKHTTSIFDDFAHYEKRQEEEEAMRRERNRNKQ

SEQ ID NO: 98283 - protein, 119 aa, Homo sapiens
  Payload ID: 19615
  Gene Name: YTH N(6)-methyladenosine RNA binding protein 3
  ENSP ID: ENSP00000483659
MFYLDLTLFHRAEETGEESFSVQNGSIHQKDAVNDDDFEPYLSSQTNQSNSYPPMSDPYMPSYYAPSIGFPYSLGEAAWSTAGDQPMPYLTTYGQMSNGEHHYIPDGVFSQPGALGNTP

SEQ ID NO: 98284 - protein, 534 aa, Homo sapiens; identical to SEQ ID NO: 98277
  Payload ID: 19615
  Gene Name: YTH N(6)-methyladenosine RNA binding protein 3
  ENSP ID: ENSP00000485046

SEQ ID NO: 98285 - protein, 204 aa, Homo sapiens
  Payload ID: 19616
  Gene Name: YY1 associated factor 2
  Uniprot ID: Q8IY57
  ENSP ID: ENSP00000328004
MGDKKSPTRPKRQPKPSSDEGYWDCSVCTFRNSAEAFKCMMCDVRKGTSTRSTLFEVIVSASRTKEPLKFPISGRKPRPVSQLVAQQVTQQFVPPTQSKKEKKDKVEKEKSEKETTSKKNSHKKTRPRLKNVDRSSAQHLEVTVGDLTVIITDFKEKTKSPPASSAASADQHSQSGSSSDNTERGMSRSSSPRGEASSLNGESH

SEQ ID NO: 98286 - protein, 138 aa, Homo sapiens
  Payload ID: 19616
  Gene Name: YY1 associated factor 2
  Uniprot ID: Q8IY57
  ENSP ID: ENSP00000370167
MGDKKSPTRKPRPVSQLVAQQVTQQFVPPTQSKKEKKDKVEKEKSEKETTSKKNSHKKTRPRLKNVDRSSAQHLEVTVGDLTVIITDFKEKTKSPPASSAASADQHSQSGSSSDNTERGMSRSSSPRGEASSLNGESH

SEQ ID NO: 98287 - protein, 180 aa, Homo sapiens
  Payload ID: 19616
  Gene Name: YY1 associated factor 2
  Uniprot ID: Q8IY57
  ENSP ID: ENSP00000439256
MGDKKSPTRPKRQPKPSSDEGYWDCSVCTFRNSAEAFKCMMCDVRKGTSTRKPRPVSQLVAQQVTQQFVPPTQSKKEKKDKVEKEKSEKETTSKKNSHKKTRPRLKNVDRSSAQHLEVTVGDLTVIITDFKEKTKSPPASSAASADQHSQSGSSSDNTERGMSRSSSPRGEASSLNGESH

SEQ ID NO: 98288 - protein, 44 aa, Homo sapiens
  Payload ID: 19616
  Gene Name: YY1 associated factor 2
  ENSP ID: ENSP00000447217
MGDKKSPTRSTLFEVIVSASRTKEPLKFPISGSSSGCPSGRFSC

SEQ ID NO: 98289 - protein, 34 aa, Homo sapiens
  Payload ID: 19616
  Gene Name: YY1 associated factor 2
  ENSP ID: ENSP00000447686
MMCDVRKGTSTRKPRPVSQLVAQQVTQQFVPPTQ

SEQ ID NO: 98290 - protein, 67 aa, Homo sapiens
  Payload ID: 19616
  Gene Name: YY1 associated factor 2
  ENSP ID: ENSP00000447863
MGDKKSPTRPKRQPKPSSDEGYWDCSVCTFRNSAEAFKCMMCDVRKGTSTREEKAGSLTSNWSSPIG

SEQ ID NO: 98291 - protein, 56 aa, Homo sapiens
  Payload ID: 19616
  Gene Name: YY1 associated factor 2
  ENSP ID: ENSP00000448291
MGDKKSPTRPKRQPKPSSDEGYWDCSVCTFRNSAEAFKCMMCDVRKGTSTRTSKLL

SEQ ID NO: 98292 - protein, 67 aa, Homo sapiens; identical to SEQ ID NO: 98290
  Payload ID: 19616
  Gene Name: YY1 associated factor 2
  ENSP ID: ENSP00000448312

SEQ ID NO: 98293 - protein, 72 aa, Homo sapiens
  Payload ID: 19616
  Gene Name: YY1 associated factor 2
  ENSP ID: ENSP00000448533
MGDKKSPTRPKRQPKPSSDEGYWDCSVCTFRNSAEAFKCMMCDVRKGTSTRDNRKRAWLPFGGTILLAQASA

SEQ ID NO: 98294 - protein, 120 aa, Homo sapiens
  Payload ID: 19616
  Gene Name: YY1 associated factor 2
  ENSP ID: ENSP00000450097
MGDKKSPTRPKRQPKPSSDEGYWDCSVCTFRNSAEAFKCMMCDVRKGTSTRMKNHEIISFLKEGEKKKLDHLPVTGVLLLGNLHRSTLFEVIVSASRTKEPLKFPISGSSSGCPSGRFSC

SEQ ID NO: 98295 - protein, 96 aa, Homo sapiens
  Payload ID: 19616
  Gene Name: YY1 associated factor 2
  ENSP ID: ENSP00000450394
MGDKKSPTRPKRQPKPSSDEGYWDCSVCTFRNSAEAFKCMMCDVRKGTSTRSTLFEVIVSASRTKEPLKFPISGRDNRKRAWLPFGGTILLAQASA

SEQ ID NO: 98296 - protein, 117 aa, Homo sapiens
  Payload ID: 19616
  Gene Name: YY1 associated factor 2
  Uniprot ID: Q8IY57
  ENSP ID: ENSP00000451626
MGDKKSPTRPKRQPKPSSDEGYWDCSVCTFRNSAEAFKCMMCDVRKGTSTRDSKEGGKLVSYSTASLGVRGTLRNRVGGGSSEEKKQAEYLAPGRRRNIVHRGVGPGQRSGPSLKEA

SEQ ID NO: 98297 - protein, 796 aa, Homo sapiens
  Payload ID: 19617
  Gene Name: YY1 associated protein 1
  Uniprot ID: Q9H869
  ENSP ID: ENSP00000295566
MEEEASRSAAATNPGSRLTRWPPPDKREGSAVDPGKRRSLAATPSSSLPCTLIALGLRHEKEANELMEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPPVDKQCQEGLSENSAYRWTVVKTEEGRQALEPLPQGIQESLNNSSPGDLEEVVKMEPEDATEEISGFL

SEQ ID NO: 98298 - protein, 719 aa, Homo sapiens
  Payload ID: 19617
  Gene Name: YY1 associated protein 1
  Uniprot ID: Q9H869
  ENSP ID: ENSP00000311138
MGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPPVDKQCQEGLSENSAYRWTVVKTEEGRQALEPLPQGIQESLNNSSPGDLEEVVKMEPEDATEEISGFL

SEQ ID NO: 98299 - protein, 750 aa, Homo sapiens
  Payload ID: 19617
  Gene Name: YY1 associated protein 1
  Uniprot ID: Q9H869
  ENSP ID: ENSP00000316079
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPPVDKQCQEGLSENSAYRWTVVKTEEGRQALEPLPQGIQESLNNSSPGDLEEVVKMEPEDATEEISGFL

SEQ ID NO: 98300 - protein, 196 aa, Homo sapiens
  Payload ID: 19617
  Gene Name: YY1 associated protein 1
  ENSP ID: ENSP00000346722
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTVC

SEQ ID NO: 98301 - protein, 750 aa, Homo sapiens; identical to SEQ ID NO: 98299
  Payload ID: 19617
  Gene Name: YY1 associated protein 1
  Uniprot ID: Q9H869
  ENSP ID: ENSP00000347686

SEQ ID NO: 98302 - protein, 739 aa, Homo sapiens
  Payload ID: 19617
  Gene Name: YY1 associated protein 1
  Uniprot ID: Q9H869
  ENSP ID: ENSP00000352134
MGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPPVDKQCQEGLSENSAYRWTVVKTEEGRQALEPLPQGIQESLNNSSPGDLEEVVKMEPEDATEEISGFL

SEQ ID NO: 98303 - protein, 165 aa, Homo sapiens
  Payload ID: 19617
  Gene Name: YY1 associated protein 1
  ENSP ID: ENSP00000354716
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLSWEPLLKAPSPFTISTTPSFRPCSNPVT

SEQ ID NO: 98304 - protein, 739 aa, Homo sapiens; identical to SEQ ID NO: 98302
  Payload ID: 19617
  Gene Name: YY1 associated protein 1
  Uniprot ID: Q9H869
  ENSP ID: ENSP00000355298

SEQ ID NO: 98305 - protein, 750 aa, Homo sapiens; identical to SEQ ID NO: 98299
  Payload ID: 19617
  Gene Name: YY1 associated protein 1
  Uniprot ID: Q9H869
  ENSP ID: ENSP00000357314

SEQ ID NO: 98306 - protein, 888 aa, Homo sapiens
  Payload ID: 19617
  Gene Name: YY1 associated protein 1
  Uniprot ID: Q9H869
  ENSP ID: ENSP00000357323
MAGVGRSGGPWGRTRGGRSGRLGVSLGALSSLPLEELPRPLCCRRCRRHFGFALRGETIPVSVAGSASSQFAPLALHLSLLLSRISASRLTRWPPPDKREGSAVDPGKRRSLAATPSSSLPCTLIALGLRHEKEANELMEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPPVDKQCQEGLSENSAYRWTVVKTEEGRQALEPLPQGIQESLNNSSPGDLEEVVKMEPEDATEEISGFL

SEQ ID NO: 98307 - protein, 868 aa, Homo sapiens
  Payload ID: 19617
  Gene Name: YY1 associated protein 1
  Uniprot ID: Q9H869
  ENSP ID: ENSP00000357324
MAGVGRSGGPWGRTRGGRSGRLGVSLGALSSLPLEELPRPLCCRRCRRHFGFALRGETIPVSVAGSASSQFAPLALHLSLLLSRISASRLTRWPPPDKREGSAVDPGKRRSLAATPSSSLPCTLIALGLRHEKEANELMEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPPVDKQCQEGLSENSAYRWTVVKTEEGRQALEPLPQGIQESLNNSSPGDLEEVVKMEPEDATEEISGFL

SEQ ID NO: 98308 - protein, 495 aa, Homo sapiens
  Payload ID: 19617
  Gene Name: YY1 associated protein 1
  ENSP ID: ENSP00000384583
MAGVGRSGGPWGRTRGGRSGRLGVSLGALSSLPLEELPRPLCCRRCRRHFGFALRGETIPVSVAGSASSQFAPLALHLSLLLSRISASRLTRWPPPDKREGSAVDPGKRRSLAATPSSSLPCTLIALGLRHEKEANELMEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKVQPSSSKSVGGRRSLKVLREYQGLP

SEQ ID NO: 98309 - protein, 730 aa, Homo sapiens
  Payload ID: 19617
  Gene Name: YY1 associated protein 1
  Uniprot ID: Q9H869
  ENSP ID: ENSP00000385390
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPPVDKQCQEGLSENSAYRWTVVKTEEGRQALEPLPQGIQESLNNSSPGDLEEVVKMEPEDATEEISGFL

SEQ ID NO: 98310 - protein, 719 aa, Homo sapiens; identical to SEQ ID NO: 98298
  Payload ID: 19617
  Gene Name: YY1 associated protein 1
  Uniprot ID: Q9H869
  ENSP ID: ENSP00000385791

SEQ ID NO: 98311 - protein, 48 aa, Homo sapiens
  Payload ID: 19617
  Gene Name: YY1 associated protein 1
  ENSP ID: ENSP00000390116
MEDLFETFQDEMGFSNMEDDGPEEEERVAEPQANFNTPQALRQLLLLM

SEQ ID NO: 98312 - protein, 206 aa, Homo sapiens
  Payload ID: 19617
  Gene Name: YY1 associated protein 1
  ENSP ID: ENSP00000409203
MGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMY

SEQ ID NO: 98313 - protein, 194 aa, Homo sapiens
  Payload ID: 19617
  Gene Name: YY1 associated protein 1
  ENSP ID: ENSP00000413240
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKT

SEQ ID NO: 98314 - protein, 414 aa, Homo sapiens
  Payload ID: 19618
  Gene Name: YY1 transcription factor
  Uniprot ID: P25490
  ENSP ID: ENSP00000262238
MASGDTLYIATDGSEMPAEIVELHEIEVETIPVETIETTVVGEEEEEDDDDEDGGGGDHGGGGGHGHAGHHHHHHHHHHHPPMIALQPLVTDDPTQVHHHQEVILVQTREEVVGGDDSDGLRAEDGFEDQILIPVPAPAGGDDDYIEQTLVTVAAAGKSGGGGSSSSGGGRVKKGGGKKSGKKSYLSGGAGAAGGGGADPGNKKWEQKQVQIKTLEGEFSVTMWSSDEKKDIDHETVVEEQIIGENSPPDYSEYMTGKKLPPGGIPGIDLSDPKQLAEFARMKPRKIKEDDAPRTIACPHKGCTKMFRDNSAMRKHLHTHGPRVHVCAECGKAFVESSKLKRHQLVHTGEKPFQCTFEGCGKRFSLDFNLRTHVRIHTGDRPYVCPFDGCNKKFAQSTNLKSHILTHAKAKNNQ

SEQ ID NO: 98315 - protein, 34 aa, Homo sapiens
  Payload ID: 19618
  Gene Name: YY1 transcription factor
  ENSP ID: ENSP00000451329
MASGDTLYIATDGSEMPAEIVELHEIEVETIPVE

SEQ ID NO: 98316 - protein, 123 aa, Homo sapiens
  Payload ID: 19618
  Gene Name: YY1 transcription factor
  ENSP ID: ENSP00000452140
  MOD_RES (1)..(1): Any amino acid
XRVKKGGGKKSGKKSYLSGGAGAAGGGGADPGNKKWEQKQVQIKTLEGEFSVTMWSSDEKKDIDHETVVEEQIIGENSPPDYSEYMTGKKLPPGGIPGIDLSDPKQLAEFARAAQRCSGITRP

SEQ ID NO: 98317 - protein, 190 aa, Homo sapiens
  Payload ID: 19618
  Gene Name: YY1 transcription factor
  ENSP ID: ENSP00000452225
  MOD_RES (1)..(1): Any amino acid
XKKGGGKKSGKKSYLSGGAGAAGGGGADPGNKKWEQKQVQIKTLEGEFSVTMWSSDEKKDIDHETVVEEQIIGENSPPDYSEYMTGKKLPPGGIPGIDLSDPKQLAEFARMKPRKIKEDDAPRTIACPHKCTFEGCGKRFSLDFNLRTHVRIHTGDRPYVCPFDGCNKKFAQSTNLKSHILTHAKAKNNQ

SEQ ID NO: 98318 - protein, 372 aa, Homo sapiens
  Payload ID: 19619
  Gene Name: YY2 transcription factor
  Uniprot ID: O15391
  ENSP ID: ENSP00000389381
MASNEDFSITQDLEIPADIVELHDINVEPLPMEDIPTESVQYEDVDGNWIYGGHNHPPLMVLQPLFTNTGYGDHDQEMLMLQTQEEVVGYCDSDNQLGNDLEDQLALPDSIEDEHFQMTLASLSASAASTSTSTQSRSKKPSKKPSGKSATSTEANPAGSSSSLGTRKWEQKQMQVKTLEGEFSVTMWSPNDNNDQGAVGEGQAENPPDYSEYLKGKKLPPGGLPGIDLSDPKQLAEFTKVKPKRSKGEPPKTVPCSYSGCEKMFRDYAAMRKHLHIHGPRVHVCAECGKAFLESSKLRRHQLVHTGEKPFQCTFEGCGKRFSLDFNLRTHLRIHTGDKPFVCPFDVCNRKFAQSTNLKTHILTHVKTKNNP

SEQ ID NO: 98319 - protein, 236 aa, Homo sapiens
  Payload ID: 19620
  Gene Name: ZBED6 C-terminal like
  Uniprot ID: Q96FA7
  ENSP ID: ENSP00000343242
MVVREASAAQASLSQVLPQLRYLHIFLEQVHTHFQEQSVGERGAAIQLAEGLARQLCTDCQLNKLFYREEFVLATLLDPCFKGKIEAILPWGPTDIDHWKQVLVYKVKEIRVSEYSLNSPSPLQSPRGLCVDPTRVAKSSGVEGRSQGEPLQSSSHSGAFLLAQREKGLLESMGLLASERSGGSLSTKSHWASIIVKKYLWENETVGAQDDPLAYWEKKREAWPPSICLTPHRSLL

SEQ ID NO: 98320 - protein, 429 aa, Homo sapiens
  Payload ID: 19621
  Gene Name: Z-DNA binding protein 1
  Uniprot ID: Q9H171
  ENSP ID: ENSP00000360215
MAQAPADPGREGHLEQRILQVLTEAGSPVKLAQLVKECQAPKRELNQVLYRMKKELKVSLTSPATWCLGGTDPEGEGPAELALSSPAERPQQHAATIPETPGPQFSQQREEDIYRFLKDNGPQRALVIAQALGMRTAKDVNRDLYRMKSRHLLDMDEQSKAWTIYRPEDSGRRAKSASIIYQHNPINMICQNGPNSWISIANSEAIQIGHGNIITRQTVSREDGSAGPRHLPSMAPGDSSTWGTLVDPWGPQDIHMEQSILRRVQLGHSNEMRLHGVPSEGPAHIPPGSPPVSATAAGPEASFEARIPSPGTHPEGEAAQRIHMKSCFLEDATIGNSNKMSISPGVAGPGGVAGSGEGEPGEDAGRRPADTQSRSHFPRDIGQPITPSHSKLTPKLETMTLGNRSHKAAEGSHYVDEASHEGSWWGGGI

SEQ ID NO: 98321 - protein, 354 aa, Homo sapiens
  Payload ID: 19621
  Gene Name: Z-DNA binding protein 1
  Uniprot ID: Q9H171
  ENSP ID: ENSP00000379167
MAQAPADPGREAERPQQHAATIPETPGPQFSQQREEDIYRFLKDNGPQRALVIAQALGMRTAKDVNRDLYRMKSRHLLDMDEQSKAWTIYRPEDSGRRAKSASIIYQHNPINMICQNGPNSWISIANSEAIQIGHGNIITRQTVSREDGSAGPRHLPSMAPGDSSTWGTLVDPWGPQDIHMEQSILRRVQLGHSNEMRLHGVPSEGPAHIPPGSPPVSATAAGPEASFEARIPSPGTHPEGEAAQRIHMKSCFLEDATIGNSNKMSISPGVAGPGGVAGSGEGEPGEDAGRRPADTQSRSHFPRDIGQPITPSHSKLTPKLETMTLGNRSHKAAEGSHYVDEASHEGSWWGGGI

SEQ ID NO: 98322 - protein, 119 aa, Homo sapiens
  Payload ID: 19621
  Gene Name: Z-DNA binding protein 1
  ENSP ID: ENSP00000404620
  MOD_RES (1)..(1): Any amino acid
XCFLEDATIGNSNKMSISPGVAGPGGVAGSGEGEPGEDAVAAFTEVLNPSKSFMKFGINFFQTPVNVDSLTSSHESQMFLTACRLVIFSRRFSTYFAQIHLRNHSVLHLCPHKIYLLKN

SEQ ID NO: 98323 - protein, 248 aa, Homo sapiens
  Payload ID: 19621
  Gene Name: Z-DNA binding protein 1
  Uniprot ID: Q9H171
  ENSP ID: ENSP00000440552
MAQAPADPGREGHLEQRILQVLTEAGSPVKLAQLVKECQAPKRELNQVLYRMKKELKVSLTSPATWCLGGTDPEGEGPAELALSSPAERPQQHAATIPETPGPQFSQQREEDIYRFLKDNGPQRALVIAQALGMRTAKDVNRDLYRMKSRHLLDMDEQSKAWTIYRPEDSGRRAKSASIIYQHNPINMICQNGPNSWISIANSEAIQIGHGNIITRQTVSREDGKSPKRAQGGDLGGEPPDPLGGGKG

SEQ ID NO: 98324 - protein, 619 aa, Homo sapiens
  Payload ID: 19622
  Gene Name: zeta-chain (TCR) associated protein kinase 70kDa
  Uniprot ID: P43403
  ENSP ID: ENSP00000264972
MPDPAAHLPFFYGSISRAEAEEHLKLAGMADGLFLLRQCLRSLGGYVLSLVHDVRFHHFPIERQLNGTYAIAGGKAHCGPAELCEFYSRDPDGLPCNLRKPCNRPSGLEPQPGVFDCLRDAMVRDYVRQTWKLEGEALEQAIISQAPQVEKLIATTAHERMPWYHSSLTREEAERKLYSGAQTDGKFLLRPRKEQGTYALSLIYGKTVYHYLISQDKAGKYCIPEGTKFDTLWQLVEYLKLKADGLIYCLKEACPNSSASNASGAAAPTLPAHPSTLTHPQRRIDTLNSDGYTPEPARITSPDKPRPMPMDTSVYESPYSDPEELKDKKLFLKRDNLLIADIELGCGNFGSVRQGVYRMRKKQIDVAIKVLKQGTEKADTEEMMREAQIMHQLDNPYIVRLIGVCQAEALMLVMEMAGGGPLHKFLVGKREEIPVSNVAELLHQVSMGMKYLEEKNFVHRDLAARNVLLVNRHYAKISDFGLSKALGADDSYYTARSAGKWPLKWYAPECINFRKFSSRSDVWSYGVTMWEALSYGQKPYKKMKGPEVMAFIEQGKRMECPPECPPELYALMSDCWIYKWEDRPDFLTVEQRMRACYYSLASKVEGPPGSTQKAEAACA

SEQ ID NO: 98325 - protein, 312 aa, Homo sapiens
  Payload ID: 19622
  Gene Name: zeta-chain (TCR) associated protein kinase 70kDa
  Uniprot ID: P43403
  ENSP ID: ENSP00000400475
MPMDTSVYESPYSDPEELKDKKLFLKRDNLLIADIELGCGNFGSVRQGVYRMRKKQIDVAIKVLKQGTEKADTEEMMREAQIMHQLDNPYIVRLIGVCQAEALMLVMEMAGGGPLHKFLVGKREEIPVSNVAELLHQVSMGMKYLEEKNFVHRDLAARNVLLVNRHYAKISDFGLSKALGADDSYYTARSAGKWPLKWYAPECINFRKFSSRSDVWSYGVTMWEALSYGQKPYKKMKGPEVMAFIEQGKRMECPPECPPELYALMSDCWIYKWEDRPDFLTVEQRMRACYYSLASKVEGPPGSTQKAEAACA

SEQ ID NO: 98326 - protein, 374 aa, Homo sapiens
  Payload ID: 19623
  Gene Name: ZFP1 zinc finger protein
  ENSP ID: ENSP00000333192
MDVMLENYSNLLSVEVWKADDQMERDHRNPDEQARQFLILKNQTPIEERGDLFGKALNLNTDFVSLRQVPYKYDLYEKTLKYNSDLLNSNRSYAGKQTDECNEFGKALLYLKQEKTHSGVEYSEYNKSGKALSHKAAIFKHQKIKNLVQPFICTYCDKAFSFKSLLISHKRIHTGEKPYECNVCKKTFSHKANLIKHQRIHTGEKPFECPECGKAFTHQSNLIVHQRAHMEKKPYECSECGKTFAQKFELTTHQRIHTGERPYECNECAKTFFKKSNLIIHQKIHTGEKRYECSECGKSFIQNSQLIIHMRTHTGEKPYECTECGKTFSQRSTLRLHLRIHTGEKPYECSECGKAFSRKSRLSVHQRVHIGEKP

SEQ ID NO: 98327 - protein, 407 aa, Homo sapiens
  Payload ID: 19623
  Gene Name: ZFP1 zinc finger protein
  Uniprot ID: Q6P2D0
  ENSP ID: ENSP00000377080
MNKSQGSVSFTDVTVDFTQEEWEQLDPSQRILYMDVMLENYSNLLSVEVWKADDQMERDHRNPDEQARQFLILKNQTPIEERGDLFGKALNLNTDFVSLRQVPYKYDLYEKTLKYNSDLLNSNRSYAGKQTDECNEFGKALLYLKQEKTHSGVEYSEYNKSGKALSHKAAIFKHQKIKNLVQPFICTYCDKAFSFKSLLISHKRIHTGEKPYECNVCKKTFSHKANLIKHQRIHTGEKPFECPECGKAFTHQSNLIVHQRAHMEKKPYECSECGKTFAQKFELTTHQRIHTGERPYECNECAKTFFKKSNLIIHQKIHTGEKRYECSECGKSFIQNSQLIIHMRTHTGEKPYECTECGKTFSQRSTLRLHLRIHTGEKPYECSECGKAFSRKSRLSVHQRVHIGEKP

SEQ ID NO: 98328 - protein, 28 aa, Homo sapiens
  Payload ID: 19623
  Gene Name: ZFP1 zinc finger protein
  ENSP ID: ENSP00000454286
MNKSQKCGRLMTRWRETTETQTSRRGNF

SEQ ID NO: 98329 - protein, 76 aa, Homo sapiens
  Payload ID: 19623
  Gene Name: ZFP1 zinc finger protein
  ENSP ID: ENSP00000455627
MNKSQGSVSFTDVTVDFTQEEWEQLDPSQRILYMDVMLENYSNLLSVGKDGFQKCGRLMTRWRETTETQTSRRGNF

SEQ ID NO: 98330 - protein, 407 aa, Homo sapiens; identical to SEQ ID NO: 98327
  Payload ID: 19623
  Gene Name: ZFP1 zinc finger protein
  Uniprot ID: Q6P2D0
  ENSP ID: ENSP00000457044

SEQ ID NO: 98331 - protein, 76 aa, Homo sapiens; identical to SEQ ID NO: 98329
  Payload ID: 19623
  Gene Name: ZFP1 zinc finger protein
  ENSP ID: ENSP00000457941

SEQ ID NO: 98332 - protein, 533 aa, Homo sapiens
  Payload ID: 19624
  Gene Name: ZFP14 zinc finger protein
  Uniprot ID: Q9HCL3
  ENSP ID: ENSP00000270001
MAHGSVTFRDVAIDFSQEEWEFLDPAQRDLYRDVMWENYSNFISLGPSISKPDVITLLDEERKEPGMVVREGTRRYCPDLESRYRTNTLSPEKDIYEIYSFQWDIMERIKSYSLQGSIFRNDWECKSKIEGEKEQQEGYFGQVKITSEKMTTYKRHNFLTEYQIVHNGEKVYECKECRKTFIRRSTLSQHLRIHTGEKPYKCKECGQAFRQRAHLIRHHKLHTGEKPYECKECGKAFTVLQELTQHQRLHTGEKPYECKECGKAFRVHQQLARHQRIHTGEKPYECKDCGKTFRQCTHLTRHQRLHTAEKLYECKECGKAFVCGPDLRVHQKIHFGEKPYECKECGKAFRICQQLTVHQSIHTGEKPYECKECGKTFRLRQQLVRHQRIHTREKPYECMECWKTFSSYSQLISHQSIHIGERPYECEECGKAFRLLSQLTQHQSIHTGEKPYECKECRKPFRLLSQLTQHQSIHTGEKPYECKECGKAFRLYSFLTQHQRIHTGEKPYKCKECKKAFRQHSHLTQHQKIHNGI

SEQ ID NO: 98333 - protein, 81 aa, Homo sapiens
  Payload ID: 19624
  Gene Name: ZFP14 zinc finger protein
  ENSP ID: ENSP00000466416
MAHGSVTFRDVAIDFSQEEWEFLDPAQRDLYRDVMWENYSNFISLAGPSISKPDVITLLDEERKEPGMVVREGTRRYCPGE

SEQ ID NO: 98334 - protein, 461 aa, Homo sapiens
  Payload ID: 19625
  Gene Name: ZFP2 zinc finger protein
  Uniprot ID: Q6ZN57
  ENSP ID: ENSP00000354453
MEREGIWHSTLGETWEPNNWLEGQQDSHLSQVGVTHKETFTEMRVCGGNEFERCSSQDSILDTQQSIPMVKRPHNCNSHGEDATQNSELIKTQRMFVGKKIYECNQCSKTFSQSSSLLKHQRIHTGEKPYKCNVCGKHFIERSSLTVHQRIHTGEKPYKCNECGKAFSQSMNLTVHQRTHTGEKPYQCKECGKAFHKNSSLIQHERIHTGEKPYKCNECGKAFTQSMNLTVHQRTHTGEKPYECNECGKAFSQSMHLIVHQRSHTGEKPYECSQCGKAFSKSSTLTLHQRNHTGEKPYKCNKCGKSFSQSTYLIEHQRLHSGVKPFECNECGKAFSKNSSLTQHRRIHTGEKPYECMVCGKHFTGRSSLTVHQVIHTGEKPYECNECGKAFSQSAYLIEHQRIHTGEKPYECDQCGKAFIKNSSLTVHQRTHTGEKPYQCNECGKAFSRSTNLTRHQRTHT

SEQ ID NO: 98335 - protein, 23 aa, Homo sapiens
  Payload ID: 19625
  Gene Name: ZFP2 zinc finger protein
  ENSP ID: ENSP00000429095
MEREGIWHSTLGETWEPNNWLEG

SEQ ID NO: 98336 - protein, 461 aa, Homo sapiens; identical to SEQ ID NO: 98334
  Payload ID: 19625
  Gene Name: ZFP2 zinc finger protein
  Uniprot ID: Q6ZN57
  ENSP ID: ENSP00000430531

SEQ ID NO: 98337 - protein, 461 aa, Homo sapiens; identical to SEQ ID NO: 98334
  Payload ID: 19625
  Gene Name: ZFP2 zinc finger protein
  Uniprot ID: Q6ZN57
  ENSP ID: ENSP00000430980

SEQ ID NO: 98338 - protein, 8 aa, Homo sapiens
  Payload ID: 19625
  Gene Name: ZFP2 zinc finger protein
  ENSP ID: ENSP00000431074
MEREGIWH

SEQ ID NO: 98339 - protein, 868 aa, Homo sapiens
  Payload ID: 19626
  Gene Name: ZFP28 zinc finger protein
  Uniprot ID: Q8NHY6
  ENSP ID: ENSP00000301318
MRGAASASVREPTPLPGRGAPRTKPRAGRGPTVGTPATLALPARGRPRSRNGLASKGQRGAAPTGPGHRALPSRDTALPQERNKKLEAVGTGIEPKAMSQGLVTFGDVAVDFSQEEWEWLNPIQRNLYRKVMLENYRNLASLGLCVSKPDVISSLEQGKEPWTVKRKMTRAWCPDLKAVWKIKELPLKKDFCEGKLSQAVITERLTSYNLEYSLLGEHWDYDALFETQPGLVTIKNLAVDFRQQLHPAQKNFCKNGIWENNSDLGSAGHCVAKPDLVSLLEQEKEPWMVKRELTGSLFSGQRSVHETQELFPKQDSYAEGVTDRTSNTKLDCSSFRENWDSDYVFGRKLAVGQETQFRQEPITHNKTLSKERERTYNKSGRWFYLDDSEEKVHNRDSIKNFQKSSVVIKQTGIYAGKKLFKCNECKKTFTQSSSLTVHQRIHTGEKPYKCNECGKAFSDGSSFARHQRCHTGKKPYECIECGKAFIQNTSLIRHWRYYHTGEKPFDCIDCGKAFSDHIGLNQHRRIHTGEKPYKCDVCHKSFRYGSSLTVHQRIHTGEKPYECDVCRKAFSHHASLTQHQRVHSGEKPFKCKECGKAFRQNIHLASHLRIHTGEKPFECAECGKSFSISSQLATHQRIHTGEKPYECKVCSKAFTQKAHLAQHQKTHTGEKPYECKECGKAFSQTTHLIQHQRVHTGEKPYKCMECGKAFGDNSSCTQHQRLHTGQRPYECIECGKAFKTKSSLICHRRSHTGEKPYECSVCGKAFSHRQSLSVHQRIHSGKKPYECKECRKTFIQIGHLNQHKRVHTGERSYNYKKSRKVFRQTAHLAHHQRIHTGESSTCPSLPSTSNPVDLFPKFLWNPSSLPSP

SEQ ID NO: 98340 - protein, 146 aa, Homo sapiens
  Payload ID: 19626
  Gene Name: ZFP28 zinc finger protein
  ENSP ID: ENSP00000465853
TLALPARGRPRSRNGLASKGQRGAAPTGPGHRALPSRDTALPQERNKKLEAVGTGIEPKAMSQGLVTFGDVAVDFSQEEWEWLNPIQRNLYRKVMLENYRNLASLGLCVSKPDVISSLEQGKEPWTVKRKMTRAWCPDHSSLLETS

SEQ ID NO: 98341 - protein, 349 aa, Homo sapiens
  Payload ID: 19626
  Gene Name: ZFP28 zinc finger protein
  Uniprot ID: Q8NHY6
  ENSP ID: ENSP00000468603
MRGAASASVREPTPLPGRGAPRTKPRAGRGPTVGTPATLALPARGRPRSRNGLASKGQRGAAPTGPGHRALPSRDTALPQERNKKLEAVGTGIEPKAMSQGLVTFGDVAVDFSQEEWEWLNPIQRNLYRKVMLENYRNLASLGLCVSKPDVISSLEQGKEPWTVKRKMTRAWCPDLKAVWKIKELPLKKDFCEGKLSQAVITERLTSYNLEYSLLGEHWDYDALFETQPGLVTIKNLAVDFRQQLHPAQKNFCKNGIWENNSDLGSAGHCVAKPDLVSLLEQEKEPWMVKRELTGSLFSGECRRAWCGKSTARESGAFTKKAASSLIYSRKLYPGSLGLERKLNSGSSK

SEQ ID NO: 98342 - protein, 502 aa, Homo sapiens
  Payload ID: 19627
  Gene Name: ZFP3 zinc finger protein
  Uniprot ID: Q96NJ6
  ENSP ID: ENSP00000320347
MGTENKEVIPKEEISEESEPHGSLLEKFPKVVYQGHEFGAGCEEDMLEGHSRESMEEVIEQMSPQERDFPSGLMIFKKSPSSEKDRENNESERGCSPSPNLVTHQGDTTEGVSAFATSGQNFLEILESNKTQRSSVGEKPHTCKECGKAFNQNSHLIQHMRVHSGEKPFECKECGKTFGTNSSLRRHLRIHAGEKPFACNECGKAFIQSSHLIHHHRIHTGERPYKCEECGKAFSQNSALILHQRIHTGEKPYECNECGKTFRVSSQLIQHQRIHTEERYHECNECGKAFKHSSGLIRHQKIHTGEKPYLCNECGKGFGQSSELIRHQRIHTGDKPYECNECGKTFGQNSEIIRHIRIHTGEKPYVCKECGKAFRGNSELLRHERIHTGEKPYECFECGKAFRRTSHLIVHQRIHTGEKPHQCNECARTFWDNSELLLHQKIHIGEKPYECSECEKTFSQHSQLIIHQRIHTGEKPYECQECQKTFSRSSHLLRHQSVHCME

SEQ ID NO: 98343 - protein, 519 aa, Homo sapiens
  Payload ID: 19628
  Gene Name: ZFP30 zinc finger protein
  Uniprot ID: Q9Y2G7
  ENSP ID: ENSP00000343581
MARDLVMFRDVAVDFSQEEWECLNSYQRNLYRDVILENYSNLVSLAGCSISKPDVITLLEQGKEPWMVVRDEKRRWTLDLESRYDTKKLFQGKDIYEMNLSQWKVMERIKSCGLEEQESPHEVCFRQVTKTTSEKMPTYRKLTSLPLYQKSHNREKPYECGECGKAFRVRQQLTFHQRIHTGEKPYECKECGKAFRQCAHLSRHQRIHTSDKLYECKKCGKIFTCGSDLRVHQRIHIGEKPYECKECGKAFRVRGQLNLHQRIHTGEKPYECKECGKAFRQYAHLTRHQRLNIAEKCYECKECGQAFLCSTGLRLHHKLHTGEKPYECKECGKAFRVRQQLTLHQRIHTGEKPYDCKECGKTFSRGYHLTLHQRIHTGEKPYECKECQKFFRRYSELISHQGIHIGEKPYECKECGKAFRLFSQLTQHQSIHFGEKPFKCKECEKTFRLLSQLTQHQSIHTGEKPYDCKECGKAFRLHSSLIQHQRIHSGEKPYKCKECKKAFRQHSHLTYHQRIHNVT

SEQ ID NO: 98344 - protein, 519 aa, Homo sapiens; identical to SEQ ID NO: 98343
  Payload ID: 19628
  Gene Name: ZFP30 zinc finger protein
  Uniprot ID: Q9Y2G7
  ENSP ID: ENSP00000375988

SEQ ID NO: 98345 - protein, 519 aa, Homo sapiens; identical to SEQ ID NO: 98343
  Payload ID: 19628
  Gene Name: ZFP30 zinc finger protein
  Uniprot ID: Q9Y2G7
  ENSP ID: ENSP00000422930

SEQ ID NO: 98346 - protein, 56 aa, Homo sapiens
  Payload ID: 19628
  Gene Name: ZFP30 zinc finger protein
  ENSP ID: ENSP00000465496
MARDLVMFRDVAVDFSQEEWECLNSYQRNLYRDVILENYSNLVSLAGCSISKPDVI

SEQ ID NO: 98347 - protein, 124 aa, Homo sapiens
  Payload ID: 19628
  Gene Name: ZFP30 zinc finger protein
  ENSP ID: ENSP00000466563
MARDLVMFRDVAVDFSQEEWECLNSYQRNLYRDVILENYSNLVSLGCSISKPDVITLLEQGKEPWMVVRDEKRRWTLDLESRYDTKKLFQGKDIYEMNLSQWKVMERIKSCGLEEQESPHEVCF

SEQ ID NO: 98348 - protein, 3 aa, Homo sapiens
  Payload ID: 19628
  Gene Name: ZFP30 zinc finger protein
  ENSP ID: ENSP00000466993
MAR

SEQ ID NO: 98349 - protein, 92 aa, Homo sapiens
  Payload ID: 19628
  Gene Name: ZFP30 zinc finger protein
  ENSP ID: ENSP00000467387
MARDLVMFRDVAVDFSQEEWECLNSYQRNLYRDVILENYSNLVSLGCSISKPDVITLLEQGKEPWMVVRDEKRRWTLGPTFKYHHLGIRVST

SEQ ID NO: 98350 - protein, 2 aa, Homo sapiens
  Payload ID: 19628
  Gene Name: ZFP30 zinc finger protein
  ENSP ID: ENSP00000468295
MA

SEQ ID NO: 98351 - protein, 332 aa, Homo sapiens
  Payload ID: 19629
  Gene Name: ZFP36 ring finger protein
  ENSP ID: ENSP00000469647
MANRYTMDLTAIYESLLSLSPDVPVPSDHGGTESSPGWGSSGPWSLSPSDSSPSGVTSRLPGRSTSLVEGRSCGWVPPPPGFAPLAPRLGPELSPSPTSPTATSTTPSRYKTELCRTFSESGRCRYGAKCQFAHGLGELRQANRHPKYKTELCHKFYLQGRCPYGSRCHFIHNPSEDLAAPGHPPVLRQSISFSGLPSGRRTSPPPPGLAGPSLSSSSFSPSSSPPPPGDLPLSPSAFSAAPGTPLARRDPTPVCCPSCRRATPISVWGPLGGLVRTPSVQSLGSDPDEYASSGSSLGGSDSPVFEAGVFAPPQPVAAPRRLPIFNRISVSE

SEQ ID NO: 98352 - protein, 148 aa, Homo sapiens
  Payload ID: 19629
  Gene Name: ZFP36 ring finger protein
  ENSP ID: ENSP00000470200
  MOD_RES (1)..(1): Any amino acid
XHIRGGQETQNWETVSLLSLSPDVPVPSDHGGTESSPGWGSSGPWSLSPSDSSPSGVTSRLPGRSTSLVEGRSCGWVPPPPGFAPLAPRLGPELSPSPTSPTATSTTPSRYKTELCRTFSESGRCRYGAKCQFAHGLGELRQANRHPK

SEQ ID NO: 98353 - protein, 343 aa, Homo sapiens
  Payload ID: 19629
  Gene Name: ZFP36 ring finger protein
  ENSP ID: ENSP00000471239
  MOD_RES (1)..(1): Any amino acid
XALPLSADTPHGQPLHHGSDCHLRGDLLSLSPDVPVPSDHGGTESSPGWGSSGPWSLSPSDSSPSGVTSRLPGRSTSLVEGRSCGWVPPPPGFAPLAPRLGPELSPSPTSPTATSTTPSRYKTELCRTFSESGRCRYGAKCQFAHGLGELRQANRHPKYKTELCHKFYLQGRCPYGSRCHFIHNPSEDLAAPGHPPVLRQSISFSGLPSGRRTSPPPPGLAGPSLSSSSFSPSSSPPPPGDLPLSPSAFSAAPGTPLARRDPTPVCCPSCRRATPISVWGPLGGLVRTPSVQSLGSDPDEYASSGSSLGGSDSPVFEAGVFAPPQPVAAPRRLPIFNRISVSE

SEQ ID NO: 98354 - protein, 71 aa, Homo sapiens [sequence omitted]

SEQ ID NO: 98355 - protein, 338 aa, Homo sapiens
  Payload ID: 19630
  Gene Name: ZFP36 ring finger protein-like 1
  Uniprot ID: Q07352
  ENSP ID: ENSP00000337386
MTTTLVSATIFDLSEVLCKGNKMLNYSAPSAGGCLLDRKAVGTPAGGGFPRRHSVTLPSSKFHQNQLLSSLKGEPAPALSSRDSRFRDRSFSEGGERLLPTQKQPGGGQVNSSRYKTELCRPFEENGACKYGDKCQFAHGIHELRSLTRHPKYKTELCRTFHTIGFCPYGPRCHFIHNAEERRALAGARDLSADRPRLQHSFSFAGFPSAAATAAATGLLDSPTSITPPPILSADDLLGSPTLPDGTNNPFAFSSQELASLFAPSMGLPGGGSPTTFLFRPMSESPHMFDSPPSPQDSLSDQEGYLSSSSSSHSGSDSPTLDNSRRLPIFSRLSISDD

SEQ ID NO: 98356 - protein, 338 aa, Homo sapiens; identical to SEQ ID NO: 98355
  Payload ID: 19630
  Gene Name: ZFP36 ring finger protein-like 1
  Uniprot ID: Q07352
  ENSP ID: ENSP00000388402

SEQ ID NO: 98357 - protein, 176 aa, Homo sapiens
  Payload ID: 19630
  Gene Name: ZFP36 ring finger protein-like 1
  ENSP ID: ENSP00000450600
MLNYSAPSAGGCLLDRKAVGTPAGGGFPRRHSVTLPSSKFHQNQLLSSLKGEPAPALSSRDSRFRDRSFSEGGERLLPTQKQPGGGQVNSSRYKTELCRPFEENGACKYGDKCQFAHGIHELRSLTRHPKYKTELCRTFHTIGFCPYGPRCHFIHNAEERRALAGARDLSADRPRL

SEQ ID NO: 98358 - protein, 207 aa, Homo sapiens
  Payload ID: 19630
  Gene Name: ZFP36 ring finger protein-like 1
  ENSP ID: ENSP00000450784
MGRARKSGLGQRSRPTASRSEAAVQGNKMLNYSAPSAGGCLLDRKAVGTPAGGGFPRRHSVTLPSSKFHQNQLLSSLKGEPAPALSSRDSRFRDRSFSEGGERLLPTQKQPGGGQVNSSRYKTELCRPFEENGACKYGDKCQFAHGIHELRSLTRHPKYKTELCRTFHTIGFCPYGPRCHFIHNAEERRALAGARDLSADRPRLQHS

SEQ ID NO: 98359 - protein, 69 aa, Homo sapiens
  Payload ID: 19630
  Gene Name: ZFP36 ring finger protein-like 1
  ENSP ID: ENSP00000451093
MVREIIVENISSGNLGQRVLFSGITSLSPPTSDQAPNLLPTRKSKGSLKTCCQRKGTLLKEEVESLRPG

SEQ ID NO: 98360 - protein, 189 aa, Homo sapiens
  Payload ID: 19630
  Gene Name: ZFP36 ring finger protein-like 1
  ENSP ID: ENSP00000452119
MGRARKSGLGQRSRPTASRSEAAVQPGVRKARGAGNWRVGLQTGEAAPSPHRDLRDTPDPRPWLARTHRMTTTLVSATIFDLSEVLCKGNKMLNYSAPSAGGCLLDRKAVGTPAGGGFPRRHSVTLPSSKFHQNQLLSSLKGEPAPALSSRDSRFRDRSFSEGGERLLPTQKQPGGGQVNSSRYKTELC

SEQ ID NO: 98361 - protein, 494 aa, Homo sapiens
  Payload ID: 19631
  Gene Name: ZFP36 ring finger protein-like 2
  Uniprot ID: P47974
  ENSP ID: ENSP00000282388
MSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSASSCSSASAASTPSGAPTCCASAAAAAAAALLYGTGGAEDLLAPGAPCAACSSASCANNAFAFGPELSSLITPLAIQTHNFAAVAAAAYYRSQQQQQQQGLAPPAQPPAPPSATLPAGAAAPPSPPFSFQLPRRLSDSPVFDAPPSPPDSLSDRDSYLSGSLSSGSLSGSESPSLDPGRRLPIFSRLSISDD

SEQ ID NO: 98362 - protein, 492 aa, Homo sapiens
  Payload ID: 19631
  Gene Name: ZFP36 ring finger protein-like 2
  ENSP ID: ENSP00000478940
MSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSASSCSSASAASTPSGAPTCCASAAAALRLLYGTGGAEDLLAPGAPCAACSSASCANNAFAFGPELSSLITPLAIQTHNFAAVAAAAYYRSQQQQQQQGLAPPAQPPAPPSATLPAGAAAPPSPPFSFQLPRRLSDSPVFDAPPSPPDSLSDRDSYLSGSLSSGSLSGSESPSLDPGRRLPIFSRLSISDD

SEQ ID NO: 98363 - protein, 630 aa, Homo sapiens
  Payload ID: 19632
  Gene Name: ZFP37 zinc finger protein
  Uniprot ID: Q9Y6Q3
  ENSP ID: ENSP00000363344
MSVSSGVQILTKPETVDRRRSAETTKEAGRPLEMAVSEPEASAAEWKQLDPAQSNLYNDVMLENYCNQASMGCQAPKPDMISKLEKGEAPWLGKGKRPSQGCPSKIARPKQKETDGKVQKDDDQLENIQKSQNKLLREVAVKKKTQAKKNGSDCGSLGKKNNLHKKHVPSKKRLLKFESCGKILKQNLDLPDHSRNCVKRKSDAAKEHKKSFNHSLSDTRKGKKQTGKKHEKLSSHSSSDKCNKTGKKHDKLCCHSSSHIKQDKIQTGEKHEKSPSLSSSTKHEKPQACVKPYECNQCGKVLSHKQGLIDHQRVHTGEKPYECNECGIAFSQKSHLVVHQRTHTGEKPYECIQCGKAHGHKHALTDHLRIHTGEKPYECAECGKTFRHSSNLIQHVRSHTGEKPYECKECGKSFRYNSSLTEHVRTHTGEIPYECNECGKAFKYSSSLTKHMRIHTGEKPFECNECGKAFSKKSHLIIHQRTHTKEKPYKCNECGKAFGHSSSLTYHMRTHTGESPFECNQCGKGFKQIEGLTQHQRVHTGEKPYECNECGKAFSQKSHLIVHQRTHTGEKPYECNECEKAFNAKSQLVIHQRSHTGEKPYECNECGKTFKQNASLTKHVKTHSEDKSHE

SEQ ID NO: 98364 - protein, 631 aa, Homo sapiens
  Payload ID: 19632
  Gene Name: ZFP37 zinc finger protein
  Uniprot ID: Q9Y6Q3
  ENSP ID: ENSP00000451310
MSVSSGVQILTKPETVDRRRSAETTKEAGRPLEMAVSEPEASAAKEWKQLDPAQSNLYNDVMLENYCNQASMGCQAPKPDMISKLEKGEAPWLGKGKRPSQGCPSKIARPKQKETDGKVQKDDDQLENIQKSQNKLLREVAVKKKTQAKKNGSDCGSLGKKNNLHKKHVPSKKRLLKFESCGKILKQNLDLPDHSRNCVKRKSDAAKEHKKSFNHSLSDTRKGKKQTGKKHEKLSSHSSSDKCNKTGKKHDKLCCHSSSHIKQDKIQTGEKHEKSPSLSSSTKHEKPQACVKPYECNQCGKVLSHKQGLIDHQRVHTGEKPYECNECGIAFSQKSHLVVHQRTHTGEKPYECIQCGKAHGHKHALTDHLRIHTGEKPYECAECGKTFRHSSNLIQHVRSHTGEKPYECKECGKSFRYNSSLTEHVRTHTGEIPYECNECGKAFKYSSSLTKHMRIHTGEKPFECNECGKAFSKKSHLIIHQRTHTKEKPYKCNECGKAFGHSSSLTYHMRTHTGESPFECNQCGKGFKQIEGLTQHQRVHTGEKPYECNECGKAFSQKSHLIVHQRTHTGEKPYECNECEKAFNAKSQLVIHQRSHTGEKPYECNECGKTFKQNASLTKHVKTHSEDKSHE

SEQ ID NO: 98365 - protein, 645 aa, Homo sapiens
  Payload ID: 19632
  Gene Name: ZFP37 zinc finger protein
  Uniprot ID: Q9Y6Q3
  ENSP ID: ENSP00000452552
MSVSSGVQILTKPETVDRRRSAETTKEAGRPLEMAVSEPEASAAVSVTFKHVTMAFTQKEWKQLDPAQSNLYNDVMLENYCNQASMGCQAPKPDMISKLEKGEAPWLGKGKRPSQGCPSKIARPKQKETDGKVQKDDDQLENIQKSQNKLLREVAVKKKTQAKKNGSDCGSLGKKNNLHKKHVPSKKRLLKFESCGKILKQNLDLPDHSRNCVKRKSDAAKEHKKSFNHSLSDTRKGKKQTGKKHEKLSSHSSSDKCNKTGKKHDKLCCHSSSHIKQDKIQTGEKHEKSPSLSSSTKHEKPQACVKPYECNQCGKVLSHKQGLIDHQRVHTGEKPYECNECGIAFSQKSHLVVHQRTHTGEKPYECIQCGKAHGHKHALTDHLRIHTGEKPYECAECGKTFRHSSNLIQHVRSHTGEKPYECKECGKSFRYNSSLTEHVRTHTGEIPYECNECGKAFKYSSSLTKHMRIHTGEKPFECNECGKAFSKKSHLIIHQRTHTKEKPYKCNECGKAFGHSSSLTYHMRTHTGESPFECNQCGKGFKQIEGLTQHQRVHTGEKPYECNECGKAFSQKSHLIVHQRTHTGEKPYECNECEKAFNAKSQLVIHQRSHTGEKPYECNECGKTFKQNASLTKHVKTHSEDKSHE

SEQ ID NO: 98366 - protein, 199 aa, Homo sapiens; identical to SEQ ID NO: 75977
  Payload ID: 19633
  Gene Name: ZFP41 zinc finger protein
  ENSP ID: ENSP00000327427

SEQ ID NO: 98367 - protein, 199 aa, Homo sapiens; identical to SEQ ID NO: 75977
  Payload ID: 19633
  Gene Name: ZFP41 zinc finger protein
  ENSP ID: ENSP00000430465

SEQ ID NO: 98368 - protein, 310 aa, Homo sapiens
  Payload ID: 19634
  Gene Name: ZFP42 zinc finger protein
  Uniprot ID: Q96MM3
  ENSP ID: ENSP00000317686
MSQQLKKRAKTRHQKGLGGRAPSGAKPRQGKSSQDLQAEIEPVSAVWALCDGYVCYEPGPQALGGDDFSDCYIECVIRGEFSQPILEEDSLFESLEYLKKGSEQQLSQKVFEASSLECSLEYMKKGVKKELPQKIVGENSLEYSEYMTGKKLPPGGIPGIDLSDPKQLAEFARKKPPINKEYDSLSAIACPQSGCTRKLRNRAALRKHLLIHGPRDHVCAECGKAFVESSKLKRHFLVHTGEKPFRCTFEGCGKRFSLDFNLRTHVRIHTGEKRFVCPFQGCNRRFIQSNNLKAHILTHANTNKNEQEGK

SEQ ID NO: 98369 - protein, 310 aa, Homo sapiens; identical to SEQ ID NO: 98368
  Payload ID: 19634
  Gene Name: ZFP42 zinc finger protein
  Uniprot ID: Q96MM3
  ENSP ID: ENSP00000424662

SEQ ID NO: 98370 - protein, 310 aa, Homo sapiens; identical to SEQ ID NO: 98368
  Payload ID: 19634
  Gene Name: ZFP42 zinc finger protein
  Uniprot ID: Q96MM3
  ENSP ID: ENSP00000483363

SEQ ID NO: 98371 - protein, 452 aa, Homo sapiens
  Payload ID: 19635
  Gene Name: ZFP57 zinc finger protein
  Uniprot ID: Q9NU63
  ENSP ID: ENSP00000366078
MAAGEPRSLLFFQKPVTFEDVAVNFTQEEWDCLDASQRVLYQDVMSETFKNLTSVARIFLHKPELITKLEQEEEQWRETRVLQASQAGPPFFCYTCGKCFSRRSYLYSHQFVHNPKLTNSCSQCGKLFRSPKSLSYHRRMHLGERPFCCTLCDKTYCDASGLSRHRRVHLGYRPHSCSVCGKSFRDQSELKRHQKIHQNQEPVDGNQECTLRIPGTQAEFQTPIARSQRSIQGLLDVNHAPVARSQEPIFRTEGPMAQNQASVLKNQAPVTRTQAPITGTLCQDARSNSHPVKPSRLNVFCCPHCSLTFSKKSYLSRHQKAHLTEPPNYCFHCSKSFSSFSRLVRHQQTHWKQKSYLCPICDLSFGEKEGLMDHWRGYKGKDLCQSSHHKCRVILGQWLGFSHDVPTMAGEEWKHGGDQSPPRIHTPRRRGLREKACKGDKTKEAVSILKHK

SEQ ID NO: 98372 - protein, 516 aa, Homo sapiens
  Payload ID: 19635
  Gene Name: ZFP57 zinc finger protein
  Uniprot ID: Q9NU63
  ENSP ID: ENSP00000366080
MFEQLKPIEPRDCWREARVKKKPVTFEDVAVNFTQEEWDCLDASQRVLYQDVMSETFKNLTSVARIFLHKPELITKLEQEEEQWREFVHLPNTEGLSEGKKKELREQHPSLRDEGTSDDKVFLACRGAGQCPLSAPAGTMDRTRVLQASQAGPPFFCYTCGKCFSRRSYLYSHQFVHNPKLTNSCSQCGKLFRSPKSLSYHRRMHLGERPFCCTLCDKTYCDASGLSRHRRVHLGYRPHSCSVCGKSFRDQSELKRHQKIHQNQEPVDGNQECTLRIPGTQAEFQTPIARSQRSIQGLLDVNHAPVARSQEPIFRTEGPMAQNQASVLKNQAPVTRTQAPITGTLCQDARSNSHPVKPSRLNVFCCPHCSLTFSKKSYLSRHQKAHLTEPPNYCFHCSKSFSSFSRLVRHQQTHWKQKSYLCPICDLSFGEKEGLMDHWRGYKGKDLCQSSHHKCRVILGQWLGFSHDVPTMAGEEWKHGGDQSPPRIHTPRRRGLREKACKGDKTKEAVSILKHK

SEQ ID NO: 98373 - protein, 516 aa, Homo sapiens; identical to SEQ ID NO: 98372
  Payload ID: 19635
  Gene Name: ZFP57 zinc finger protein
  Uniprot ID: Q9NU63
  ENSP ID: ENSP00000373124

SEQ ID NO: 98374 - protein, 516 aa, Homo sapiens; identical to SEQ ID NO: 98372
  Payload ID: 19635
  Gene Name: ZFP57 zinc finger protein
  Uniprot ID: Q9NU63
  ENSP ID: ENSP00000394222

SEQ ID NO: 98375 - protein, 211 aa, Homo sapiens
  Payload ID: 19635
  Gene Name: ZFP57 zinc finger protein
  ENSP ID: ENSP00000394744
  MOD_RES (1)..(1): Any amino acid
XARSQEPIFRTEGPMAQNQASVLKNQAPVTRTQAPITGTLCQDARSNSHPVKPSRLNVFCCPHCSLTFSKKSYLSRHQKAHLTEPPNYCFHCSKSFSSFSRLVRHQQTHWKQKSYLCPICDLSFGEKEGLMDHWRGYKGKDLCQSSHHKCRVILGQWLGFSHDVPTMAGEEWKHGGDQSPPRIHTPRRRGLREKACKGDKTKEAVSILKHK

SEQ ID NO: 98376 - protein, 516 aa, Homo sapiens; identical to SEQ ID NO: 98372
  Payload ID: 19635
  Gene Name: ZFP57 zinc finger protein
  Uniprot ID: Q9NU63
  ENSP ID: ENSP00000396462

SEQ ID NO: 98377 - protein, 516 aa, Homo sapiens; identical to SEQ ID NO: 98372
  Payload ID: 19635
  Gene Name: ZFP57 zinc finger protein
  Uniprot ID: Q9NU63
  ENSP ID: ENSP00000398086

SEQ ID NO: 98378 - protein, 516 aa, Homo sapiens; identical to SEQ ID NO: 98372
  Payload ID: 19635
  Gene Name: ZFP57 zinc finger protein
  Uniprot ID: Q9NU63
  ENSP ID: ENSP00000409118

SEQ ID NO: 98379 - protein, 516 aa, Homo sapiens; identical to SEQ ID NO: 98372
  Payload ID: 19635
  Gene Name: ZFP57 zinc finger protein
  Uniprot ID: Q9NU63
  ENSP ID: ENSP00000412932

SEQ ID NO: 98380 - protein, 536 aa, Homo sapiens
  Payload ID: 19635
  Gene Name: ZFP57 zinc finger protein
  Uniprot ID: Q9NU63
  ENSP ID: ENSP00000418259
MFEQLKPIEPVQKTLPWVGEVAATLQEAMKRDCWREARVKKKPVTFEDVAVNFTQEEWDCLDASQRVLYQDVMSETFKNLTSVARIFLHKPELITKLEQEEEQWREFVHLPNTEGLSEGKKKELREQHPSLRDEGTSDDKVFLACRGAGQCPLSAPAGTMDRTRVLQASQAGPPFFCYTCGKCFSRRSYLYSHQFVHNPKLTNSCSQCGKLFRSPKSLSYHRRMHLGERPFCCTLCDKTYCDASGLSRHRRVHLGYRPHSCSVCGKSFRDQSELKRHQKIHQNQEPVDGNQECTLRIPGTQAEFQTPIARSQRSIQGLLDVNHAPVARSQEPIFRTEGPMAQNQASVLKNQAPVTRTQAPITGTLCQDARSNSHPVKPSRLNVFCCPHCSLTFSKKSYLSRHQKAHLTEPPNYCFHCSKSFSSFSRLVRHQQTHWKQKSYLCPICDLSFGEKEGLMDHWRGYKGKDLCQSSHHKCRVILGQWLGFSHDVPTMAGEEWKHGGDQSPPRIHTPRRRGLREKACKGDKTKEAVSILKHK

SEQ ID NO: 98381 - protein, 452 aa, Homo sapiens; identical to SEQ ID NO: 98371
  Payload ID: 19635
  Gene Name: ZFP57 zinc finger protein
  Uniprot ID: Q9NU63
  ENSP ID: ENSP00000446541

SEQ ID NO: 98382 - protein, 536 aa, Homo sapiens; identical to SEQ ID NO: 98380
  Payload ID: 19635
  Gene Name: ZFP57 zinc finger protein
  Uniprot ID: Q9NU63
  ENSP ID: ENSP00000446798

SEQ ID NO: 98383 - protein, 452 aa, Homo sapiens; identical to SEQ ID NO: 98371
  Payload ID: 19635
  Gene Name: ZFP57 zinc finger protein
  Uniprot ID: Q9NU63
  ENSP ID: ENSP00000447492

SEQ ID NO: 98384 - protein, 536 aa, Homo sapiens; identical to SEQ ID NO: 98380
  Payload ID: 19635
  Gene Name: ZFP57 zinc finger protein
  Uniprot ID: Q9NU63
  ENSP ID: ENSP00000447495

SEQ ID NO: 98385 - protein, 452 aa, Homo sapiens; identical to SEQ ID NO: 98371
  Payload ID: 19635
  Gene Name: ZFP57 zinc finger protein
  Uniprot ID: Q9NU63
  ENSP ID: ENSP00000447698

SEQ ID NO: 98386 - protein, 536 aa, Homo sapiens; identical to SEQ ID NO: 98380
  Payload ID: 19635
  Gene Name: ZFP57 zinc finger protein
  Uniprot ID: Q9NU63
  ENSP ID: ENSP00000448351

SEQ ID NO: 98387 - protein, 452 aa, Homo sapiens; identical to SEQ ID NO: 98371
  Payload ID: 19635
  Gene Name: ZFP57 zinc finger protein
  Uniprot ID: Q9NU63
  ENSP ID: ENSP00000448634

SEQ ID NO: 98388 - protein, 536 aa, Homo sapiens; identical to SEQ ID NO: 98380
  Payload ID: 19635
  Gene Name: ZFP57 zinc finger protein
  Uniprot ID: Q9NU63
  ENSP ID: ENSP00000449230

SEQ ID NO: 98389 - protein, 536 aa, Homo sapiens; identical to SEQ ID NO: 98380
  Payload ID: 19635
  Gene Name: ZFP57 zinc finger protein
  Uniprot ID: Q9NU63
  ENSP ID: ENSP00000449407

SEQ ID NO: 98390 - protein, 452 aa, Homo sapiens; identical to SEQ ID NO: 98371
  Payload ID: 19635
  Gene Name: ZFP57 zinc finger protein
  Uniprot ID: Q9NU63
  ENSP ID: ENSP00000449556

SEQ ID NO: 98391 - protein, 536 aa, Homo sapiens; identical to SEQ ID NO: 98380
  Payload ID: 19635
  Gene Name: ZFP57 zinc finger protein
  Uniprot ID: Q9NU63
  ENSP ID: ENSP00000450279

SEQ ID NO: 98392 - protein, 452 aa, Homo sapiens; identical to SEQ ID NO: 98371
  Payload ID: 19635
  Gene Name: ZFP57 zinc finger protein
  Uniprot ID: Q9NU63
  ENSP ID: ENSP00000450397

SEQ ID NO: 98393 - protein, 160 aa, Homo sapiens
  Payload ID: 19636
  Gene Name: ZFP62 zinc finger protein
  ENSP ID: ENSP00000422987
MPESKVGDTCVWDSKVENQQKKPVENRMKEDKSSIREAISKAKSTANIKTEQEGEASEKSLHLSPQHITHQTMPIGQRGSEQGKRVENINGTSYPSLQQKTNAVKKLHKCDECGKSFKYNSRLVQHKIMHTGEKRYECDDCGGTFRSSSSLRVHKRIHTG

SEQ ID NO: 98394 - protein, 103 aa, Homo sapiens
  Payload ID: 19636
  Gene Name: ZFP62 zinc finger protein
  ENSP ID: ENSP00000423709
MPESKVGDTCVWDSKVENQQKKPVENRMKEDKSSIREAISKAKSTANIKTEQEGEASEKSLHLSPQHITHQTMPIGQRGSEQGKRVENINGTSYPSLQQKTNA

SEQ ID NO: 98395 - protein, 900 aa, Homo sapiens
  Payload ID: 19636
  Gene Name: ZFP62 zinc finger protein
  Uniprot ID: Q8NB50
  ENSP ID: ENSP00000423820
MSHLKTSTEDEEPTEEYENVGNAASKWPKVEDPMPESKVGDTCVWDSKVENQQKKPVENRMKEDKSSIREAISKAKSTANIKTEQEGEASEKSLHLSPQHITHQTMPIGQRGSEQGKRVENINGTSYPSLQQKTNAVKKLHKCDECGKSFKYNSRLVQHKIMHTGEKRYECDDCGGTFRSSSSLRVHKRIHTGEKPYKCEECGKAYMSYSSLINHKSTHSGEKNCKCDECGKSFNYSSVLDQHKRIHTGEKPYECGECGKAFRNSSGLRVHKRIHTGEKPYECDICGKTFSNSSGLRVHKRIHTGEKPYECDECGKAFITCRTLLNHKSIHFGDKPYKCDECEKSFNYSSLLIQHKVIHTGEKPYECDECGKAFRNSSGLIVHKRIHTGEKPYKCDVCGKAFSYSSGLAVHKSIHPGKKAHECKECGKSFSYNSLLLQHRTIHTGERPYVCDVCGKTFRNNAGLKVHRRLHTGEKPYKCDVCGKAYISRSSLKNHKGIHLGEKPYKCSYCEKSFNYSSALEQHKRIHTREKPFGCDECGKAFRNNSGLKVHKRIHTGERPYKCEECGKAYISLSSLINHKSVHPGEKPFKCDECEKAFITYRTLTNHKKVHLGEKPYKCDVCEKSFNYTSLLSQHRRVHTREKPYECDRCEKVFRNNSSLKVHKRIHTGERPYECDVCGKAYISHSSLINHKSTHPGRTPHTCDECGKAFFSSRTLISHKRVHLGEKPFKCVECGKSFSYSSLLSQHKRIHTGEKPYVCDRCGKAFRNSSGLTVHKRIHTGEKPYECDECGKAYISHSSLINHKSVHQGKQPYNCECGKSFNYRSVLDQHKRIHTGKKPYRCNECGKAFNIRSNLTKHKRTHTGEESLNVIYVGSYSGTSQKRTYEGGNALDGGRMRMPL

SEQ ID NO: 98396 - protein, 78 aa, Homo sapiens
  Payload ID: 19636
  Gene Name: ZFP62 zinc finger protein
  ENSP ID: ENSP00000424156
MPESKVGDTCVWDSKVENQQKKPVENRMKEDKSSIREAISKAKSTANIKTEQEGEASEKSLHLSPQHITHQTMPIGQR

SEQ ID NO: 98397 - protein, 867 aa, Homo sapiens
  Payload ID: 19636
  Gene Name: ZFP62 zinc finger protein
  Uniprot ID: Q8NB50
  ENSP ID: ENSP00000426193
MPESKVGDTCVWDSKVENQQKKPVENRMKEDKSSIREAISKAKSTANIKTEQEGEASEKSLHLSPQHITHQTMPIGQRGSEQGKRVENINGTSYPSLQQKTNAVKKLHKCDECGKSFKYNSRLVQHKIMHTGEKRYECDDCGGTFRSSSSLRVHKRIHTGEKPYKCEECGKAYMSYSSLINHKSTHSGEKNCKCDECGKSFNYSSVLDQHKRIHTGEKPYECGECGKAFRNSSGLRVHKRIHTGEKPYECDICGKTFSNSSGLRVHKRIHTGEKPYECDECGKAFITCRTLLNHKSIHFGDKPYKCDECEKSFNYSSLLIQHKVIHTGEKPYECDECGKAFRNSSGLIVHKRIHTGEKPYKCDVCGKAFSYSSGLAVHKSIHPGKKAHECKECGKSFSYNSLLLQHRTIHTGERPYVCDVCGKTFRNNAGLKVHRRLHTGEKPYKCDVCGKAYISRSSLKNHKGIHLGEKPYKCSYCEKSFNYSSALEQHKRIHTREKPFGCDECGKAFRNNSGLKVHKRIHTGERPYKCEECGKAYISLSSLINHKSVHPGEKPFKCDECEKAFITYRTLTNHKKVHLGEKPYKCDVCEKSFNYTSLLSQHRRVHTREKPYECDRCEKVFRNNSSLKVHKRIHTGERPYECDVCGKAYISHSSLINHKSTHPGRTPHTCDECGKAFFSSRTLISHKRVHLGEKPFKCVECGKSFSYSSLLSQHKRIHTGEKPYVCDRCGKAFRNSSGLTVHKRIHTGEKPYECDECGKAYISHSSLINHKSVHQGKQPYNCECGKSFNYRSVLDQHKRIHTGKKPYRCNECGKAFNIRSNLTKHKRTHTGEESLNVIYVGSYSGTSQKRTYEGGNALDGGRMRMPL

SEQ ID NO: 98398 - protein, 681 aa, Homo sapiens
  Payload ID: 19637
  Gene Name: ZFP64 zinc finger protein
  Uniprot ID: Q9NPA5
  ENSP ID: ENSP00000216923
MNASSEGESFAGSVQIPGGTTVLVELTPDIHICGICKQQFNNLDAFVAHKQSGCQLTGTSAAAPSTVQFVSEETVPATQTQTTTRTITSETQTITVSAPEFVFEHGYQTYLPTESNENQTATVISLPAKSRTKKPTTPPAQKRLNCCYPGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTGDAPFQCWLCSAKFKISSDLKRHMRVHSGEKPFKCEFCNVRCTMKGNLKSHIRIKHSGNNFKCPHCDFLGDSKATLRKHSRVHQSEHPEKCSECSYSCSSKAALRIHERIHCTDRPFKCNYCSFDTKQPSNLSKHMKKFHGDMVKTEALERKDTGRQSSRQVAKLDAKKSFHCDICDASFMREDSLRSHKRQHSEYSESKNSDVTVLQFQIDPSKQPATPLTVGHLQVPLQPSQVPQFSEGRVKIIVGHQVPQANTIVQAAAAAVNIVPPALVAQNPEELPGNSRLQILRQVSLIAPPQSSRCPSEAGAMTQPAVLLTTHEQTDGATLHQTLIPTASGGPQEGSGNQTFITSSGITCTDFEGLNALIQEGTAEVTVVSDGGQNIAVATTAPPVFSSSSQQELPKQTYSIIQGAAHPALLCPADSIPD

SEQ ID NO: 98399 - protein, 627 aa, Homo sapiens
  Payload ID: 19637
  Gene Name: ZFP64 zinc finger protein
  Uniprot ID: Q9NPA5
  ENSP ID: ENSP00000344615
MNASSEGESFAGSVQIPGGTTVLVELTPDIHICGICKQQFNNLDAFVAHKQSGCQLTGTSAAAPSTVQFVSEETVPATQTQTTTRTITSETQTITGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTGDAPFQCWLCSAKFKISSDLKRHMRVHSGEKPFKCEFCNVRCTMKGNLKSHIRIKHSGNNFKCPHCDFLGDSKATLRKHSRVHQSEHPEKCSECSYSCSSKAALRIHERIHCTDRPFKCNYCSFDTKQPSNLSKHMKKFHGDMVKTEALERKDTGRQSSRQVAKLDAKKSFHCDICDASFMREDSLRSHKRQHSEYSESKNSDVTVLQFQIDPSKQPATPLTVGHLQVPLQPSQVPQFSEGRVKIIVGHQVPQANTIVQAAAAAVNIVPPALVAQNPEELPGNSRLQILRQVSLIAPPQSSRCPSEAGAMTQPAVLLTTHEQTDGATLHQTLIPTASGGPQEGSGNQTFITSSGITCTDFEGLNALIQEGTAEVTVVSDGGQNIAVATTAPPVFSSSSQQELPKQTYSIIQGAAHPALLCPADSIPD

SEQ ID NO: 98400 - protein, 645 aa, Homo sapiens
  Payload ID: 19637
  Gene Name: ZFP64 zinc finger protein
  Uniprot ID: Q9NTW7
  ENSP ID: ENSP00000355179
MNASSEGESFAGSVQIPGGTTVLVELTPDIHICGICKQQFNNLDAFVAHKQSGCQLTGTSAAAPSTVQFVSEETVPATQTQTTTRTITSETQTITVSAPEFVFEHGYQTYLPTESNENQTATVISLPAKSRTKKPTTPPAQKRLNCCYPGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTASELDDDVPKANCLSTESTDTPKAPVITLPSEAREQMATLGERTFNCCYPGCHFKTVHGMKDLDRHLRIHTGDKPHKCEFCDKCFSRKDNLTMHMRCHTSVKPHKCHLCDYAAVDSSSLKKHLRIHSDERPYKCQLCPYASRNSSQLTVHLRSHTGDTPFQCWLCSAKFKISSDLKRHMIVHSGEKPFKCEFCDVRCTMKANLKSHIRIKHTFKCLHCAFQGRDRADLLEHSRLHQADHPEKCPECSYSCSSAAALRVHSRVHCKDRPFKCDFCSFDTKRPSSLAKHVDKVHRDEAKTENRAPLGKEGLREGSSQHVAKIVTQRAFRCETCGASFVRDDSLRCHKKQHSDQSENKNSDLVTFPPESGASGQLSTLVSVGQLEAPLEPSQDL

SEQ ID NO: 98401 - protein, 679 aa, Homo sapiens
  Payload ID: 19637
  Gene Name: ZFP64 zinc finger protein
  Uniprot ID: Q9NTW7
  ENSP ID: ENSP00000360570
MNASSEGESFAGSVQSGTTVLVELTPDIHICGICKQQFNNLDAFVAHKQSGCQLTGTSAAAPSTVQFVSEETVPATQTQTTTRTITSETQTITVSAPEFVFEHGYQTYLPTESNENQTATVISLPAKSRTKKPTTPPAQKRLNCCYPGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTGDAPFQCWLCSAKFKISSDLKRHMRVHSGEKPFKCEFCNVRCTMKGNLKSHIRIKHSGNNFKCPHCDFLGDSKATLRKHSRVHQSEHPEKCSECSYSCSSKAALRIHERIHCTDRPFKCNYCSFDTKQPSNLSKHMKKFHGDMVKTEALERKDTGRQSSRQVAKLDAKKSFHCDICDASFMREDSLRSHKRQHSEYSESKNSDVTVLQFQIDPSKQPATPLTVGHLQVPLQPSQVPQFSEGRVKIIVGHQVPQANTIVQAAAAAVNIVPPALVAQNPEELPGNSRLQILRQVSLIAPPQSSRCPSEAGAMTQPAVLLTTHEQTDGATLHQTLIPTASGGPQEGSGNQTFITSSGITCTDFEGLNALIQEGTAEVTVVSDGGQNIAVATTAPPVFSSSSQQELPKQTYSIIQGAAHPALLCPADSIPD

SEQ ID NO: 98402 - protein, 415 aa, Homo sapiens
  Payload ID: 19637
  Gene Name: ZFP64 zinc finger protein
  Uniprot ID: Q9NTW7
  ENSP ID: ENSP00000360573
MNASSEGESFAGSVQIPGGTTVLVELTPDIHICGICKQQFNNLDAFVAHKQSGCQLTGTSAAAPSTVQFVSEETVPATQTQTTTRTITSETQTITVSAPEFVFEHGYQTYLPTESNENQTATVISLPAKSRTKKPTTPPAQKRLNCCYPGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTASELDDDVPKANCLSTESTDTPKAPVITLPSEAREQMATLGERTFNCCYPGCHFKTVHGMKDLDRHLRIHTGDKPHKCEFCDKCFSRKDNLTMHMRCHTSVKPHKCHLCDYAAVDSSSLKKHLRIHSDERPYKCQLCPYASRNSSQLTVHLRSHTGCCYVA

SEQ ID NO: 98403 - protein, 426 aa, Homo sapiens
  Payload ID: 19637
  Gene Name: ZFP64 zinc finger protein
  Uniprot ID: Q9NTW7
  ENSP ID: ENSP00000360578
MSRRKQAKPQHLNSEEPRPARRECAEVAPQVAGEPASELDDDVPKANCLSTESTDTPKAPVITLPSEAREQMATLGERTFNCCYPGCHFKTVHGMKDLDRHLRIHTGDKPHKCEFCDKCFSRKDNLTMHMRCHTSVKPHKCHLCDYAAVDSSSLKKHLRIHSDERPYKCQLCPYASRNSSQLTVHLRSHTGDTPFQCWLCSAKFKISSDLKRHMIVHSGEKPFKCEFCDVRCTMKANLKSHIRIKHTFKCLHCAFQGRDRADLLEHSRLHQADHPEKCPECSYSCSSAAALRVHSRVHCKDRPFKCDFCSFDTKRPSSLAKHVDKVHRDEAKTENRAPLGKEGLREGSSQHVAKIVTQRAFRCETCGASFVRDDSLRCHKKQHSDQSENKNSDLVTFPPESGASGQLSTLVSVGQLEAPLEPSQDL

SEQ ID NO: 98404 - protein, 131 aa, Homo sapiens
  Payload ID: 19637
  Gene Name: ZFP64 zinc finger protein
  ENSP ID: ENSP00000379303
MRGHPSLRPPWHWASAARLEGGFLPWGYVSNALSREGLTEERTFERRPEGWEGASCAASELDDDVPKANCLSTESTDTPKAPVITLPSEAREQMATLGERTFNCCYPGCHFKTVHGMKDLDRHLRIHTASC

SEQ ID NO: 98405 - protein, 221 aa, Homo sapiens
  Payload ID: 19637
  Gene Name: ZFP64 zinc finger protein
  ENSP ID: ENSP00000379312
MRGHPSLRPPWHWASAARLEGGFLPWGYVSNALSREGLTEERTFERRPEGWEGASCAASELDDDVPKANCLSTESTDTPKAPVITLPSEAREQMATLGERTFNCCYPGCHFKTVHGMKDLDRHLRIHTGDKPHKCEFCDKCFSRKDNLTMHMRCHTSVKPHKCHLCDYAAVDSSSLKKHLRIHSDERPYKCQLCPYASRNSSQLTVHLRSHTGDTPFQCWL

SEQ ID NO: 98406 - protein, 120 aa, Homo sapiens
  Payload ID: 19637
  Gene Name: ZFP64 zinc finger protein
  ENSP ID: ENSP00000403424
  MOD_RES (1)..(1): Any amino acid
XERTFNCCYPGCHFKTVHGMKDLDRHLRIHTGDKPHKCEFCDKCFSRKDNLTMHMRCHTSVKPHKCHLCDYAAVDSSSLKKHLRIHSDERPYKCQLCPYASRNSSQLTVHLRSHTGPGPG

SEQ ID NO: 98407 - protein, 526 aa, Homo sapiens
  Payload ID: 19638
  Gene Name: ZFP69 zinc finger protein
  Uniprot ID: Q49AA0
  ENSP ID: ENSP00000361790
MPQQLLITLPTEASTWVKLQHPKKAVEGAPLWEDVTKMFEGEALLSQDAEDVKTQRESLEDEVTPGLPTAESQELLTFKDISIDFTQEEWGQLAPAHQNLYREVMLENYSNLVSVGYQLSKPSVISQLEKGEEPWMAEKEGPGDPSSDLKSKIETIESTAKSTISQERLYHGIMMESFMRDDIIYSTLRKVSTYDDVLERHQETCMRDVRQAILTHKKRVQETNKFGENIIVHSNVIIEQRHHKYDTPTKRNTYKLDLINHPTSYIRTKTYECNICEKIFKQPIHLTEHMRIHTGEKPFRCKECGRAFSQSASLSTHQRIHTGEKPFECEECGKAFRHRSSLNQHHRTHTGEKPYVCDKCQKAFSQNISLVQHLRTHSGEKPFTCNECGKTFRQIRHLSEHIRIHTGEKPYACTACCKTFSHRAYLTHHQRIHTGERPYKCKECGKAFRQRIHLSNHKTVHTGVKAYECNRCGKAYRHDSSFKKHQRHHTGEKPYECNECGKAFSYNSSLSRHHEIHRRNAFRNKV

SEQ ID NO: 98408 - protein, 526 aa, Homo sapiens; identical to SEQ ID NO: 98407
  Payload ID: 19638
  Gene Name: ZFP69 zinc finger protein
  Uniprot ID: Q49AA0
  ENSP ID: ENSP00000361791

SEQ ID NO: 98409 - protein, 534 aa, Homo sapiens
  Payload ID: 19639
  Gene Name: ZFP69 zinc finger protein B
  Uniprot ID: Q9UJL9
  ENSP ID: ENSP00000354547
MLQQLLITLPTEASTWVKLRHPKAATERVALWEDVTKMFKAEALLSQDADETQGESLESRVTLGSLTAESQELLTFKDVSVDFTQEEWGQLAPAHRNLYREVMLENYGNLVSVGCQLSKPGVISQLEKGEEPWLMERDISGVPSSDLKSKTKTKESALQNDISWEELHCGLMMERFTKGSSMYSTLGRISKCNKLESQQENQRMGKGQIPLMCKKTFTQERGQESNRFEKRINVKSEVMPGPIGLPRKRDRKYDTPGKRSRYNIDLVNHSRSYTKMKTFECNICEKIFKQLIHLTEHMRIHTGEKPFRCKECGKAFSQSSSLIPHQRIHTGEKPYECKECGKTFRHPSSLTQHVRIHTGEKPYECRVCEKAFSQSIGLIQHLRTHVREKPFTCKDCGKAFFQIRHLRQHEIIHTGVKPYICNVCSKTFSHSTYLTQHQRTHTGERPYKCKECGKAFSQRIHLSIHQRVHTGVKPYECSHCGKAFRHDSSFAKHQRIHTGEKPYDCNECGKAFSCSSSLIRHCKTHLRNTFSNVV

SEQ ID NO: 98410 - protein, 534 aa, Homo sapiens; identical to SEQ ID NO: 98409
  Payload ID: 19639
  Gene Name: ZFP69 zinc finger protein B
  Uniprot ID: Q9UJL9
  ENSP ID: ENSP00000399664

SEQ ID NO: 98411 - protein, 131 aa, Homo sapiens
  Payload ID: 19639
  Gene Name: ZFP69 zinc finger protein B
  ENSP ID: ENSP00000435907
MLQQLLITLPTEASTWVKLRHPKAATERVALWEDVTKMFKAEGTVNLQGRICGLHSGGVGAAGPCSPESVPGGDAGELWEPGLSGMSAFQTWRDFPVGERRRTMADGERYFRSSKFRLEEQNKNQRVSLTE

SEQ ID NO: 98412 - protein, 532 aa, Homo sapiens
  Payload ID: 19640
  Gene Name: ZFP82 zinc finger protein
  Uniprot ID: Q8N141
  ENSP ID: ENSP00000431265
MALRSVMFSDVSIDFSPEEWEYLDLEQKDLYRDVMLENYSNLVSLGCFISKPDVISSLEQGKEPWKVVRKGRRQYPDLETKYETKKLSLENDIYEINLSQWKIMERIENHGLKGLILKNDWESTGKIEGQERPQEGYFSSVKMPSEKVSSYQKRTSVTPHQRLHFVDKPYECKECGKAFRVRQQLTFHHRIHTGEKPYECKECGMAFRQTAHLTRHQRLHSGEKLYECKECGEAFICGADLRVHQKMHIGEKPYECKECGKAFRVRGQLTLHQRIHTGEKPYVCKECGKAFRQYAHLTRHQKLNSADRLYECKECGKAFLCGSGLRVHHKLHTGEKPYECKECGKAFRVRQQLTLHQRIHTGEKPYECKECGKTFSRGYHLILHHRIHTGEKPYECKECWKAFSRYSQLISHQSIHIGVKPYDCKECGKAFRLLSQLTQHQSIHIGEKPYKCKECGKAFRLRQKLTLHQSIHTGEKPFECKECRKAFRLNSSLIQHLRIHSGEKPYECKECKKAFRQHSHLTHHLKIHNVKI

SEQ ID NO: 98413 - protein, 49 aa, Homo sapiens
  Payload ID: 19640
  Gene Name: ZFP82 zinc finger protein
  ENSP ID: ENSP00000468212
  MOD_RES (1)..(1): Any amino acid
XEPWKVVRKGRRQYPDAAITKRTSKMKMSALWQMYDYWYGEESNSHHAL

SEQ ID NO: 98414 - protein, 636 aa, Homo sapiens
  Payload ID: 19641
  Gene Name: ZFP90 zinc finger protein
  Uniprot ID: Q8TF47
  ENSP ID: ENSP00000381304
MAPRPPTAAPQESVTFKDVSVDFTQEEWYHVDPAQRSLYRDVMLENYSHLVSLGYQVSKPEVIFKLEQGEEPWISEGEIQRPFYPDWKTRPEVKSSHLQQDVSEVSHCTHDLLHATLEDSWDVSSQLDRQQENWKRHLGSEASTQKKIITPQENFEQNKFGENSRLNTNLVTQLNIPARIRPSECETLGSNLGHNADLLNENNILAKKKPYKCDKCRKAFIHRSSLTKHEKTHKGEGAFPNGTDQGIYPGKKHHECTDCGKTFLWKTQLTEHQRIHTGEKPFECNVCGKAFRHSSSLGQHENAHTGEKPYQCSLCGKAFQRSSSLVQHQRIHTGEKPYRCNLCGRSFRHGTSLTQHEVTHSGEKPFQCKECGKAFSRCSSLVQHERTHTGEKPFECSICGRAFGQSPSLYKHMRIHKRGKPYQSSNYSIDFKHSTSLTQDESTLTEVKSYHCNDCGEDFSHITDFTDHQRIHTAENPYDCEQAFSQQAISHPGEKPYQCNVCGKAFKRSTSFIEHHRIHTGEKPYECNECGEAFSRRSSLTQHERTHTGEKPYECIDCGKAFSQSSSLIQHERTHTGEKPYECNECGRAFRKKTNLHDHQRIHTGEKPYSCKECGKNFSRSSALTKHQRIHTRNKL

SEQ ID NO: 98415 - protein, 60 aa, Homo sapiens
  Payload ID: 19641
  Gene Name: ZFP90 zinc finger protein
  ENSP ID: ENSP00000454391
MAPRPPTAAPQESVTFKDVSVDFTQEEWYHVDPAQRSLYRDVMLENYSHLVSLEFLRIKD

SEQ ID NO: 98416 - protein, 636 aa, Homo sapiens; identical to SEQ ID NO: 98414
  Payload ID: 19641
  Gene Name: ZFP90 zinc finger protein
  Uniprot ID: Q8TF47
  ENSP ID: ENSP00000454418

SEQ ID NO: 98417 - protein, 60 aa, Homo sapiens; identical to SEQ ID NO: 98415
  Payload ID: 19641
  Gene Name: ZFP90 zinc finger protein
  ENSP ID: ENSP00000457129

SEQ ID NO: 98418 - protein, 103 aa, Homo sapiens
  Payload ID: 19641
  Gene Name: ZFP90 zinc finger protein
  ENSP ID: ENSP00000458051
MAPRPPTAAPQESVTFKDVSVDFTQEEWYHVDPAQRSLYRDVMLENYSHLVSLGYQVSKPEVIFKLEQGEEPWISEGEIQRPFYPDWKTRPEVKSSHLQQDVS

SEQ ID NO: 98419 - protein, 60 aa, Homo sapiens; identical to SEQ ID NO: 98415
  Payload ID: 19641
  Gene Name: ZFP90 zinc finger protein
  ENSP ID: ENSP00000458276

SEQ ID NO: 98420 - protein, 33 aa, Homo sapiens
  Payload ID: 19641
  Gene Name: ZFP90 zinc finger protein
  ENSP ID: ENSP00000458323
MAPRPPTAAPQEEWYHVDPAQRSLYRDVMLENY

SEQ ID NO: 98421 - protein, 102 aa, Homo sapiens
  Payload ID: 19641
  Gene Name: ZFP90 zinc finger protein
  ENSP ID: ENSP00000458410
ESVTFKDVSVDFTQEEWYHVDPAQRSLYRDVMLENYSHLVSLGYQVSKPEVIFKLEQGEEPWISEGEIQRPFYPGFVCLLPLSLPSGSKGERRQKLPRKNPE

SEQ ID NO: 98422 - protein, 45 aa, Homo sapiens
  Payload ID: 19641
  Gene Name: ZFP90 zinc finger protein
  ENSP ID: ENSP00000458920
MAPRPPTAAPQESVTFKDVSVDFTQEEWYHVDPAQRSLYRDVMLE

SEQ ID NO: 98423 - protein, 52 aa, Homo sapiens
  Payload ID: 19641
  Gene Name: ZFP90 zinc finger protein
  ENSP ID: ENSP00000459846
GPEASDRRAPGGTYLLGPGTEPTLKCSLPLPIFCALSACSTSPYCVLSHIVL

SEQ ID NO: 98424 - protein, 103 aa, Homo sapiens; identical to SEQ ID NO: 98418
  Payload ID: 19641
  Gene Name: ZFP90 zinc finger protein
  ENSP ID: ENSP00000459944

SEQ ID NO: 98425 - protein, 636 aa, Homo sapiens; identical to SEQ ID NO: 98414
  Payload ID: 19641
  Gene Name: ZFP90 zinc finger protein
  Uniprot ID: Q8TF47
  ENSP ID: ENSP00000460547

SEQ ID NO: 98426 - protein, 47 aa, Homo sapiens
  Payload ID: 19641
  Gene Name: ZFP90 zinc finger protein
  ENSP ID: ENSP00000460560
MAPRPPTAAPQESVTFKDVSVDFTQEEWYHVDPAQRSLYRDVMLENY

SEQ ID NO: 98427 - protein, 60 aa, Homo sapiens; identical to SEQ ID NO: 98415
  Payload ID: 19641
  Gene Name: ZFP90 zinc finger protein
  ENSP ID: ENSP00000460982

SEQ ID NO: 98428 - protein, 93 aa, Homo sapiens
  Payload ID: 19641
  Gene Name: ZFP90 zinc finger protein
  ENSP ID: ENSP00000463193
MAPRPPTAAPQESVTFKDVSVDFTQEEWYHVDPAQRSLYRDVMLENYSHLVSLGYQVSKPEVIFKLEQGEEPWISEGEIQRPFYPAVYFNRKE

SEQ ID NO: 98429 - protein, 113 aa, Homo sapiens
  Payload ID: 19641
  Gene Name: ZFP90 zinc finger protein
  Uniprot ID: Q8TF47
  ENSP ID: ENSP00000480309
MAPRPPTAAPQESVTFKDVSVDFTQEEWYHVDPAQRSLYRDVMLENYSHLVSLGYQVSKPEVIFKLEQGEEPWISEGEIQRPFYPGFVCLLPLSLPSGSKGERRQKLPRKNPE

SEQ ID NO: 98430 - protein, 570 aa, Homo sapiens
  Payload ID: 19642
  Gene Name: ZFP91 zinc finger protein
  Uniprot ID: Q96JP5
  ENSP ID: ENSP00000339030
MPGETEEPRPPEQQDQEGGEAAKAAPEEPQQRPPEAVAAAPAGTTSSRVLRGGRDRGRAAAAAAAAAVSRRRKAEYPRRRRSSPSARPPDVPGQQPQAAKSPSPVQGKKSPRLLCIEKVTTDKDPKEEKEEEDDSALPQEVSIAASRPSRGWRSSRTSVSRHRDTENTRSSRSKTGSLQLICKSEPNTDQLDYDVGEEHQSPGGISSEEEEEEEEEMLISEEEIPFKDDPRDETYKPHLERETPKPRRKSGKVKEEKEKKEIKVEVEVEVKEEENEIREDEEPPRKRGRRRKDDKSPRLPKRRKKPPIQYVRCEMEGCGTVLAHPRYLQHHIKYQHLLKKKYVCPHPSCGRLFRLQKQLLRHAKHHTDQRDYICEYCARAFKSSHNLAVHRMIHTGEKPLQCEICGFTCRQKASLNWHMKKHDADSFYQFSCNICGKKFEKKDSVVAHKAKSHPEVLIAEALAANAGALITSTDILGTNPESLTQPSDGQGLPLLPEPLGNSTSGECLLLEAEGMSKSYCSGTERVSLMADGKIFVGSGSSGGTEGLVMNSDILGATTEVLIEDSDSAGP

SEQ ID NO: 98431 - protein, 529 aa, Homo sapiens
  Payload ID: 19643
  Gene Name: ZFP91-CNTF readthrough (NMD candidate)
  ENSP ID: ENSP00000455911
MPGETEEPRPPEQQDQEGGEAAKAAPEEPQQRPPEAVAAAPAGTTSSRVLRGGRDRGRAAAAAAAAAVSRRRKAEYPRRRRSSPSARPPDVPGQQPQAAKSPSPVQGKKSPRLLCIEKVTTDKDPKEEKEEEDDSALPQEVSIAASRPSRGWRSSRTSVSRHRDTENTRSSRSKTGSLQLICKSEPNTDQLDYDVGEEHQSPGGISSEEEEEEEEEMLISEEEIPFKDDPRDETYKPHLERETPKPRRKSGKVKEEKEKKEIKVEVEVEVKEEENEIREDEEPPRKRGRRRKDDKSPRLPKRRKKPPIQYVRCEMEGCGTVLAHPRYLQHHIKYQHLLKKKYVCPHPSCGRLFRLQKQLLRHAKHHTDQRDYICEYCARAFKSSHNLAVHRMIHTGEKPLQCEICGFTCRQKASLNWHMKKHDADSFYQFSCNICGKKFEKKDSVVAHKAKSHPEVLIAEALAANAGALITSTDILGTNPESLTQPSDGQGLPLLPEPLGNSTSGECLLLEAEGMSKSYCSGTERSIHR

SEQ ID NO: 98432 - protein, 354 aa, Homo sapiens
  Payload ID: 19643
  Gene Name: ZFP91-CNTF readthrough (NMD candidate)
  ENSP ID: ENSP00000457288
KTGSLQLICKSEPNTDQLDYDVGEEHQSPGGISSEEEEEEEEEMLISEEEIPFKDDPRDETYKPHLERETPKPRRKSGKVKEEKEKKEIKVEVEVEVKEEENEIREDEEPPRKRGRRRKDDKSPRLPKRRKKPPIQYVRCEMEGCGTVLAHPRYLQHHIKYQHLLKKKYVCPHPSCGRLFRLQKQLLRHAKHHTDQRDYICEYCARAFKSSHNLAVHRMIHTGEKPLQCEICGFTCRQKASLNWHMKKHDADSFYQFSCNICGKKFEKKDSVVAHKAKSHPEVLIAEALAANAGALITSTDILGTNPESLTQPSDGQGLPLLPEPLGNSTSGECLLLEAEGMSKSYCSGTERLS

SEQ ID NO: 98433 - protein, 416 aa, Homo sapiens
  Payload ID: 19644
  Gene Name: ZFP92 zinc finger protein
  Uniprot ID: A6NM28
  ENSP ID: ENSP00000462054
MAAILLTTRPKVPVSFEDVSVYFTKTEWKLLDLRQKVLYKRVMLENYSHLVSLGFSFSKPHLISQLERGEGPWVADIPRTWATAGLHIGDRTQSKTSTSTQKHSGRQLPGADPQGGKEGQAARSSVLQRGAQGLGQSSAAGPQGPKGAEKRYLCQQCGKAFSRSSNLIKHRIIHSGEKPYACPECGKLFRRSFALLEHQRIHSGEKPYACPECSKTFTRSSNLIKHQVIHSGERPFACGDCGKLFRRSFALLEHARVHSGERPYACPECGKAFSRSSNLIEHQRTHRGEKPYACGQCAKAFKGVSQLIHHQRSHSGERPFACRECGKAFRGRSGLSQHRRVHSGEKPYECSDCGKAFGRRANLFKHQAVHGARRPAKAETARRLAGPGSTGPGSAVAATSPPRPSTAARPSRPSRR

SEQ ID NO: 98434 - protein, 292 aa, Homo sapiens
  Payload ID: 19645
  Gene Name: ZHX1-C8orf76 readthrough
  Uniprot ID: Q96EF9
  ENSP ID: ENSP00000349593
MLRKLWQWFYEETESSDDVEVLTLKKFKGDLAYRRQEYQKALQEYSSISEKLSSTNFAMKRDVQEGQARCLAHLGRHMEALEIAANLENKATNTDHLTTVLYLQLAICSSLQNLEKTIFCLQKLISLHPFNPWNWGKLAEAYLNLGPALSAALASSQKQHSFTSSDKTIKSFFPHSGKDCLLCFPETLPESSLFSVEANSSNSQKNEKALTNIQNCMAEKRETVLIETQLKACASFIRTRLLLQFTQPQQTSFALERNLRTQQEIEDKMKGFSFKEDTLLLIAEVSVSLGFM

SEQ ID NO: 98435 - protein, 140 aa, Homo sapiens
  Payload ID: 19645
  Gene Name: ZHX1-C8orf76 readthrough
  Uniprot ID: Q96EF9
  ENSP ID: ENSP00000481928
MLRKLWQWFYEETESSDDVEVLTLKKFKGDLAYRRQEYQKALQEYSSISEKLSSTNFAMKRDVQEGQARCLAHLGRHMEALEIAANLENKATNTDHLTTVLYLQLAICSSLQNLEKTIFCLQKLISLHPFNPWNWGKLAE

SEQ ID NO: 98436 - protein, 447 aa, Homo sapiens
  Payload ID: 19646
  Gene Name: Zic family member 1
  Uniprot ID: Q15915
  ENSP ID: ENSP00000282928
MLLDAGPQYPAIGVTTFGASRHHSAGDVAERDVGLGINPFADGMGAFKLNPSSHELASAGQTAFTSQAPGYAAAAALGHHHHPGHVGSYSSAAFNSTRDFLFRNRGFGDAAAAASAQHSLFAASAGGFGGPHGHTDAAGHLLFPGLHEQAAGHASPNVVNGQMRLGFSGDMYPRPEQYGQVTSPRSEHYAAPQLHGYGPMNVNMAAHHGAGAFFRYMRQPIKQELICKWIEPEQLANPKKSCNKTFSTMHELVTHVTVEHVGGPEQSNHICFWEECPREGKPFKAKYKLVNHIRVHTGEKPFPCPFPGCGKVFARSENLKIHKRTHTGEKPFKCEFEGCDRRFANSSDRKKHMHVHTSDKPYLCKMCDKSYTHPSSLRKHMKVHESSSQGSQPSPAASSGYESSTPPTIVSPSTDNPTTSSLSPSSSAVHHTAGHSALSSNFNEWYV

SEQ ID NO: 98437 - protein, 136 aa, Homo sapiens
  Payload ID: 19646
  Gene Name: Zic family member 1
  ENSP ID: ENSP00000419664
  MOD_RES (1)..(1): Any amino acid
XPFGADSRLQSQAPDSGEKPFKCEFEGCDRRFANSSDRKKHMHVHTSDKPYLCKMCDKSYTHPSSLRKHMKVHESSSQGSQPSPAASSGYESSTPPTIVSPSTDNPTTSSLSPSSSAVHHTAGHSALSSNFNEWYV

SEQ ID NO: 98438 - protein, 532 aa, Homo sapiens
  Payload ID: 19647
  Gene Name: Zic family member 2
  Uniprot ID: O95409
  ENSP ID: ENSP00000365514
MLLDAGPQFPAIGVGSFARHHHHSAAAAAAAAAEMQDRELSLAAAQNGFVDSAAAHMGAFKLNPGAHELSPGQSSAFTSQGPGAYPGSAAAAAAAAALGPHAAHVGSYSGPPFNSTRDFLFRSRGFGDSAPGGGQHGLFGPGAGGLHHAHSDAQGHLLFPGLPEQHGPHGSQNVLNGQMRLGLPGEVFGRSEQYRQVASPRTDPYSAAQLHNQYGPMNMNMGMNMAAAAAHHHHHHHHHPGAFFRYMRQQCIKQELICKWIDPEQLSNPKKSCNKTFSTMHELVTHVSVEHVGGPEQSNHVCFWEECPREGKPFKAKYKLVNHIRVHTGEKPFPCPFPGCGKVFARSENLKIHKRTHTGEKPFQCEFEGCDRRFANSSDRKKHMHVHTSDKPYLCKMCDKSYTHPSSLRKHMKVHESSPQGSESSPAASSGYESSTPPGLVSPSAEPQSSSNLSPAAAAAAAAAAAAAAAVSAVHRGGGSGSGGAGGGSGGGSGSGGGGGGAGGGGGGSSGGGSGTAGGHSGLSSNFNEWYV

SEQ ID NO: 98439 - protein, 531 aa, Homo sapiens
  Payload ID: 19647
  Gene Name: Zic family member 2
  ENSP ID: ENSP00000481510
MLLDAGPQFPAIGVGSFARHHHHSAAAAAAAAAEMQDRELSLAAAQNGFVDSAAAHMGAFKLNPGAHELSPGQSSAFTSQGPGAYPGSAAAAAAAAALGPHAAHVGSYSGPPFNSTRDFLFRSAASGTAPGGGQHGLFGPGAGGLHHAHSDAQGHLLFPGLPEQHGPHGSQNVLNGQMRLGLPGEVFGRSEQYRQVASPRTDPYSAAQLHNQYGPMNMNMGMNMAAAAAHHHHHHHHHPGAFFRYMRQQCIKQELICKWIDPEQLSNPKKSCNKTFSTMHELVTHVSVEHVGGPEQSNHVCFWEECPREGKPFKAKYKLVNHIRVHTGEKPFPCPFPGCGKVFARSENLKIHKRTHTGEKPFQCEFEGCDRRFANSSDRKKHMHVHTSDKPYLCKMCDKSYTHPSSLRKHMKVHESSPQGSESSPAASSGYESSTPPGLVSPSAEPQSSSNLSPAAAAAAAAAAAAAAAVSAVHRGGGSGSGGAGGGSGGGSGSGGGGGGAGGGGGGSSGGGSGTAGGHSGLSSNFNEWYV

SEQ ID NO: 98440 - protein, 467 aa, Homo sapiens
  Payload ID: 19648
  Gene Name: Zic family member 3
  Uniprot ID: O60481
  ENSP ID: ENSP00000287538
MTMLLDGGPQFPGLGVGSFGAPRHHEMPNREPAGMGLNPFGDSTHAAAAAAAAAAFKLSPAAAHDLSSGQSSAFTPQGSGYANALGHHHHHHHHHHHTSQVPSYGGAASAAFNSTREFLFRQRSSGLSEAASGGGQHGLFAGSASSLHAPAGIPEPPSYLLFPGLHEQGAGHPSPTGHVDNNQVHLGLRGELFGRADPYRPVASPRTDPYAAGAQFPNYSPMNMNMGVNVAAHHGPGAFFRYMRQPIKQELSCKWIDEAQLSRPKKSCDRTFSTMHELVTHVTMEHVGGPEQNNHVCYWEECPREGKSFKAKYKLVNHIRVHTGEKPFPCPFPGCGKIFARSENLKIHKRTHTGEKPFKCEFEGCDRRFANSSDRKKHMHVHTSDKPYICKVCDKSYTHPSSLRKHMKVHESQGSDSSPAASSGYESSTPPAIASANSKDTTKTPSAVQTSTSHNPGLPPNFNEWYV

SEQ ID NO: 98441 - protein, 457 aa, Homo sapiens
  Payload ID: 19648
  Gene Name: Zic family member 3
  Uniprot ID: O60481
  ENSP ID: ENSP00000359638
MTMLLDGGPQFPGLGVGSFGAPRHHEMPNREPAGMGLNPFGDSTHAAAAAAAAAAFKLSPAAAHDLSSGQSSAFTPQGSGYANALGHHHHHHHHHHHTSQVPSYGGAASAAFNSTREFLFRQRSSGLSEAASGGGQHGLFAGSASSLHAPAGIPEPPSYLLFPGLHEQGAGHPSPTGHVDNNQVHLGLRGELFGRADPYRPVASPRTDPYAAGAQFPNYSPMNMNMGVNVAAHHGPGAFFRYMRQPIKQELSCKWIDEAQLSRPKKSCDRTFSTMHELVTHVTMEHVGGPEQNNHVCYWEECPREGKSFKAKYKLVNHIRVHTGEKPFPCPFPGCGKIFARSENLKIHKRTHTGEKPFKCEFEGCDRRFANSSDRKKHMHVHTSDKPYICKVCDKSYTHPSSLRKHMKCCPAWYPGQSLIPDEELDTDVGMQQPALHNTTYPKCRVNAEPTVQEMIY

SEQ ID NO: 98442 - protein, 334 aa, Homo sapiens
  Payload ID: 19649
  Gene Name: Zic family member 4
  Uniprot ID: Q8N9L1
  ENSP ID: ENSP00000372553
MRYKTSLVMRKRLRLYRNTLKESSSSSGHHGPQLTAASSPSVFPGLHEEPPQASPSRPLNGLLRLGLPGDMYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHTGEKPFRCEFEGCERRFANSSDRKKHSHVHTSDKPYTCKVRGCDKCYTHPSSLRKHMKVHGRSPPPSSGYDSATPSALVSPSSDCGHKSQVASSAAVAARTADLSE

SEQ ID NO: 98443 - protein, 372 aa, Homo sapiens
  Payload ID: 19649
  Gene Name: Zic family member 4
  Uniprot ID: Q8N9L1
  ENSP ID: ENSP00000397695
MNGPCQSLRKAEGLLEGCTSAVTVFRKLPLDSKAQSQKMRYKTSLVMRKRLRLYRNTLKESSSSSGHHGPQLTAASSPSVFPGLHEEPPQASPSRPLNGLLRLGLPGDMYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHTGEKPFRCEFEGCERRFANSSDRKKHSHVHTSDKPYTCKVRGCDKCYTHPSSLRKHMKVHGRSPPPSSGYDSATPSALVSPSSDCGHKSQVASSAAVAARTADLSE

SEQ ID NO: 98444 - protein, 334 aa, Homo sapiens; identical to SEQ ID NO: 98442
  Payload ID: 19649
  Gene Name: Zic family member 4
  Uniprot ID: Q8N9L1
  ENSP ID: ENSP00000417855

SEQ ID NO: 98445 - protein, 128 aa, Homo sapiens
  Payload ID: 19649
  Gene Name: Zic family member 4
  Uniprot ID: Q8N9L1
  ENSP ID: ENSP00000418277
MRYKTSLVMRKRLRLYRNTLKESSEKPFRCEFEGCERRFANSSDRKKHSHVHTSDKPYTCKVRGCDKCYTHPSSLRKHMKVHGRSPPPSSGYDSATPSALVSPSSDCGHKSQVASSAAVAARTADLSE

SEQ ID NO: 98446 - protein, 77 aa, Homo sapiens
  Payload ID: 19649
  Gene Name: Zic family member 4
  ENSP ID: ENSP00000418343
MRYKTSLVMRKRLRLYRNTLKESSSSSGHHGPQLTAASSPSVFPGLHEEPPQASPSRPLNGLLRLGLPGDMYARPEP

SEQ ID NO: 98447 - protein, 68 aa, Homo sapiens
  Payload ID: 19649
  Gene Name: Zic family member 4
  ENSP ID: ENSP00000419727
MRYKTSLVMRKRLRLYRNTLKESSSSSGHHGPQLTAASSPSVFPGLHEEPPQASPSRPLNGLLRLGLP

SEQ ID NO: 98448 - protein, 229 aa, Homo sapiens
  Payload ID: 19649
  Gene Name: Zic family member 4
  ENSP ID: ENSP00000420627
MRYKTSLVMRKRLRLYRNTLKESSSSSGHHGPQLTAASSPSVFPGLHEEPPQASPSRPLNGLLRLGLPGDMYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHT

SEQ ID NO: 98449 - protein, 334 aa, Homo sapiens; identical to SEQ ID NO: 98442
  Payload ID: 19649
  Gene Name: Zic family member 4
  Uniprot ID: Q8N9L1
  ENSP ID: ENSP00000420775

SEQ ID NO: 98450 - protein, 384 aa, Homo sapiens
  Payload ID: 19649
  Gene Name: Zic family member 4
  Uniprot ID: Q8N9L1
  ENSP ID: ENSP00000435509
MPPFCRNAKLGLLSFLICAGRSLLPLGKNAFWLERIENNNTLWEKAQSQKMRYKTSLVMRKRLRLYRNTLKESSSSSGHHGPQLTAASSPSVFPGLHEEPPQASPSRPLNGLLRLGLPGDMYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHTGEKPFRCEFEGCERRFANSSDRKKHSHVHTSDKPYTCKVRGCDKCYTHPSSLRKHMKVHGRSPPPSSGYDSATPSALVSPSSDCGHKSQVASSAAVAARTADLSE

SEQ ID NO: 98451 - protein, 663 aa, Homo sapiens
  Payload ID: 19650
  Gene Name: Zic family member 5
  Uniprot ID: Q96T25
  ENSP ID: ENSP00000267294
MFLKAGRGNKVPPVRVYGPDCVVLMEPPLSKRNPPALRLADLATAQVQPLQNMTGFPALAGPPAHSQLRAAVAHLRLRDLGADPGVATTPLGPEHMAQASTLGLSPPSQAFPAHPEAPAAAARAAALVAHPGAGSYPCGGGSSGAQPSAPPPPAPPLPPTPSPPPPPPPPPPPALSGYTTTNSGGGGSSGKGHSRDFVLRRDLSATAPAAAMHGAPLGGEQRSGTGSPQHPAPPPHSAGMFISASGTYAGPDGSGGPALFPALHDTPGAPGGHPHPLNGQMRLGLAAAAAAAAAELYGRAEPPFAPRSGDAHYGAVAAAAAAALHGYGAVNLNLNLAAAAAAAAAGPGPHLQHHAPPPAPPPPPAPAQHPHQHHPHLPGAAGAFLRYMRQPIKQELICKWIDPDELAGLPPPPPPPPPPPPPPPAGGAKPCSKTFGTMHELVNHVTVEHVGGPEQSSHVCFWEDCPREGKPFKAKYKLINHIRVHTGEKPFPCPFPGCGKVFARSENLKIHKRTHTGEKPFKCEFDGCDRKFANSSDRKKHSHVHTSDKPYYCKIRGCDKSYTHPSSLRKHMKIHCKSPPPSPGPLGYSSVGTPVGAPLSPVLDPARSHSSTLSPQVTNLNEWYVCQASGAPSHLHTPSSNGTTSETEDEEIYGNPEVVRTIH

SEQ ID NO: 98452 - protein, 412 aa, Homo sapiens
  Payload ID: 19651
  Gene Name: zinc activated ligand-gated ion channel
  Uniprot ID: Q401N2
  ENSP ID: ENSP00000334854
MMALWSLLHLTFLGFSITLLLVHGQGFQGTAAIWPSLFNVNLSKKVQESIQIPNNGSAPLLVDVRVFVSNVFNVDILRYTMSSMLLLRLSWLDTRLAWNTSAHPRHAITLPWESLWTPRLTILEALWVDWRDQSPQARVDQDGHVKLNLALATETNCNFELLHFPRDHSNCSLSFYALSNTAMELEFQAHVVNEIVSVKREYVVYDLKTQVPPQQLVPCFQVTLRLKNTALKSIIALLVPAEALLLADVCGGLLPLRAIERIGYKVTLLLSYLVLHSSLVQALPSSSSCNPLLIYYFTILLLLLFLSTIETVLLAGLLARGNLGAKSGPSPAPRGEQREHGNPGPHPAEEPSRGVKGSQRSWPETADRIFFLVYVVGVLCTQFVFAGIWMWAACKSDAAPGEAAPHGRRPRL

SEQ ID NO: 98453 - protein, 126 aa, Homo sapiens
  Payload ID: 19651
  Gene Name: zinc activated ligand-gated ion channel
  Uniprot ID: Q401N2
  ENSP ID: ENSP00000391936
MMALWSLLHLTFLGFSITLLLVHGQGFQGTAAIWPSLFNVNLSKKVQESIQIPNNGSAPLLVDVRVFVSNVFNVSSVLPRATALHSHGDCSGSAPCSKARGSGCHGLTPGNHLKVQPPCINPSGDI

SEQ ID NO: 98454 - protein, 266 aa, Homo sapiens
  Payload ID: 19651
  Gene Name: zinc activated ligand-gated ion channel
  Uniprot ID: Q401N2
  ENSP ID: ENSP00000397489
MMALWSLLHLTFLGFSITLLLVHGQGFQGTAAIWPSLFNVNLSKKVQESIQIPNNGSAPLLVDVRVFVSNVFNVDILRYTMSSMLLLRLSWLDTRLAWNTSAHPRHAITLPWESLWTPRLTILEALWVDWRDQSPQARVDQDGHVKLNLALATETNCNFELLHFPRDHSNCSLSFYALSNTGADRAGAAGLRRGGGRWGRGTPRSVVQGQGAGQGEGAKADRRRTPRSVFRAVYPRLRRAAPALPLRPPLEWQPISVLSGSLRAPL

SEQ ID NO: 98455 - protein, 278 aa, Homo sapiens
  Payload ID: 19652
  Gene Name: zinc and ring finger 1, E3 ubiquitin protein ligase
  Uniprot ID: Q8ND25
  ENSP ID: ENSP00000323362
MGGKQSTAARSRGPFPGVSTDDSAVPPPGGAPHFGHYRTGGGAMGLRSRSVSSVAGMGMDPSTAGGVPFGLYTPASRGTGDSERAPGGGGSASDSTYAHGNGYQETGGGHHRDGMLYLGSRASLADALPLHIAPRWFSSHSGFKCPICSKSVASDEMEMHFIMCLSKPRLSYNGRIQRSLRGAQPEKTWLSGRTLQEQPWRTECSWAPMAQMQSYPHCPVENREDDVLTKDAGECVICLEELLQGDTIARLPCLCIYHKSCIDSWFEVNRSCPEHPAD

SEQ ID NO: 98456 - protein, 227 aa, Homo sapiens
  Payload ID: 19652
  Gene Name: zinc and ring finger 1, E3 ubiquitin protein ligase
  Uniprot ID: Q8ND25
  ENSP ID: ENSP00000335091
MGGKQSTAARSRGPFPGVSTDDSAVPPPGGAPHFGHYRTGGGAMGLRSRSVSSVAGMGMDPSTAGGVPFGLYTPASRGTGDSERAPGGGGSASDSTYAHGNGYQETGGGHHRDGMLYLGSRASLADALPLHIAPRWFSSHSGFKCPICSKSVASDEMEMHFIMCLSKPRLSYNDDVLTKDAGECVICLEELLQGDTIARLPCLCIYHKSCIDSWFEVNRSCPEHPAD

SEQ ID NO: 98457 - protein, 227 aa, Homo sapiens; identical to SEQ ID NO: 98456
  Payload ID: 19652
  Gene Name: zinc and ring finger 1, E3 ubiquitin protein ligase
  Uniprot ID: Q8ND25
  ENSP ID: ENSP00000455601

SEQ ID NO: 98458 - protein, 209 aa, Homo sapiens
  Payload ID: 19652
  Gene Name: zinc and ring finger 1, E3 ubiquitin protein ligase
  ENSP ID: ENSP00000456168
MGGKQSTAARSRGPFPGVSTDDSAVPPPGGAPHFGHYRTGGGAMGLRSRSVSSVAGMGMDPSTAGGVPFGLYTPASRGTGDSERAPGGGGSASDSTYAHGNGYQETGGGHHRDGMLYLGSRASLADALPLHIAPRWFSSHSGFKCPICSKSVASDEMEMHFIMCLSKPRLSYNDDVLTKDAGECVICLEELLQGDTIARLPCLCIYHKR

SEQ ID NO: 98459 - protein, 78 aa, Homo sapiens
  Payload ID: 19652
  Gene Name: zinc and ring finger 1, E3 ubiquitin protein ligase
  ENSP ID: ENSP00000457606
  MOD_RES (1)..(1): Any amino acid
XDVLTKDAGECVICLEELLQGDTIARLPCLCIYHKRDRAPLLQGGGSPDPGAELSLGHQREQGTPSALTSRSWFSLPP

SEQ ID NO: 98460 - protein, 52 aa, Homo sapiens
  Payload ID: 19652
  Gene Name: zinc and ring finger 1, E3 ubiquitin protein ligase
  ENSP ID: ENSP00000462910
MEMHFIMCLSKPRLSYNDDVLTKDAGECVICLEELLQGDTIARLPCLCIYHK

SEQ ID NO: 98461 - protein, 242 aa, Homo sapiens
  Payload ID: 19653
  Gene Name: zinc and ring finger 2, E3 ubiquitin protein ligase
  Uniprot ID: Q8NHG8
  ENSP ID: ENSP00000323879
MGAKQSGPAAANGRTRAYSGSDLPSSSSGGANGTAGGGGGARAAAAGRFPAQVPSAHQPSASGGAAAAAAAPAAPAAPRSRSLGGAVGSVASGARAAQSPFSIPNSSSGPYGSQDSVHSSPEDGGGGRDRPVGGSPGGPRLVIGSLPAHLSPHMFGGFKCPVCSKFVSSDEMDLHLVMCLTKPRITYNEDVLSKDAGECAICLEELQQGDTIARLPCLCIYHKGCIDEWFEVNRSCPEHPSD

SEQ ID NO: 98462 - protein, 836 aa, Homo sapiens
  Payload ID: 19654
  Gene Name: zinc and ring finger 3
  Uniprot ID: Q9ULT6
  ENSP ID: ENSP00000384456
MHPLGLCNNNDEEDLYEYGWVGVVKLEQPELDPKPCLTVLGKAKRAVQRGATAVIFDVSENPEAIDQLNQGSEDPLKRPVVYVKGADAIKLMNIVNKQKVARARIQHRPPRQPTEYFDMGIFLAFFVVVSLVCLILLVKIKLKQRRSQNSMNRLAVQALEKMETRKFNSKSKGRREGSCGALDTLSSSSTSDCAICLEKYIDGEELRVIPCTHRFHRKCVDPWLLQHHTCPHCRHNIIEQKGNPSAVCVETSNLSRGRQQRVTLPVHYPGRVHRTNAIPAYPTRTSMDSHGNPVTLLTMDRHGEQSLYSPQTPAYIRSYPPLHLDHSLAAHRCGLEHRAYSPAHPFRRPKLSGRSFSKAACFSQYETMYQHYYFQGLSYPEQEGQSPPSLAPRGPARAFPPSGSGSLLFPTVVHVAPPSHLESGSTSSFSCYHGHRSVCSGYLADCPGSDSSSSSSSGQCHCSSSDSVVDCTEVSNQGVYGSCSTFRSSLSSDYDPFIYRSRSPCRASEAGGSGSSGRGPALCFEGSPPPEELPAVHSHGAGRGEPWPGPASPSGDQVSTCSLEMNYSSNSSLEHRGPNSSTSEVGLEASPGAAPDLRRTWKGGHELPSCACCCEPQPSPAGPSAGAAGSSTLFLGPHLYEGSGPAGGEPQSGSSQGLYGLHPDHLPRTDGVKYEGLPCCFYEEKQVARGGGGGSGCYTEDYSVSVQYTLTEEPPPGCYPGARDLSQRIPIIPEDVDCDLGLPSDCQGTHSLGSWGGTRGPDTPRPHRGLGATREEERALCCQARALLRPGCPPEEAGAVRANFPSALQDTQESSTTATEAAGPRSHSADSSSPGA

SEQ ID NO: 98463 - protein, 836 aa, Homo sapiens; identical to SEQ ID NO: 98462
  Payload ID: 19654
  Gene Name: zinc and ring finger 3
  Uniprot ID: Q9ULT6
  ENSP ID: ENSP00000384553

SEQ ID NO: 98464 - protein, 936 aa, Homo sapiens
  Payload ID: 19654
  Gene Name: zinc and ring finger 3
  Uniprot ID: Q9ULT6
  ENSP ID: ENSP00000443824
MRPRSGGRPGATGRRRRRLRRRPRGLRCSRLPPPPPLPLLLGLLLAAAGPGAARAKETAFVEVVLFESSPSGDYTTYTTGLTGRFSRAGATLSAEGEIVQMHPLGLCNNNDEEDLYEYGWVGVVKLEQPELDPKPCLTVLGKAKRAVQRGATAVIFDVSENPEAIDQLNQGSEDPLKRPVVYVKGADAIKLMNIVNKQKVARARIQHRPPRQPTEYFDMGIFLAFFVVVSLVCLILLVKIKLKQRRSQNSMNRLAVQALEKMETRKFNSKSKGRREGSCGALDTLSSSSTSDCAICLEKYIDGEELRVIPCTHRFHRKCVDPWLLQHHTCPHCRHNIIEQKGNPSAVCVETSNLSRGRQQRVTLPVHYPGRVHRTNAIPAYPTRTSMDSHGNPVTLLTMDRHGEQSLYSPQTPAYIRSYPPLHLDHSLAAHRCGLEHRAYSPAHPFRRPKLSGRSFSKAACFSQYETMYQHYYFQGLSYPEQEGQSPPSLAPRGPARAFPPSGSGSLLFPTVVHVAPPSHLESGSTSSFSCYHGHRSVCSGYLADCPGSDSSSSSSSGQCHCSSSDSVVDCTEVSNQGVYGSCSTFRSSLSSDYDPFIYRSRSPCRASEAGGSGSSGRGPALCFEGSPPPEELPAVHSHGAGRGEPWPGPASPSGDQVSTCSLEMNYSSNSSLEHRGPNSSTSEVGLEASPGAAPDLRRTWKGGHELPSCACCCEPQPSPAGPSAGAAGSSTLFLGPHLYEGSGPAGGEPQSGSSQGLYGLHPDHLPRTDGVKYEGLPCCFYEEKQVARGGGGGSGCYTEDYSVSVQYTLTEEPPPGCYPGARDLSQRIPIIPEDVDCDLGLPSDCQGTHSLGSWGGTRGPDTPRPHRGLGATREEERALCCQARALLRPGCPPEEAGAVRANFPSALQDTQESSTTATEAAGPRSHSADSSSPGA

SEQ ID NO: 98465 - protein, 429 aa, Homo sapiens
  Payload ID: 19655
  Gene Name: zinc and ring finger 4
  Uniprot ID: Q8WWF5
  ENSP ID: ENSP00000222033
MPLCRPEHLMPRASRVPVAASLPLSHAVIPTQLPSRPGHRPPGRPRRCPKASCLPPPVGPSSTQTAKRVTMGWPRPGRALVAVKALLVLSLLQVPAQAVVRAVLEDNSSSVDFADLPALFGVPLAPEGIRGYLMEVKPANACHPIEAPRLGNRSLGAIVLIRRYDCTFDLKVLNAQRAGFEAAIVHNVHSDDLVSMTHVYEDLRGQIAIPSVFVSEAASQDLRVILGCNKSAHALLLPDDPPCHDLGCHPVLTVSWVLGCTLALVVSAFFVLNHLWLWAQACCSHRRPVKTSTCQKAQVRTFTWHNDLCAICLDEYEEGDQLKILPCSHTYHCKCIDPWFSQAPRRSCPVCKQSVAATEDSFDSTTYSFRDEDPSLPGHRPPIWAIQVQLRSRRLELLGRASPHCHCSTTSLEAEYTTVSSAPPEAPGQ

SEQ ID NO: 98466 - protein, 377 aa, Homo sapiens
  Payload ID: 19656
  Gene Name: zinc binding alcohol dehydrogenase domain containing 2
  Uniprot ID: Q8N4Q0
  ENSP ID: ENSP00000323678
MLRLVPTGARAIVDMSYARHFLDFQGSAIPQAMQKLVVTRLSPNFREAVTLSRDCPVPLPGDGDLLVRNRFVGVNASDINYSAGRYDPSVKPPFDIGFEGIGEVVALGLSASARYTVGQAVAYMAPGSFAEYTVVPASIATPVPSVKPEYLTLLVSGTTAYISLKELGGLSEGKKVLVTAAAGGTGQFAMQLSKKAKCHVIGTCSSDEKSAFLKSLGCDRPINYKTEPVGTVLKQEYPEGVDVVYESVGGAMFDLAVDALATKGRLIVIGFISGYQTPTGLSPVKAGTLPAKLLKKSASVQGFFLNHYLSKYQAAMSHLLEMCVSGDLVCEVDLGDLSPEGRFTGLESIFRAVNYMYMGKNTGKIVVELPHSVNSKL

SEQ ID NO: 98467 - protein, 254 aa, Homo sapiens
  Payload ID: 19656
  Gene Name: zinc binding alcohol dehydrogenase domain containing 2
  Uniprot ID: Q8N4Q0
  ENSP ID: ENSP00000440111
MAPGSFAEYTVVPASIATPVPSVKPEYLTLLVSGTTAYISLKELGGLSEGKKVLVTAAAGGTGQFAMQLSKKAKCHVIGTCSSDEKSAFLKSLGCDRPINYKTEPVGTVLKQEYPEGVDVVYESVGGAMFDLAVDALATKGRLIVIGFISGYQTPTGLSPVKAGTLPAKLLKKSASVQGFFLNHYLSKYQAAMSHLLEMCVSGDLVCEVDLGDLSPEGRFTGLESIFRAVNYMYMGKNTGKIVVELPHSVNSKL

SEQ ID NO: 98468 - protein, 154 aa, Homo sapiens
  Payload ID: 19656
  Gene Name: zinc binding alcohol dehydrogenase domain containing 2
  ENSP ID: ENSP00000463106
MAPGSFAEYTVVPASIATPVPSVKPEYLTLLVSGTTAYISLKELGGLSEGKKVLVTAAAGGTGQFAMQLSKKAKCHVIGTCSSDEKSAFLKSLGCDRPINYKTEPVGTVLKQEYPEGVDVVYESVGGAMFDLAVDALATKGRLIVIGFISGYQT

SEQ ID NO: 98469 - protein, 101 aa, Homo sapiens
  Payload ID: 19656
  Gene Name: zinc binding alcohol dehydrogenase domain containing 2
  ENSP ID: ENSP00000463844
MAPGSFAEYTVVPASIATPVPSVKPEYLTLLVSGTTAYISLKELGGLSEGKKVLVTAAAGGTGQFAMQLSKKAKCHVIGTCSSDEKSAFLKSLGCDRPINY

SEQ ID NO: 98470 - protein, 479 aa, Homo sapiens
  Payload ID: 19657
  Gene Name: zinc finger (CCCH type), RNA-binding motif and serine/arginine rich 1
  Uniprot ID: Q15695
  ENSP ID: ENSP00000375133
MAALEKMTFPKKMTFPEKPSHKKYRAALKKEKRKKRRQELARLRDSGLSQEEEEDTFIEEQQLEEEKLLERERERLHEEWLLREQKAQEEFRIKKEKEEAAKKWLEEQERKLKEQWKEQQRKEREEEEQKQQEKKEKEEAVQKMLDQAENDLENSTTWQNPEPPVDFRVMEKDRANCPFYSKTGACRFGDRCSRKHNFPTSSPTLLIKSMFTTFGMEQCRRDDYDPDASLEYSEEETYQQFLDFYEDVLPEFKNVGKVIQFKVSCNLEPHLRGNVYVQYQSEEECQAALSLFNGRWYAGRQLQCEFCPVTRWKMAICGLFEIQQCPRGKHCNFLHVFRNPNNEFWEANRDIYLSSDQTGSSFGKNSERREKMGHHDHYYSRQRGRRNPSPDHTYKRNGESERKKSSHRGKKSHKRTSKSRERHNSPSRGRNRHRSWDQGRRSQSRRSHRSRSQSSSRCRSRGRRKSGNRDRTVQSPQSK

SEQ ID NO: 98471 - protein, 482 aa, Homo sapiens
  Payload ID: 19658
  Gene Name: zinc finger (CCCH type), RNA-binding motif and serine/arginine rich 2
  Uniprot ID: Q15696
  ENSP ID: ENSP00000303015
MAAPEKMTFPEKPSHKKYRAALKKEKRKKRRQELARLRDSGLSQKEEEEDTFIEEQQLEEEKLLERERQRLHEEWLLREQKAQEEFRIKKEKEEAAKKRQEEQERKLKEQWEEQQRKEREEEEQKRQEKKEKEEALQKMLDQAENELENGTTWQNPEPPVDFRVMEKDRANCPFYSKTGACRFGDRCSRKHNFPTSSPTLLIKSMFTTFGMEQCRRDDYDPDASLEYSEEETYQQFLDFYEDVLPEFKNVGKVIQFKVSCNLEPHLRGNVYVQYQSEEECQAALSLFNGRWYAGRQLQCEFCPVTRWKMAICGLFEIQQCPRGKHCNFLHVFRNPNNEFWEANRDIYLSPDRTGSSFGKNSERRERMGHHDDYYSRLRGRRNPSPDHSYKRNGESERKSSRHRGKKSHKRTSKSRERHNSRSRGRNRDRSRDRSRGRGSRSRSRSRSRRSRRSRSQSSSRSRSRGRRRSGNRDRTVQSPKSK

SEQ ID NO: 98472 - protein, 147 aa, Homo sapiens
  Payload ID: 19658
  Gene Name: zinc finger (CCCH type), RNA-binding motif and serine/arginine rich 2
  ENSP ID: ENSP00000369664
MAAPEKMTFPEKPSHKKYRAALKKEKRKKRRQELARLRDSGLSQKEEEEDTFIEEQQLEEEKLLERERLECSGVISAHRNLHLPGSHDSPASASRVAGITGTHRHTQLIFFCTFSRDGVSPCWPGWSRSLDLMICPPRPHKVLRLQV

SEQ ID NO: 98473 - protein, 1243 aa, Homo sapiens
  Payload ID: 19659
  Gene Name: zinc finger and AT hook domain containing
  Uniprot ID: Q9P243
  ENSP ID: ENSP00000367069
METRAAENTAIFMCKCCNLFSPNQSELLSHVSEKHMEEGVNVDEIIIPLRPLSTPEPPNSSKTGDEFLVMKRKRGRPKGSTKKSSTEEELAENIVSPTEDSPLAPEEGNSLPPSSLECSKCCRKFSNTRQLRKHICIIVLNLGEEEGEAGNESDLELEKKCKEDDREKASKRPRSQKTEKVQKISGKEARQLSGAKKPIISVVLTAHEAIPGATKIVPVEAGPPETGATNSETTSADLVPRRGYQEYAIQQTPYEQPMKSSRLGPTQLKIFTCEYCNKVFKFKHSLQAHLRIHTNEKPYKCPQCSYASAIKANLNVHLRKHTGEKFACDYCSFTCLSKGHLKVHIERVHKKIKQHCRFCKKKYSDVKNLIKHIRDAHDPQDKKVKEALDELCLMTREGKRQLLYDCHICERKFKNELDRDRHMLVHGDKWPFACELCGHGATKYQALELHVRKHPFVYVCAVCRKKFVSSIRLRTHIKEVHGAAQEALVFTSSINQSFCLLEPGGDIQQEALGDQLQLVEEEFALQGVNALKEEACPGDTQLEEGRKEPEAPGEMPAPAVHLASPQAESTALPPCELETTVVSSSDLHSQEVVSDDFLLKNDTSSAEAHAAPEKPPDMQHRSSVQTQGEVITLLLSKAQSAGSDQESHGAQSPLGEGQNMAVLSAGDPDPSRCLRSNPAEASDLLPPVAGGGDTITHQPDSCKAAPEHRSGITAFMKVLNSLQKKQMNTSLCERIRKVYGDLECEYCGKLFWYQVHFDMHVRTHTREHLYYCSQCHYSSITKNCLKRHVIQKHSNILLKCPTDGCDYSTPDKYKLQAHLKVHTALDKRSYSCPVCEKSFSEDRLIKSHIKTNHPEVSMSTISEVLGRRVQLKGLIGKRAMKCPYCDFYFMKNGSDLQRHIWAHEGVKPFKCSLCEYATRSKSNLKAHMNRHSTEKTHLCDMCGKKFKSKGTLKSHKLLHTADGKQFKCTVCDYTAAQKPQLLRHMEQHVSFKPFRCAHCHYSCNISGSLKRHYNRKHPNEEYANVGTGELAAEVLIQQGGLKCPVCSFVYGTKWEFNRHLKNKHGLKVVEIDGDPKWETATEAPEEPSTQYLHITEAEEDVQGTQAAVAALQDLRYTSESGDRLDPTAVNILQQIIELGAETHDATALASVVAMAPGTVTVVKQVTEEEPSSNHTVMIQETVQQASVELAEQHHLVVSSDDVEGIETVTVYTQGGEASEFIVYVQEAMQPVEEQAVEQPAQEL

SEQ ID NO: 98474 - protein, 1156 aa, Homo sapiens
  Payload ID: 19659
  Gene Name: zinc finger and AT hook domain containing
  ENSP ID: ENSP00000394501
MCKCCNLFSPNQSELLSHVSEKHMEEGVNVDEIIIPLRPLSTPEPPNSSKTGDEFLVMKRKRGRPKGSTKKSSTEEELAENIVSPTEDSPLAPEEGNSLPPSSLECSKCCRKFSNTRQLRKHICIIVLNLGEEEGEAGNESDLELEKKCKEDDREKASKRPRSQKTEKVQKISGKEARQLSGAKKPIISVVLTAHEAIPGATKIVPVEAGPPETGATNSETTSADLVPRRGYQEYAIQQTPYEQPMKSSRLGPTQLKIFTCEYCNKVFKFKHSLQAHLRIHTNEKPYKCPQCSYASAIKANLNVHLRKHTGEKFACDYCSFTCLSKGHLKVHIERVHKKIKQHCRFCKKKYSDVKNLIKHIRDAHDPQDKKVKEALDELCLMTREGKRQLLYDCHICERKFKNELDRDRHMLVHGDKWPFACELCGHGATKYQALELHVRKHPFVYVCAVCRKKFVSSIRLRTHIKEVHGAAQEALVFTSSINQSFCLLEPGGDIQQEALGDQLQLVEEEFALQGVNALKEEACPGDTQLEEGRKEPEAPGEMPAPAVHLASPQAESTALPPCELETTVVSSSDLHSQEVVSDDFLLKNDTSSAEAHAAPEKPPDMQHRSSVQTQGEVITLLLSKAQSAGSDQESHGAQSPLGEGQNMAVLSAGDPDPSRCLRSNPAEASDLLPPVAGGGDTITHQPDSCKAAPEHRSGITAFMKVLNSLQKKQMNTSLCERIRKVYGDLECEYCGKLFWYQVHFDMHVRTHTREHLYYCSQCHYSSITKNCLKRHVIQKHSNILLKCPTDGCDYSTPDKYKLQAHLKVHTALDKRSYSCPVCEKSFSEDRLIKSHIKTNHPEVSMSTISEVLGRRVQLKGLIGKRAMKCPYCDFYFMKNGSDLQRHIWAHEGVKPFKCSLCEYATRSKSNLKAHMNRHSTEKTHLCDMCGKKFKSKGTLKSHKLLHTADGKQFKCTVCDYTAAQKPQLLRHMEQHVSFKPFRCAHCHYSCNISGSLKRHYNRKHPNEEYANVGTGELAAEVLIQQGGLKCPVCSFVYGTKWEFNRHLKNKHGLKVVEIDGDPKWETATEAPEEPSTQYLHITEAEEDVQGTQAAVAALQDLRYTSESGDRLDPTAVNILQQLQPHGHDPGDGPASVRGACRAAPPGGVLRRRGGH

SEQ ID NO: 98475 - protein, 1231 aa, Homo sapiens
  Payload ID: 19659
  Gene Name: zinc finger and AT hook domain containing
  Uniprot ID: Q9P243
  ENSP ID: ENSP00000427831
MCKCCNLFSPNQSELLSHVSEKHMEEGVNVDEIIIPLRPLSTPEPPNSSKTGDEFLVMKRKRGRPKGSTKKSSTEEELAENIVSPTEDSPLAPEEGNSLPPSSLECSKCCRKFSNTRQLRKHICIIVLNLGEEEGEAGNESDLELEKKCKEDDREKASKRPRSQKTEKVQKISGKEARQLSGAKKPIISVVLTAHEAIPGATKIVPVEAGPPETGATNSETTSADLVPRRGYQEYAIQQTPYEQPMKSSRLGPTQLKIFTCEYCNKVFKFKHSLQAHLRIHTNEKPYKCPQCSYASAIKANLNVHLRKHTGEKFACDYCSFTCLSKGHLKVHIERVHKKIKQHCRFCKKKYSDVKNLIKHIRDAHDPQDKKVKEALDELCLMTREGKRQLLYDCHICERKFKNELDRDRHMLVHGDKWPFACELCGHGATKYQALELHVRKHPFVYVCAVCRKKFVSSIRLRTHIKEVHGAAQEALVFTSSINQSFCLLEPGGDIQQEALGDQLQLVEEEFALQGVNALKEEACPGDTQLEEGRKEPEAPGEMPAPAVHLASPQAESTALPPCELETTVVSSSDLHSQEVVSDDFLLKNDTSSAEAHAAPEKPPDMQHRSSVQTQGEVITLLLSKAQSAGSDQESHGAQSPLGEGQNMAVLSAGDPDPSRCLRSNPAEASDLLPPVAGGGDTITHQPDSCKAAPEHRSGITAFMKVLNSLQKKQMNTSLCERIRKVYGDLECEYCGKLFWYQVHFDMHVRTHTREHLYYCSQCHYSSITKNCLKRHVIQKHSNILLKCPTDGCDYSTPDKYKLQAHLKVHTALDKRSYSCPVCEKSFSEDRLIKSHIKTNHPEVSMSTISEVLGRRVQLKGLIGKRAMKCPYCDFYFMKNGSDLQRHIWAHEGVKPFKCSLCEYATRSKSNLKAHMNRHSTEKTHLCDMCGKKFKSKGTLKSHKLLHTADGKQFKCTVCDYTAAQKPQLLRHMEQHVSFKPFRCAHCHYSCNISGSLKRHYNRKHPNEEYANVGTGELAAEVLIQQGGLKCPVCSFVYGTKWEFNRHLKNKHGLKVVEIDGDPKWETATEAPEEPSTQYLHITEAEEDVQGTQAAVAALQDLRYTSESGDRLDPTAVNILQQIIELGAETHDATALASVVAMAPGTVTVVKQVTEEEPSSNHTVMIQETVQQASVELAEQHHLVVSSDDVEGIETVTVYTQGGEASEFIVYVQEAMQPVEEQAVEQPAQEL

SEQ ID NO: 98476 - protein, 1145 aa, Homo sapiens
  Payload ID: 19659
  Gene Name: zinc finger and AT hook domain containing
  ENSP ID: ENSP00000427879
MCKCCNLFSPNQSELLSHVSEKHMEEGVNVDEIIIPLRPLSTPEPPNSSKTGDEFLVMKRKRGRPKGSTKKSSTEEELAENIVSPTEDSPLAPEEGNSLPPSSLECSKCCRKFSNTRQLRKHICIIVLNLGEEEGEAGNESDLELEKKCKEDDREKASKRPRSQKTEKVQKISGKEARQLSGAKKPIISVVLTAHEAIPGATKIVPVEAGPPETGATNSETTSADLVPRRGYQEYAIQQTPYEQPMKSSRLGPTQLKIFTCEYCNKVFKFKHSLQAHLRIHTNEKPYKCPQCSYASAIKANLNVHLRKHTGEKFACDYCSFTCLSKGHLKVHIERVHKKIKQHCRFCKKKYSDVKNLIKHIRDAHDPQDKKVKEALDELCLMTREGKRQLLYDCHICERKFKNELDRDRHMLVHGDKWPFACELCGHGATKYQALELHVRKHPFVYVCAVCRKKFVSSIRLRTHIKEVHGAAQEALVFTSSINQSFCLLEPGGDIQQEALGDQLQLVEEEFALQGVNALKEEACPGDTQLEEGRKEPEAPGEMPAPAVHLASPQAESTALPPCELETTVVSSSDLHSQEVVSDDFLLKNDTSSAEAHAAPEKPPDMQHRSSVQTQGEVITLLLSKAQSAGSDQESHGAQSPLGEGQNMAVLSAGDPDPSRCLRSNPAEASDLLPPVAGGGDTITHQPDSCKAAPEHRSGITAFMKVLNSLQKKQMNTSLCERIRKVYGDLECEYCGKLFWYQVHFDMHVRTHTREHLYYCSQCHYSSITKNCLKRHVIQKHSNILLKCPTDGCDYSTPDKYKLQAHLKVHTALDKRSYSCPVCEKSFSEDRLIKSHIKTNHPEVSMSTISEVLGRRVQLKGLIGKRAMKCPYCDFYFMKNGSDLQRHIWAHEGVKPFKCSLCEYATRSKSNLKAHMNRHSTEKTHLCDMCGKKFKSKGTLKSHKLLHTADGKQFKCTVCDYTAAQKPQLLRHMEQHVSFKPFRCAHCHYSCNISGSLKRHYNRKHPNEEYANVGTGELAAEVLIQQGGLKCPVCSFVYGTKWEFNRHLKNKHGLKVVEIDGDPKWEVTEEEPSSNHTVMIQETVQQASVELAEQHHLVVSSDDVEGIETVTVYTQGGEASEFIVYVQEAMQPVEEQAVEQPAQEL

SEQ ID NO: 98477 - protein, 150 aa, Homo sapiens
  Payload ID: 19659
  Gene Name: zinc finger and AT hook domain containing
  ENSP ID: ENSP00000428192
MCKCCNLFSPNQSELLSHVSEKHMEEGVNVDEIIIPLRPLSTPEPPNSSKTGDEFLVMKRKRGRPKGSTKKSSTEEELAENIVSPTEDSPLAPEEGNSLPPSSLECSKCCRKFSNTRQLRKHICIIVLNLGEEEGEAGATKIVPVEAGPP

SEQ ID NO: 98478 - protein, 1231 aa, Homo sapiens; identical to SEQ ID NO: 98475
  Payload ID: 19659
  Gene Name: zinc finger and AT hook domain containing
  Uniprot ID: Q9P243
  ENSP ID: ENSP00000428483

SEQ ID NO: 98479 - protein, 58 aa, Homo sapiens
  Payload ID: 19659
  Gene Name: zinc finger and AT hook domain containing
  ENSP ID: ENSP00000429050
METRAAGLLEFAGGPLHTLFAWVSPVEAAEQQRLLPVPASGSFVPEGHLPDASQSSPV

SEQ ID NO: 98480 - protein, 1181 aa, Homo sapiens
  Payload ID: 19659
  Gene Name: zinc finger and AT hook domain containing
  Uniprot ID: Q9P243
  ENSP ID: ENSP00000429091
METRAAENTAIFMCKCCNLFSPNQSELLSHVSEKHMEEGVNVDEIIIPLRPLSTPEPPNSSKTGDEFLVMKRKRGRPKGSTKKSSTEEELAENIVSPTEDSPLAPEEGNSLPPSSLECSKCCRKFSNTRQLRKHICIIVLNLGEEEGEAGATKIVPVEAGPPETGATNSETTSADLVPRRGYQEYAIQQTPYEQPMKSSRLGPTQLKIFTCEYCNKVFKFKHSLQAHLRIHTNEKPYKCPQCSYASAIKANLNVHLRKHTGEKFACDYCSFTCLSKGHLKVHIERVHKKIKQHCRFCKKKYSDVKNLIKHIRDAHDPQDKKVKEALDELCLMTREGKRQLLYDCHICERKFKNELDRDRHMLVHGDKWPFACELCGHGATKYQALELHVRKHPFVYVCAVCRKKFVSSIRLRTHIKEVHGAAQEALVFTSSINQSFCLLEPGGDIQQEALGDQLQLVEEEFALQGVNALKEEACPGDTQLEEGRKEPEAPGEMPAPAVHLASPQAESTALPPCELETTVVSSSDLHSQEVVSDDFLLKNDTSSAEAHAAPEKPPDMQHRSSVQTQGEVITLLLSKAQSAGSDQESHGAQSPLGEGQNMAVLSAGDPDPSRCLRSNPAEASDLLPPVAGGGDTITHQPDSCKAAPEHRSGITAFMKVLNSLQKKQMNTSLCERIRKVYGDLECEYCGKLFWYQVHFDMHVRTHTREHLYYCSQCHYSSITKNCLKRHVIQKHSNILLKCPTDGCDYSTPDKYKLQAHLKVHTALDKRSYSCPVCEKSFSEDRLIKSHIKTNHPEVSMSTISEVLGRRVQLKGLIGKRAMKCPYCDFYFMKNGSDLQRHIWAHEGVKPFKCSLCEYATRSKSNLKAHMNRHSTEKTHLCDMCGKKFKSKGTLKSHKLLHTADGKQFKCTVCDYTAAQKPQLLRHMEQHVSFKPFRCAHCHYSCNISGSLKRHYNRKHPNEEYANVGTGELAAEVLIQQGGLKCPVCSFVYGTKWEFNRHLKNKHGLKVVEIDGDPKWETATEAPEEPSTQYLHITEAEEDVQGTQAAVAALQDLRYTSESGDRLDPTAVNILQQIIELGAETHDATALASVVAMAPGTVTVVKQVTEEEPSSNHTVMIQETVQQASVELAEQHHLVVSSDDVEGIETVTVYTQGGEASEFIVYVQEAMQPVEEQAVEQPAQEL

SEQ ID NO: 98481 - protein, 163 aa, Homo sapiens
  Payload ID: 19659
  Gene Name: zinc finger and AT hook domain containing
  ENSP ID: ENSP00000429600
NLWNFLAHTFIESAAERACWVLPGVQLRGQPHVRMLGLRARDRLDPTAVNILQQIIELGAETHDATALASVVAMAPGTVTVVKQVTEEEPSSNHTVMIQETVQQASVELAEQHHLVVSSDDVEGIETVTVYTQGGEASEFIVYVQEAMQPVEEQAVEQPAQEL

SEQ ID NO: 98482 - protein, 998 aa, Homo sapiens
  Payload ID: 19659
  Gene Name: zinc finger and AT hook domain containing
  ENSP ID: ENSP00000429930
METRAAENTAIFMCKCCNLFSPNQSELLSHVSEKHMEEGVNVDEIIIPLRPLSTPEPPNSSKTGDEFLVMKRKRGRPKGSTKKSSTEEELAENIVSPTEDSPLAPEEGNSLPPSSLECSKCCRKFSNTRQLRKHICIIVLNLGEEEGEAGNESDLELEKKCKEDDREKASKRPRSQKTEKVQKISGKEARQLSGAKKPIISVVLTAHEAIPGATKIVPVEAGPPETGATNSETTSADLVPRRGYQEYAIQQTPYEQPMKSSRLGPTQLKIFTCEYCNKVFKFKHSLQAHLRIHTNEKPYKCPQCSYASAIKANLNVHLRKHTGEKFACDYCSFTCLSKGHLKVHIERVHKKIKQHCRFCKKKYSDVKNLIKHIRDAHDPQDKKVKEALDELCLMTREGKRQLLYDCHICERKFKNELDRDRHMLVHGDKWPFACELCGHGATKYQALELHVRKHPFVYVCAVCRKKFVSSIRLRTHIKEVHGAAQEALVFTSSINQSFCLLEPGGDIQQEALGDQLQLVEEEFALQGVNALKEEACPGDTQLEEGRKEPEAPGEMPAPAVHLASPQAESTALPPCELETTVVSSSDLHSQEVVSDDFLLKNDTSSAEAHAAPEKPPDMQHRSSVQTQGEVITLLLSKAQSAGSDQESHGAQSPLGEGQNMAVLSAGDPDPSRCLRSNPAEASDLLPPVAGGGDTITHQPDSCKAAPEHRSGITAFMKVLNSLQKKQMNTSLCERIRKVYGDLECEYCGKLFWYQVHFDMHVRTHTREHLYYCSQCHYSSITKNCLKRHVIQKHSNILLKCPTDGCDYSTPDKYKLQAHLKVHTALDKRSYSCPVCEKSFSEDRLIKSHIKTNHPEVSMSTISEVLGRRVQLKGLIGKRAMKCPYCDFYFMKNGSDLQRHIWAHEGVKPFKCSLCEYATRSKSNLKAHMNRHSTEKTHLCDMCGKKFKSKGTLKSHKLLHTADGKQFKCTVCDYTAAQKPQLLRHMEQHVSFKKRSIAL

SEQ ID NO: 98483 - protein, 196 aa, Homo sapiens
  Payload ID: 19659
  Gene Name: zinc finger and AT hook domain containing
  ENSP ID: ENSP00000429983
MTREFLVMKRKRGRPKGSTKKSSTEEELAENIVSPTEDSPLAPEEGNSLPPSSLECSKCCRKFSNTRQLRKHICIIVLNLGEEEGEAGNESDLELEKKCKEDDREKASKRPRSQKTEKVQKISGKEARQLSGAKKPIISVVLTAHEAIPGATKIVPVEAGPPETGATNSETTSADLVPRRGYQEYAIQQTPYEQPM

SEQ ID NO: 98484 - protein, 98 aa, Homo sapiens
  Payload ID: 19659
  Gene Name: zinc finger and AT hook domain containing
  ENSP ID: ENSP00000430924
  MOD_RES (1)..(1): Any amino acid
XKLFWYQVHFDMHVRTHTREHLYYCSQCHYSSITKNCLKRHVIQKHSNILLKCPTDGCDYSTPDKYKLQAHLKVHTALVFGGGSCNTMNECLFLQILI

SEQ ID NO: 98485 - protein, 644 aa, Homo sapiens
  Payload ID: 19660
  Gene Name: zinc finger and BTB domain containing 1
  Uniprot ID: Q9Y2K1
  ENSP ID: ENSP00000351587
MAKPSHSSYVLQQLNNQREWGFLCDCCIAIDDIYFQAHKAVLAACSSYFRMFFMNHQHSTAQLNLSNMKISAECFDLILQFMYLGKIMTAPSSFEQFKVAMNYLQLYNVPDCLEDIQDADCSSSKCSSSASSKQNSKMIFGVRMYEDTVARNGNEANRWCAEPSSTVNTPHNREADEESLQLGNFPEPLFDVCKKSSVSKLSTPKERVSRRFGRSFTCDSCGFGFSCEKLLDEHVLTCTNRHLYQNTRSYHRIVDIRDGKDSNIKAEFGEKDSSKTFSAQTDKYRGDTSQAADDSASTTGSRKSSTVESEIASEEKSRAAERKRIIIKMEPEDIPTDELKDFNIIKVTDKDCNESTDNDELEDEPEEPFYRYYVEEDVSIKKSGRKTLKPRMSVSADERGGLENMRPPNNSSPVQEDAENASCELCGLTITEEDLSSHYLAKHIENICACGKCGQILVKGRQLQEHAQRCGEPQDLTMNGLGNTEEKMDLEENPDEQSEIRDMFVEMLDDFRDNHYQINSIQKKQLFKHSACPFRCPNCGQRFETENLVVEHMSSCLDQDMFKSAIMEENERDHRRKHFCNLCGKGFYQRCHLREHYTVHTKEKQFVCQTCGKQFLRERQLRLHNDMHKGMASGEIGPSKPVEK

SEQ ID NO: 98486 - protein, 130 aa, Homo sapiens
  Payload ID: 19660
  Gene Name: zinc finger and BTB domain containing 1
  ENSP ID: ENSP00000450689
MAKPSHSSYVLQQLNNQREWGFLCDCCIAIDDIYFQAHKAVLAACSSYFRMFFMNHQHSTAQLNLSNMKISAECFDLILQFMYLGKIMTAPSSFEQFKVAMNYLQLYNVPDCLEDIQDADCSSSKCSSSA

SEQ ID NO: 98487 - protein, 713 aa, Homo sapiens
  Payload ID: 19660
  Gene Name: zinc finger and BTB domain containing 1
  Uniprot ID: Q9Y2K1
  ENSP ID: ENSP00000451000
MAKPSHSSYVLQQLNNQREWGFLCDCCIAIDDIYFQAHKAVLAACSSYFRMFFMNHQHSTAQLNLSNMKISAECFDLILQFMYLGKIMTAPSSFEQFKVAMNYLQLYNVPDCLEDIQDADCSSSKCSSSASSKQNSKMIFGVRMYEDTVARNGNEANRWCAEPSSTVNTPHNREADEESLQLGNFPEPLFDVCKKSSVSKLSTPKERVSRRFGRSFTCDSCGFGFSCEKLLDEHVLTCTNRHLYQNTRSYHRIVDIRDGKDSNIKAEFGEKDSSKTFSAQTDKYRGDTSQAADDSASTTGSRKSSTVESEIASEEKSRAAERKRIIIKMEPEDIPTDELKDFNIIKVTDKDCNESTDNDELEDEPEEPFYRYYVEEDVSIKKSGRKTLKPRMSVSADERGGLENMRPPNNSSPVQEDAENASCELCGLTITEEDLSSHYLAKHIENICACGKCGQILVKGRQLQEHAQRCGEPQDLTMNGLGNTEEKMDLEENPDEQSEIRDMFVEMLDDFRDNHYQINSIQKKQLFKHSACPFRCPNCGQRFETENLVVEHMSSCLDQDMFKSAIMEENERDHRRKHFCNLCGKGFYQRCHLREHYTVHTKEKQFVCQTCGKQFLRERQLRLHNDMHKGMARYVCSICDQGNFRKHDHVRHMISHLSAGETICQVCFQIFPNNEQLEQHMDVHLYTCGICGAKFNLRKDMRSHYNAKHLKRT

SEQ ID NO: 98488 - protein, 34 aa, Homo sapiens
  Payload ID: 19660
  Gene Name: zinc finger and BTB domain containing 1
  ENSP ID: ENSP00000451332
MAKPSHSSYVLQQLNNQREWGFLCDCCIAIDDIY

SEQ ID NO: 98489 - protein, 155 aa, Homo sapiens
  Payload ID: 19660
  Gene Name: zinc finger and BTB domain containing 1
  ENSP ID: ENSP00000451584
MAKPSHSSYVLQQLNNQREWGFLCDCCIAIDDIYFQAHKAVLAACSSYFRMFFMNHQHSTAQLNLSNMKISAECFDLILQFMYLGKIMTAPSSFEQFKVAMNYLQLYNVPDCLEDIQDADCSSSKCSSSASSKQNSKMIFGVRMYEDTVARNGNE

SEQ ID NO: 98490 - protein, 579 aa, Homo sapiens
  Payload ID: 19661
  Gene Name: zinc finger and BTB domain containing 10
  Uniprot ID: Q96DT7
  ENSP ID: ENSP00000368384
MTRLERSSHRTVICKVPGELVAREGKCASRARESEIPSEEGYCDFNSRPNENSYCYQLLRQLNEQRKKGILCDVSIVVSGKIFKAHKNILVAGSRFFKTLYCFSNKESPNQNNTTHLDIAAVQGFSVILDFLYSGNLVLTSQNAIEVMTVASYLQMSEVVQTCRNFIKDALNISIKSEAPESVVVDYNNRKPVNRDGLSSSRDQKIASFWATRNLTNLASNVKIENDGCNVDEGQIENYQMNDSSWVQDGSPEMAENESEGQTKVFIWNNMGSQGIQETGKTRRKNQTTKRFIYNIPPNNETNLEDCSVMQPPVAYPEENTLLIKEEPDLDGALLSGPDGDRNVNANLLAEAGTSQDGGDAGTSHDFKYGLMPGPSNDFKYGLIPGTSNDFKYGLIPGASNDFKYGLLPESWPKQETWENGESSLIMNKLKCPHCSYVAKYRRTLKRHLLIHTGVRSFSCDICGKLFTRREHVKRHSLVHKKDKKYKCMVCKKIFMLAASVGIRHGSRRYGVCVDCADKSQPGGQEGVDQGQDTEFPRDEEYEENEVGEADEELVDDGEDQNDPSRWDESGEVCMSLDD

SEQ ID NO: 98491 - protein, 871 aa, Homo sapiens
  Payload ID: 19661
  Gene Name: zinc finger and BTB domain containing 10
  Uniprot ID: Q96DT7
  ENSP ID: ENSP00000387462
MSFSEMNRRTLAFRGGGLVTASGGGSTNNNAGGEASAWPPQPQPRQPPPPAPPALQPPNGRGADEEVELEGLEPQDLEASAGPAAGAAEEAKELLLPQDAGGPTSLGGGAGGPLLAERNRRTLAFRGGGGGGLGNNGSSRGRPETSVWPLRHFNGRGPATVDLELDALEGKELMQDGASLSDSTEDEEEGASLGDGSGAEGGSCSSSRRSGGDGGDEVEGSGVGAGEGETVQHFPLARPKSLMQKLQCSFQTSWLKDFPWLRYSKDTGLMSCGWCQKTPADGGSVDLPPVGHDELSRGTRNYKKTLLLRHHVSTEHKLHEANAQESEIPSEEGYCDFNSRPNENSYCYQLLRQLNEQRKKGILCDVSIVVSGKIFKAHKNILVAGSRFFKTLYCFSNKESPNQNNTTHLDIAAVQGFSVILDFLYSGNLVLTSQNAIEVMTVASYLQMSEVVQTCRNFIKDALNISIKSEAPESVVVDYNNRKPVNRDGLSSSRDQKIASFWATRNLTNLASNVKIENDGCNVDEGQIENYQMNDSSWVQDGSPEMAENESEGQTKVFIWNNMGSQGIQETGKTRRKNQTTKRFIYNIPPNNETNLEDCSVMQPPVAYPEENTLLIKEEPDLDGALLSGPDGDRNVNANLLAEAGTSQDGGDAGTSHDFKYGLMPGPSNDFKYGLIPGTSNDFKYGLIPGASNDFKYGLLPESWPKQETWENGESSLIMNKLKCPHCSYVAKYRRTLKRHLLIHTGVRSFSCDICGKLFTRREHVKRHSLVHKKDKKYKCMVCKKIFMLAASVGIRHGSRRYGVCVDCADKSQPGGQEGVDQGQDTEFPRDEEYEENEVGEADEELVDDGEDQNDPSRWDESGEVCMSLDD

SEQ ID NO: 98492 - protein, 871 aa, Homo sapiens; identical to SEQ ID NO: 98491
  Payload ID: 19661
  Gene Name: zinc finger and BTB domain containing 10
  Uniprot ID: Q96DT7
  ENSP ID: ENSP00000412036

SEQ ID NO: 98493 - protein, 847 aa, Homo sapiens
  Payload ID: 19661
  Gene Name: zinc finger and BTB domain containing 10
  Uniprot ID: Q96DT7
  ENSP ID: ENSP00000416134
MSFSEMNRRTLAFRGGGLVTASGGGSTNNNAGGEASAWPPQPQPRQPPPPAPPALQPPNGRGADEEVELEGLEPQDLEASAGPAAGAAEEAKELLLPQDAGGPTSLGGGAGGPLLAERNRRTLAFRGGGGGGLGNNGSSRGRPETSVWPLRHFNGRGPATVDLELDALEGKELMQDGASLSDSTEDEEEGASLGDGSGAEGGSCSSSRRSGGDGGDEVEGSGVGAGEGETVQHFPLARPKSLMQKLQCSFQTSWLKDFPWLRYSKDTGLMSCGWCQKTPADGGSVDLPPVGHDELSRGTRNYKKTLLLRHHVSTEHKLHEANAQESEIPSEEGYCDFNSRPNENSYCYQLLRQLNEQRKKGILCDVSIVVSGKIFKAHKNILVAGSRFFKTLYCFSNKESPNQNNTTHLDIAAVQGFSVILDFLYSGNLVLTSQNAIEVMTVASYLQMSEVVQTCRNFIKDALNISIKSEAPESVVVDYNNRKPVNRDGLSSSRDQKIASFWATRNLTNLASNVKIENDGCNVDEGQIENYQMNDSSWVQDGSPEMAENESEGQTKVFIWNNMGSQGIQETGKTRRKNQTTKRFIYNIPPNNETNLEDCSVMQPPVAYPEENTLLIKEEPDLDGALLSGPDGDRNVNANLLAEAGTSQDGGDAGTSHDFKYGLMPGASNDFKYGLLPESWPKQETWENGESSLIMNKLKCPHCSYVAKYRRTLKRHLLIHTGVRSFSCDICGKLFTRREHVKRHSLVHKKDKKYKCMVCKKIFMLAASVGIRHGSRRYGVCVDCADKSQPGGQEGVDQGQDTEFPRDEEYEENEVGEADEELVDDGEDQNDPSRWDESGEVCMSLDD

SEQ ID NO: 98494 - protein, 698 aa, Homo sapiens
  Payload ID: 19661
  Gene Name: zinc finger and BTB domain containing 10
  Uniprot ID: Q96DT7
  ENSP ID: ENSP00000484716
MQDGASLSDSTEDEEEGASLGDGSGAEGGSCSSSRRSGGDGGDEVEGSGVGAGEGETVQHFPLARPKSLMQKLQCSFQTSWLKDFPWLRYSKDTGLMSCGWCQKTPADGGSVDLPPVGHDELSRGTRNYKKTLLLRHHVSTEHKLHEANAQESEIPSEEGYCDFNSRPNENSYCYQLLRQLNEQRKKGILCDVSIVVSGKIFKAHKNILVAGSRFFKTLYCFSNKESPNQNNTTHLDIAAVQGFSVILDFLYSGNLVLTSQNAIEVMTVASYLQMSEVVQTCRNFIKDALNISIKSEAPESVVVDYNNRKPVNRDGLSSSRDQKIASFWATRNLTNLASNVKIENDGCNVDEGQIENYQMNDSSWVQDGSPEMAENESEGQTKVFIWNNMGSQGIQETGKTRRKNQTTKRFIYNIPPNNETNLEDCSVMQPPVAYPEENTLLIKEEPDLDGALLSGPDGDRNVNANLLAEAGTSQDGGDAGTSHDFKYGLMPGPSNDFKYGLIPGTSNDFKYGLIPGASNDFKYGLLPESWPKQETWENGESSLIMNKLKCPHCSYVAKYRRTLKRHLLIHTGVRSFSCDICGKLFTRREHVKRHSLVHKKDKKYKCMVCKKIFMLAASVGIRHGSRRYGVCVDCADKSQPGGQEGVDQGQDTEFPRDEEYEENEVGEADEELVDDGEDQNDPSRWDESGEVCMSLDD

SEQ ID NO: 98495 - protein, 1053 aa, Homo sapiens
  Payload ID: 19662
  Gene Name: zinc finger and BTB domain containing 11
  Uniprot ID: O95625
  ENSP ID: ENSP00000326200
MSSEESYRAILRYLTNEREPYAPGTEGNVKRKIRKAAACYVVRGGTLYYQRRQRHRKTFAELEVVLQPERRRDLIEAAHLGPGGTHHTRHQTWHYLSKTYWWRGILKQVKDYIKQCSKCQEKLDRSRPISDVSEMLEELGLDLESGEESNESEDDLSNFTSSPTTASKPAKKKPVSKHELVFVDTKGVVKRSSPKHCQAVLKQLNEQRLSNQFCDVTLLIEGEEYKAHKSVLSANSEYFRDLFIEKGAVSSHEAVVDLSGFCKASFLPLLEFAYTSVLSFDFCSMADVAILARHLFMSEVLEICESVHKLMEEKQLTVYKKGEVQTVASTQDLRVQNGGTAPPVASSEGTTTSLPTELGDCEIVLLVNGELPEAEQNGEVGRQPEPQVSSEAESALSSVGCIADSHPEMESVDLITKNNQTELETSNNRENNTVSNIHPKLSKENVISSSPEDSGMGNDISAEDICAEDIPKHRQKVDQPLKDQENLVASTAKTDFGPDDDTYRSRLRQRSVNEGAYIRLHKGMEKKLQKRKAVPKSAVQQVAQKLVQRGKKMKQPKRDAKENTEEASHKCGECGMVFQRRYALIMHKLKHERARDYKCPLCKKQFQYSASLRAHLIRHTRKDAPSSSSSNSTSNEASGTSSEKGRTKREFICSICGRTLPKLYSLRIHMLKHTGVKPHACQVCGKTFIYKHGLKLHQSLHQSQKQFQCELCVKSFVTKRSLQEHMSIHTGESKYLCSVCGKSFHRGSGLSKHFKKHQPKPEVRGYHCTQCEKSFFEARDLRQHMNKHLGVKPFQCQFCDKCYSWKKDWYSHVKSHSVTEPYRCNICGKEFYEKALFRRHVKKATHGKKGRAKQNLERVCEKCGRKFTQLREYRRHMNNHEGVKPFECLTCGVAWADARSLKRHVRTHTGERPYVCPVCSEAYIDARTLRKHMTKFHRDYVPCKIMLEKDTLQFHNQGTQVAHAVSILTAGMQEQESSGPQELETVVVTGETMEALEAVAATEEYPSVSTLSDQSIMQVVNYVLAQQQGQKLSEVAEAIQTVKVEVAHISGGE

SEQ ID NO: 98496 - protein, 215 aa, Homo sapiens
  Payload ID: 19662
  Gene Name: zinc finger and BTB domain containing 11
  ENSP ID: ENSP00000417369
MSSEESYRAILRYLTNEREPYAPGTEGNVKRKIRKAAACYVVRGGTLYYQRRQRHRKTFAELEVVLQPERRRDLIEAAHLGPGGTHHTRHQTWHYLSKTYWWRGILKQVKDYIKQCSKCQEKLDRSRPISDVSEMLEELGLDLESGEESNESEDDLSNFTSSPTTASKPAKKKPVSKHELVFVSGTLQSALRFVTSVLVFAALVTYFSQTTKTAY

SEQ ID NO: 98497 - protein, 459 aa, Homo sapiens
  Payload ID: 19663
  Gene Name: zinc finger and BTB domain containing 12
  Uniprot ID: Q9Y330
  ENSP ID: ENSP00000364675
MASGVEVLRFQLPGHEAATLRNMNQLRAEERFCDVTIVADSLKFRGHKVILAACSPFLRDQFLLNPSSELQVSLMHSARIVADLLLSCYTGALEFAVRDIVNYLTAASYLQMEHVVEKCRNALSQFIEPKIGLKEDGVSEASLVSSISATKSLLPPARTPKPAPKPPPPPPLPPPLLRPVKLEFPLDEDLELKAEEEDEDEDEDVSDICIVKVESALEVAHRLKPPGGLGGGLGIGGSVGGHLGELAQSSVPPSTVAPPQGVVKACYSLSEDAEGEGLLLIPGGRASVGATSGLVEAAAVAMAARGAGGSLGAGGSRGPLPGGFSGGNPLKNIKCTKCPEVFQGVEKLVFHMRAQHFIFMCPRCGKQFNHSSNLNRHMNVHRGVKSHSCGICGKCFTQKSTLHDHLNLHSGARPYRCSYCDVRFAHKPAIRRHLKEQHGKTTAENVLEASVAEINVLIR

SEQ ID NO: 98498 - protein, 459 aa, Homo sapiens; identical to SEQ ID NO: 98497
  Payload ID: 19663
  Gene Name: zinc finger and BTB domain containing 12
  Uniprot ID: Q9Y330
  ENSP ID: ENSP00000364677

SEQ ID NO: 98499 - protein, 459 aa, Homo sapiens; identical to SEQ ID NO: 98497
  Payload ID: 19663
  Gene Name: zinc finger and BTB domain containing 12
  Uniprot ID: Q9Y330
  ENSP ID: ENSP00000391563

SEQ ID NO: 98500 - protein, 459 aa, Homo sapiens; identical to SEQ ID NO: 98497
  Payload ID: 19663
  Gene Name: zinc finger and BTB domain containing 12
  Uniprot ID: Q9Y330
  ENSP ID: ENSP00000392328

SEQ ID NO: 98501 - protein, 459 aa, Homo sapiens; identical to SEQ ID NO: 98497
  Payload ID: 19663
  Gene Name: zinc finger and BTB domain containing 12
  Uniprot ID: Q9Y330
  ENSP ID: ENSP00000414777

SEQ ID NO: 98502 - protein, 459 aa, Homo sapiens; identical to SEQ ID NO: 98497
  Payload ID: 19663
  Gene Name: zinc finger and BTB domain containing 12
  Uniprot ID: Q9Y330
  ENSP ID: ENSP00000478943

SEQ ID NO: 98503 - protein, 449 aa, Homo sapiens
  Payload ID: 19664
  Gene Name: zinc finger and BTB domain containing 14
  Uniprot ID: O43829
  ENSP ID: ENSP00000349503
MEFFISMSETIKYNDDDHKTLFLKTLNEQRLEGEFCDIAIVVEDVKFRAHRCVLAACSTYFKKLFKKLEVDSSSVIEIDFLRSDIFEEVLNYMYTAKISVKKEDVNLMMSSGQILGIRFLDKLCSQKRDVSSPDENNGQSKSKYCLKINRPIGDAADTQDDDVEEIGDQDDSPSDDTVEGTPPSQEDGKSPTTTLRVQEAILKELGSEEVRKVNCYGQEVESMETPESKDLGSQTPQALTFNDGMSEVKDEQTPGWTTAASDMKFEYLLYGHHREQIACQACGKTFSDEGRLRKHEKLHTADRPFVCEMCTKGFTTQAHLKEHLKIHTGYKPYSCEVCGKSFIRAPDLKKHERVHSNERPFACHMCDKAFKHKSHLKDHERRHRGEKPFVCGSCTKAFAKASDLKRHENNMHSERKQVTPSAIQSETEQLQAAAMAAEAEQQLETIACS

SEQ ID NO: 98504 - protein, 449 aa, Homo sapiens; identical to SEQ ID NO: 98503
  Payload ID: 19664
  Gene Name: zinc finger and BTB domain containing 14
  Uniprot ID: O43829
  ENSP ID: ENSP00000383009

SEQ ID NO: 98505 - protein, 102 aa, Homo sapiens
  Payload ID: 19664
  Gene Name: zinc finger and BTB domain containing 14
  ENSP ID: ENSP00000462112
MEFFISMSETIKYNDDDHKTLFLKTLNEQRLEGEFCDIAIVVEDVKFRAHRCVLAACSTYFKKLFKKLEVDSSSVIEIDFLRSDIFEEVLNYMYTAKISVKK

SEQ ID NO: 98506 - protein, 165 aa, Homo sapiens
  Payload ID: 19664
  Gene Name: zinc finger and BTB domain containing 14
  ENSP ID: ENSP00000463414
MEFFISMSETIKYNDDDHKTLFLKTLNEQRLEGEFCDIAIVVEDVKFRAHRCVLAACSTYFKKLFKKLEVDSSSVIEIDFLRSDIFEEVLNYMYTAKISVKKEDVNLMMSSGQILGIRFLDKLCSQKRDVSSPDENNGQSKSKYCLKINRPIGDAADTQDDDVEE

SEQ ID NO: 98507 - protein, 221 aa, Homo sapiens
  Payload ID: 19664
  Gene Name: zinc finger and BTB domain containing 14
  ENSP ID: ENSP00000463555
MEFFISMSETIKYNDDDHKTLFLKTLNEQRLEGEFCDIAIVVEDVKFRAHRCVLAACSTYFKKLFKKLEVDSSSVIEIDFLRSDIFEEVLNYMYTAKISVKKEDVNLMMSSGQILGIRFLDKLCSQKRDVSSPDENNGQSKSKYCLKINRPIGDAADTQDDDVEEIGDQDDSPSDDTVEGTPPSQEDGKSPTTTLRVQEAILKELGSEEVRKVNCYGQEVE

SEQ ID NO: 98508 - protein, 449 aa, Homo sapiens; identical to SEQ ID NO: 98503
  Payload ID: 19664
  Gene Name: zinc finger and BTB domain containing 14
  Uniprot ID: O43829
  ENSP ID: ENSP00000478971

SEQ ID NO: 98509 - protein, 449 aa, Homo sapiens; identical to SEQ ID NO: 98503
  Payload ID: 19664
  Gene Name: zinc finger and BTB domain containing 14
  Uniprot ID: O43829
  ENSP ID: ENSP00000484129

SEQ ID NO: 98510 - protein, 673 aa, Homo sapiens
  Payload ID: 19665
  Gene Name: zinc finger and BTB domain containing 16
  Uniprot ID: Q05516
  ENSP ID: ENSP00000338157
MDLTKMGMIQLQNPSHPTGLLCKANQMRLAGTLCDVVIMVDSQEFHAHRTVLACTSKMFEILFHRNSQHYTLDFLSPKTFQQILEYAYTATLQAKAEDLDDLLYAAEILEIEYLEEQCLKMLETIQASDDNDTEATMADGGAEEEEDRKARYLKNIFISKHSSEESGYASVAGQSLPGPMVDQSPSVSTSFGLSAMSPTKAAVDSLMTIGQSLLQGTLQPPAGPEEPTLAGGGRHPGVAEVKTEMMQVDEVPSQDSPGAAESSISGGMGDKVEERGKEGPGTPTRSSVITSARELHYGREESAEQVPPPAEAGQAPTGRPEHPAPPPEKHLGIYSVLPNHKADAVLSMPSSVTSGLHVQPALAVSMDFSTYGGLLPQGFIQRELFSKLGELAVGMKSESRTIGEQCSVCGVELPDNEAVEQHRKLHSGMKTYGCELCGKRFLDSLRLRMHLLAHSAGAKAFVCDQCGAQFSKEDALETHRQTHTGTDMAVFCLLCGKRFQAQSALQQHMEVHAGVRSYICSECNRTFPSHTALKRHLRSHTGDHPYECEFCGSCFRDESTLKSHKRIHTGEKPYECNGCGKKFSLKHQLETHYRVHTGEKPFECKLCHQRSRDYSAMIKHLRTHNGASPYQCTICTEYCPSLSSMQKHMKGHKPEEIPPDWRIEKTYLYLCYV

SEQ ID NO: 98511 - protein, 673 aa, Homo sapiens; identical to SEQ ID NO: 98510
  Payload ID: 19665
  Gene Name: zinc finger and BTB domain containing 16
  Uniprot ID: Q05516
  ENSP ID: ENSP00000376721

SEQ ID NO: 98512 - protein, 115 aa, Homo sapiens
  Payload ID: 19665
  Gene Name: zinc finger and BTB domain containing 16
  ENSP ID: ENSP00000437716
MDLTKMGMIQLQNPSHPTGLLCKANQMRLAGTLCDVVIMVDSQEFHAHRTVLACTSKMFEILFHRNSQHYTLDFLSPKTFQQILEYAYTATLQAKAEDLDDLLYAAEILEIEYLE

SEQ ID NO: 98513 - protein, 148 aa, Homo sapiens
  Payload ID: 19665
  Gene Name: zinc finger and BTB domain containing 16
  ENSP ID: ENSP00000443013
MDLTKMGMIQLQNPSHPTGLLCKANQMRLAGTLCDVVIMVDSQEFHAHRTVLACTSKMFEILFHRNSQHYTLDFLSPKTFQQILEYAYTATLQAKAEDLDDLLYAAEILEIEYLEEQCLKMLETIQASDDNDTEATMADGGAEEEEDR

SEQ ID NO: 98514 - protein, 55 aa, Homo sapiens
  Payload ID: 19665
  Gene Name: zinc finger and BTB domain containing 16
  ENSP ID: ENSP00000445047
  MOD_RES (1)..(1): Any amino acid
XGGLLPQGFIQRELFSKLGELAVGMKSESRTIGEQCSVCGVELPDNEAVEQHRVF

SEQ ID NO: 98515 - protein, 810 aa, Homo sapiens
  Payload ID: 19666
  Gene Name: zinc finger and BTB domain containing 17
  Uniprot ID: Q13105
  ENSP ID: ENSP00000364885
MDFPQHSQHVLEQLNQQRQLGLLCDCTFVVDGVHFKAHKAVLAACSEYFKMLFVDQKDVVHLDISNAAGLGQVLEFMYTAKLSLSPENVDDVLAVATFLQMQDIITACHALKSLAEPATSPGGNAEALATEGGDKRAKEEKVATSTLSRLEQAGRSTPIGPSRDLKEERGGQAQSAASGAEQTEKADAPREPPPVELKPDPTSGMAAAEAEAALSESSEQEMEVEPARKGEEEQKEQEEQEEEGAGPAEVKEEGSQLENGEAPEENENEESAGTDSGQELGSEARGLRSGTYGDRTESKAYGSVIHKCEDCGKEFTHTGNFKRHIRIHTGEKPFSCRECSKAFSDPAACKAHEKTHSPLKPYGCEECGKSYRLISLLNLHKKRHSGEARYRCEDCGKLFTTSGNLKRHQLVHSGEKPYQCDYCGRSFSDPTSKMRHLETHDTDKEHKCPHCDKKFNQVGNLKAHLKIHIADGPLKCRECGKQFTTSGNLKRHLRIHSGEKPYVCIHCQRQFADPGALQRHVRIHTGEKPCQCVMCGKAFTQASSLIAHVRQHTGEKPYVCERCGKRFVQSSQLANHIRHHDNIRPHKCSVCSKAFVNVGDLSKHIIIHTGEKPYLCDKCGRGFNRVDNLRSHVKTVHQGKAGIKILEPEEGSEVSVVTVDDMVTLATEALAATAVTQLTGPATLPAVVPVGAAVTADETEVLKAEISKAVKQVQEEDPNTHILYACDSCGDKFLDANSLAQHVRIHTAQALVMFQTDADFYQQYGPGGTWPAGQVLQAGELVFRPRDGAEGQPALAETSPTAPECPPPAE

SEQ ID NO: 98516 - protein, 803 aa, Homo sapiens
  Payload ID: 19666
  Gene Name: zinc finger and BTB domain containing 17
  Uniprot ID: Q13105
  ENSP ID: ENSP00000364895
MDFPQHSQHVLEQLNQQRQLGLLCDCTFVVDGVHFKAHKAVLAACSEYFKMLFVDQKDVVHLDISNAAGLGQVLEFMYTAKLSLSPENVDDVLAVATFLQMQDIITACHALKSLAEPATSPGGNAEALATEGGDKRAKEEKVATSTLSRLEQAGRSTPIGPSRDLKEERGGQAQSAASGAEQTEKADAPREPPPVELKPDPTSGMAAAEAEAALSESSEQEMEVEPARKGEEEQKEQEEQEEEGAGPAEVKEEGSQLENGEAPEENENEESAGTDSGQELGSEARGLRSGTYGDRTESKAYGSVIHKCEDCGKEFTHTGNFKRHIRIHTGEKPFSCRECSKAFSDPAACKAHEKTHSPLKPYGCEECGKSYRLISLLNLHKKRHSGEARYRCEDCGKLFTTSGNLKRHQLVHSGEKPYQCDYCGRSFSDPTSKMRHLETHDTDKEHKCPHCDKKFNQVGNLKAHLKIHIADGPLKCRECGKQFTTSGNLKRHLRIHSGEKPYVCIHCQRQFADPGALQRHVRIHTGEKPCQCVMCGKAFTQASSLIAHVRQHTGEKPYVCERCGKRFVQSSQLANHIRHHDNIRPHKCSVCSKAFVNVGDLSKHIIIHTGEKPYLCDKCGRGFNRVDNLRSHVKTVHQGKAGIKILEPEEGSEVSVVTVDDMVTLATEALAATAVTQLTVVPVGAAVTADETEVLKAEISKAVKQVQEEDPNTHILYACDSCGDKFLDANSLAQHVRIHTAQALVMFQTDADFYQQYGPGGTWPAGQVLQAGELVFRPRDGAEGQPALAETSPTAPECPPPAE

SEQ ID NO: 98517 - protein, 210 aa, Homo sapiens
  Payload ID: 19666
  Gene Name: zinc finger and BTB domain containing 17
  ENSP ID: ENSP00000400827
  MOD_RES (1)..(1): Any amino acid
XSKHIIIHTGEKPYLCDKCGRGFNRVDNLRSHVKTVHQGKAGIKILEPEEGSEVSVVTVDDMVTLATEALAATAVTQLTGPATLPAVVPVGAAVTADETEVLKAEISKAVKQVQEEDPNTHILYACDSCGDKFLDANSLAQHVRIHTAQALVMFQTDADFYQQYGPGGTWPAGQVLQAGELVFRPRDGAEGQPALAETSPTAPECPPPAE

SEQ ID NO: 98518 - protein, 241 aa, Homo sapiens
  Payload ID: 19666
  Gene Name: zinc finger and BTB domain containing 17
  ENSP ID: ENSP00000408483
  MOD_RES (1)..(1): Any amino acid
XEALPVRLLRPLLLRPHFQDAPPGDPRHGQGAQVPTLRQEVQPGNLKRHLRIHSGEKPYVCIHCQRQFADPGALQRHVRIHTGEKPCQCVMCGKAFTQASSLIAHVRQHTGEKPYVCERCGKRFVQSSQLANHIRHHDNIRPHKCSVCSKAFVNVGDLSKHIIIHTGEKPYLCDKCGRGFNRVDNLRSHVKTVHQGKAGIKILEPEEGSEVSVVTVDDMVTLATEALAATAVTQLTVVPVG

SEQ ID NO: 98519 - protein, 721 aa, Homo sapiens
  Payload ID: 19666
  Gene Name: zinc finger and BTB domain containing 17
  Uniprot ID: Q13105
  ENSP ID: ENSP00000438529
MMCWPWPLSSKCRTSSRPAMPSSHLLSRLPALGEMRRPWPQKVCPVPSPGGDKRAKEEKVATSTLSRLEQAGRSTPIGPSRDLKEERGGQAQSAASGAEQTEKADAPREPPPVELKPDPTSGMAAAEAEAALSESSEQEMEVEPARKGEEEQKEQEEQEEEGAGPAEVKEEGSQLENGEAPEENENEESAGTDSGQELGSEARGLRSGTYGDRTESKAYGSVIHKCEDCGKEFTHTGNFKRHIRIHTGEKPFSCRECSKAFSDPAACKAHEKTHSPLKPYGCEECGKSYRLISLLNLHKKRHSGEARYRCEDCGKLFTTSGNLKRHQLVHSGEKPYQCDYCGRSFSDPTSKMRHLETHDTDKEHKCPHCDKKFNQVGNLKAHLKIHIADGPLKCRECGKQFTTSGNLKRHLRIHSGEKPYVCIHCQRQFADPGALQRHVRIHTGEKPCQCVMCGKAFTQASSLIAHVRQHTGEKPYVCERCGKRFVQSSQLANHIRHHDNIRPHKCSVCSKAFVNVGDLSKHIIIHTGEKPYLCDKCGRGFNRVDNLRSHVKTVHQGKAGIKILEPEEGSEVSVVTVDDMVTLATEALAATAVTQLTVVPVGAAVTADETEVLKAEISKAVKQVQEEDPNTHILYACDSCGDKFLDANSLAQHVRIHTAQALVMFQTDADFYQQYGPGGTWPAGQVLQAGELVFRPRDGAEGQPALAETSPTAPECPPPAE

SEQ ID NO: 98520 - protein, 531 aa, Homo sapiens
  Payload ID: 19667
  Gene Name: zinc finger and BTB domain containing 18
  Uniprot ID: Q99592
  ENSP ID: ENSP00000351539
MCPKGYEDSMEFPDHSRHLLQCLSEQRHQGFLCDCTVLVGDAQFRAHRAVLASCSMYFHLFYKDQLDKRDIVHLNSDIVTAPAFALLLEFMYEGKLQFKDLPIEDVLAAASYLHMYDIVKVCKKKLKEKATTEADSTKKEEDASSCSDKVESLSDGSSHIAGDLPSDEDEGEDEKLNILPSKRDLAAEPGNMWMRLPSDSAGIPQAGGEAEPHATAAGKTVASPCSSTESLSQRSVTSVRDSADVDCVLDLSVKSSLSGVENLNSSYFSSQDVLRSNLVQVKVEKEASCDESDVGTNDYDMEHSTVKESVSTNNRVQYEPAHLAPLREDSVLRELDREDKASDDEMMTPESERVQVEGGMESSLLPYVSNILSPAGQIFMCPLCNKVFPSPHILQIHLSTHFREQDGIRSKPAADVNVPTCSLCGKTFSCMYTLKRHERTHSGEKPYTCTQCGKSFQYSHNLSRHAVVHTREKPHACKWCERRFTQSGDLYRHIRKFHCELVNSLSVKSEALSLPTVRDWTLEDSSQELWK

SEQ ID NO: 98521 - protein, 522 aa, Homo sapiens
  Payload ID: 19667
  Gene Name: zinc finger and BTB domain containing 18
  Uniprot ID: Q99592
  ENSP ID: ENSP00000481278
MEFPDHSRHLLQCLSEQRHQGFLCDCTVLVGDAQFRAHRAVLASCSMYFHLFYKDQLDKRDIVHLNSDIVTAPAFALLLEFMYEGKLQFKDLPIEDVLAAASYLHMYDIVKVCKKKLKEKATTEADSTKKEEDASSCSDKVESLSDGSSHIAGDLPSDEDEGEDEKLNILPSKRDLAAEPGNMWMRLPSDSAGIPQAGGEAEPHATAAGKTVASPCSSTESLSQRSVTSVRDSADVDCVLDLSVKSSLSGVENLNSSYFSSQDVLRSNLVQVKVEKEASCDESDVGTNDYDMEHSTVKESVSTNNRVQYEPAHLAPLREDSVLRELDREDKASDDEMMTPESERVQVEGGMESSLLPYVSNILSPAGQIFMCPLCNKVFPSPHILQIHLSTHFREQDGIRSKPAADVNVPTCSLCGKTFSCMYTLKRHERTHSGEKPYTCTQCGKSFQYSHNLSRHAVVHTREKPHACKWCERRFTQSGDLYRHIRKFHCELVNSLSVKSEALSLPTVRDWTLEDSSQELWK

SEQ ID NO: 98522 - protein, 514 aa, Homo sapiens
  Payload ID: 19668
  Gene Name: zinc finger and BTB domain containing 2
  Uniprot ID: Q8N680
  ENSP ID: ENSP00000323183
MDLANHGLILLQQLNAQREFGFLCDCTVAIGDVYFKAHKSVLASFSNYFKMLFVHQTSECVRLKPTDIQPDIFSYLLHLMYTGKMAPQLIDPVRLEQGIKFLHAYPLIQEASLASQGAFSHPDQVFPLASSLYGIQIADHQLRQATKIASAPEKLGRDPRPQTSRISQEQVPEASQLSQLTSNLAQVNRTNMTPSDPLQTSLSPELVSTPVPPPPPGEETNLEASSSDEQPASLTIAHVKPSIMKRNGSFPKYYACHLCGRRFTLRSSLREHLQIHTGVPFTSSQQGESRVPLTLCSNAADLGKDAMEVPEAGMISDSELQHISDSPIIDGQQQSETPPPSDIADIDNLEQADQEREVKRRKYECTICGRKFIQKSHWREHMYIHTGKPFKCSTCDKSFCRANQAARHVCLNQSIDTYTMVDKQTLELCTFEEGSQMDNMLVQTNKPYKCNLCDKTFSTPNEVVKHSCQNQNSDVFALDEGRSILLGSGDSEVTEPDHPVLASIKKEQETVLLD

SEQ ID NO: 98523 - protein, 668 aa, Homo sapiens
  Payload ID: 19669
  Gene Name: zinc finger and BTB domain containing 20
  Uniprot ID: Q9HC78
  ENSP ID: ENSP00000349803
MTERIHSINLHNFSNSVLETLNEQRNRGHFCDVTVRIHGSMLRAHRCVLAAGSPFFQDKLLLGYSDIEIPSVVSVQSVQKLIDFMYSGVLRVSQSEALQILTAASILQIKTVIDECTRIVSQNVGDVFPGIQDSGQDTPRGTPESGTSGQSSDTESGYLQSHPQHSVDRIYSALYACSMQNGSGERSFYSGAVVSHHETALGLPRDHHMEDPSWITRIHERSQQMERYLSTTPETTHCRKQPRPVRIQTLVGNIHIKQEMEDDYDYYGQQRVQILERNESEECTEDTDQAEGTESEPKGESFDSGVSSSIGTEPDSVEQQFGPGAARDSQAEPTQPEQAAEAPAEGGPQTNQLETGASSPERSNEVEMDSTVITVSNSSDKSVLQQPSVNTSIGQPLPSTQLYLRQTETLTSNLRMPLTLTSNTQVIGTAGNTYLPALFTTQPAGSGPKPFLFSLPQPLAGQQTQFVTVSQPGLSTFTAQLPAPQPLASSAGHSTASGQGEKKPYECTLCNKTFTAKQNYVKHMFVHTGEKPHQCSICWRSFSLKDYLIKHMVTHTGVRAYQCSICNKRFTQKSSLNVHMRLHRGEKSYECYICKKKFSHKTLLERHVALHSASNGTPPAGTPPGARAGPPGVVACTEGTTYVCSVCPAKFDQIEQFNDHMRMHVSDG

SEQ ID NO: 98524 - protein, 668 aa, Homo sapiens; identical to SEQ ID NO: 98523
  Payload ID: 19669
  Gene Name: zinc finger and BTB domain containing 20
  Uniprot ID: Q9HC78
  ENSP ID: ENSP00000377375

SEQ ID NO: 98525 - protein, 668 aa, Homo sapiens; identical to SEQ ID NO: 98523
  Payload ID: 19669
  Gene Name: zinc finger and BTB domain containing 20
  Uniprot ID: Q9HC78
  ENSP ID: ENSP00000417307

SEQ ID NO: 98526 - protein, 668 aa, Homo sapiens; identical to SEQ ID NO: 98523
  Payload ID: 19669
  Gene Name: zinc finger and BTB domain containing 20
  Uniprot ID: Q9HC78
  ENSP ID: ENSP00000418092

SEQ ID NO: 98527 - protein, 741 aa, Homo sapiens
  Payload ID: 19669
  Gene Name: zinc finger and BTB domain containing 20
  Uniprot ID: Q9HC78
  ENSP ID: ENSP00000419153
MLERKKPKTAENQKASEENEITQPGGSSAKPGLPCLNFEAVLSPDPALIHSTHSLTNSHAHTGSSDCDISCKGMTERIHSINLHNFSNSVLETLNEQRNRGHFCDVTVRIHGSMLRAHRCVLAAGSPFFQDKLLLGYSDIEIPSVVSVQSVQKLIDFMYSGVLRVSQSEALQILTAASILQIKTVIDECTRIVSQNVGDVFPGIQDSGQDTPRGTPESGTSGQSSDTESGYLQSHPQHSVDRIYSALYACSMQNGSGERSFYSGAVVSHHETALGLPRDHHMEDPSWITRIHERSQQMERYLSTTPETTHCRKQPRPVRIQTLVGNIHIKQEMEDDYDYYGQQRVQILERNESEECTEDTDQAEGTESEPKGESFDSGVSSSIGTEPDSVEQQFGPGAARDSQAEPTQPEQAAEAPAEGGPQTNQLETGASSPERSNEVEMDSTVITVSNSSDKSVLQQPSVNTSIGQPLPSTQLYLRQTETLTSNLRMPLTLTSNTQVIGTAGNTYLPALFTTQPAGSGPKPFLFSLPQPLAGQQTQFVTVSQPGLSTFTAQLPAPQPLASSAGHSTASGQGEKKPYECTLCNKTFTAKQNYVKHMFVHTGEKPHQCSICWRSFSLKDYLIKHMVTHTGVRAYQCSICNKRFTQKSSLNVHMRLHRGEKSYECYICKKKFSHKTLLERHVALHSASNGTPPAGTPPGARAGPPGVVACTEGTTYVCSVCPAKFDQIEQFNDHMRMHVSDG

SEQ ID NO: 98528 - protein, 19 aa, Homo sapiens
  Payload ID: 19669
  Gene Name: zinc finger and BTB domain containing 20
  ENSP ID: ENSP00000419480
MLERKKPKTAENQKASEEN

SEQ ID NO: 98529 - protein, 668 aa, Homo sapiens; identical to SEQ ID NO: 98523
  Payload ID: 19669
  Gene Name: zinc finger and BTB domain containing 20
  Uniprot ID: Q9HC78
  ENSP ID: ENSP00000419902

SEQ ID NO: 98530 - protein, 668 aa, Homo sapiens; identical to SEQ ID NO: 98523
  Payload ID: 19669
  Gene Name: zinc finger and BTB domain containing 20
  Uniprot ID: Q9HC78
  ENSP ID: ENSP00000420324

SEQ ID NO: 98531 - protein, 57 aa, Homo sapiens
  Payload ID: 19669
  Gene Name: zinc finger and BTB domain containing 20
  ENSP ID: ENSP00000420684
MTERIHSINLHNFSNSVLETLNEQRNRGHFCDVTVRIHGSMLRAHRCVLAAGSPFFQ

SEQ ID NO: 98532 - protein, 1066 aa, Homo sapiens
  Payload ID: 19670
  Gene Name: zinc finger and BTB domain containing 21
  Uniprot ID: Q9ULJ3
  ENSP ID: ENSP00000308759
MEGLLHYINPAHAISLLSALNEERLKGQLCDVLLIVGDQKFRAHKNVLAASSEYFQSLFTNKENESQTVFQLDFCEPDAFDNVLNYIYSSSLFVEKSSLAAVQELGYSLGISFLTNIVSKTPQAPFPTCPNRKKVFVEDDENSSQKRSVIVCQSRNEAQGKTVSQNQPDVSHTSRPSPSIAVKANTNKPHVPKPIEPLHNLSLTEKSWPKDSSVVYAKSLEHSGSLDDPNRISLVKRNAVLPSKPLQDREAMDDKPGVSGQLPKGKALELALKRPRPPVLSVCSSSETPYLLKETNKGNGQGEDRNLLYYSKLGLVIPSSGSGSGNQSIDRSGPLVKSLLRRSLSMDSQVPVYSPSIDLKSSQGSSSVSSDAPGNVLCALSQKSSLKDCSEKTALDDRPQVLQPHRLRSFSASQSTDREGASPVTEVRIKTEPSSPLSDPSDIIRVTVGDAATTAAASSSSVTRDLSLKTEDDQKDMSRLPAKRRFQADRRLPFKKLKVNEHGSPVSEDNFEEGSSPTLLDADFPDSDLNKDEFGELEGTRPNKKFKCKHCLKIFRSTAGLHRHVNMYHNPEKPYACDICHKRFHTNFKVWTHCQTQHGIVKNPSPASSSHAVLDEKFQRKLIDIVREREIKKALIIKLRRGKPGFQGQSSSQAQQVIKRNLRSRAKGAYICTYCGKAYRFLSQFKQHIKMHPGEKPLGVNKVAKPKEHAPLASPVENKEVYQCRLCNAKLSSLLEQGSHERLCRNAAVCPYCSLRFFSPELKQEHESKCEYKKLTCLECMRTFKSSFSIWRHQVEVHNQNNMAPTENFSLPVLDHNGDVTGSSRPQSQPEPNKVNHIVTTKDDNVFSDSSEQVNFDSEDSSCLPEDLSLSKQLKIQVKEEPVEEAEEEAPEASTAPKEAGPSKEASLWPCEKCGKMFTVHKQLERHQELLCSVKPFICHVCNKAFRTNFRLWSHFQSHMSQASEESAHKESEVCPVPTNSPSPPPLPPPPPLPKIQPLEPDSPTGLSENPTPATEKLFVPQESDTLFYHAPPLSAITFKRQFMCKLCHRTFKTAFSLWSHEQTHN

SEQ ID NO: 98533 - protein, 49 aa, Homo sapiens
  Payload ID: 19670
  Gene Name: zinc finger and BTB domain containing 21
  ENSP ID: ENSP00000381510
MEGLLHYINPAHAISLLSALNEERLKGQLCDVLLIVGDQKFRAHKNVLA

SEQ ID NO: 98534 - protein, 1066 aa, Homo sapiens; identical to SEQ ID NO: 98532
  Payload ID: 19670
  Gene Name: zinc finger and BTB domain containing 21
  Uniprot ID: Q9ULJ3
  ENSP ID: ENSP00000381512

SEQ ID NO: 98535 - protein, 865 aa, Homo sapiens
  Payload ID: 19670
  Gene Name: zinc finger and BTB domain containing 21
  Uniprot ID: Q9ULJ3
  ENSP ID: ENSP00000381517
MEGLLHYINPAHAISLLSALNEERLKGQLCDVLLIVGDQKFRAHKNVLAASSEYFQSLFTNKENESQTVFQLDFCEPDAFDNVLNYIYSSSLFVEKSSLAAVQELGYSLGISFLTNIVSKTPQAPFPTCPNRKKVFVEDDENSSQKRSVIVCQSRNEAQGKTVSQNQPDVSHTSRPSPSIAVKANTNKPHVPKPIEPLHNLSLTEKSWPKDSSVVYAKSLEHSGSLDDPNRISLVKRNAVLPSKPLQDREAMDDKPGVSGQLPKGKALELALKRPRPPVLSVCSSSETPYLLKETNKGNGQGEDRNLLYYSKLGLVIPSSGSGSGNQSIDRSGPLVKSLLRRSLSMDSQVPVYSPSIDLKSSQGSSSVSSDAPGNVLCALSQKSSLKDCSEKTALDDRPQVLQPHRLRSFSASQSTDREGASPVTEVRIKTEPSSPLSDPSDIIRVTVGDAATTAAASSSSVTRDLSLKTEDDQKDMSRLPAKRRFQADRRLPFKKLKVNEHGSPVSEDNFEEGSSPTLLDADFPDSDLNKDEFEQGSHERLCRNAAVCPYCSLRFFSPELKQEHESKCEYKKLTCLECMRTFKSSFSIWRHQVEVHNQNNMAPTENFSLPVLDHNGDVTGSSRPQSQPEPNKVNHIVTTKDDNVFSDSSEQVNFDSEDSSCLPEDLSLSKQLKIQVKEEPVEEAEEEAPEASTAPKEAGPSKEASLWPCEKCGKMFTVHKQLERHQELLCSVKPFICHVCNKAFRTNFRLWSHFQSHMSQASEESAHKESEVCPVPTNSPSPPPLPPPPPLPKIQPLEPDSPTGLSENPTPATEKLFVPQESDTLFYHAPPLSAITFKRQFMCKLCHRTFKTAFSLWSHEQTHN

SEQ ID NO: 98536 - protein, 1066 aa, Homo sapiens; identical to SEQ ID NO: 98532
  Payload ID: 19670
  Gene Name: zinc finger and BTB domain containing 21
  Uniprot ID: Q9ULJ3
  ENSP ID: ENSP00000381523

SEQ ID NO: 98537 - protein, 118 aa, Homo sapiens
  Payload ID: 19670
  Gene Name: zinc finger and BTB domain containing 21
  ENSP ID: ENSP00000387788
MEGLLHYINPAHAISLLSALNEERLKGQLCDVLLIVGDQKFRAHKNVLAASSEYFQSLFTNKENESQTVFQLDFCEPDAFDNVLNYIYSSSLFVEKSSLAAVQELGYSLGISFLTNIV

SEQ ID NO: 98538 - protein, 49 aa, Homo sapiens; identical to SEQ ID NO: 98533
  Payload ID: 19670
  Gene Name: zinc finger and BTB domain containing 21
  ENSP ID: ENSP00000395186

SEQ ID NO: 98539 - protein, 634 aa, Homo sapiens
  Payload ID: 19671
  Gene Name: zinc finger and BTB domain containing 22
  Uniprot ID: O15209
  ENSP ID: ENSP00000372683
MEPSPLSPSGAALPLPLSLAPPPLPLPAAAVVHVSFPEVTSALLESLNQQRLQGQLCDVSIRVQGREFRAHRAVLAASSPYFHDQVLLKGMTSISLPSVMDPGAFETVLASAYTGRLSMAAADIVNFLTVGSVLQMWHIVDKCTELLREGRASATTTITTAAATSVTVPGAGVPSGSGGTVAPATMGSARSHASSRASENQSPSSSNYFSPRESTDFSSSSQEAFAASAVGSGERRGGGPVFPAPVVGSGGATSGKLLLEADELCDDGGDGRGAVVPGAGLRRPTYTPPSIMPQKHWVYVKRGGNCPAPAPLVPQDPDLEEEEEEEDLVLTCEDDEDEELGGSSRVPVGGGPEATLSISDVRTLSEPPDKGEEQVNFCESSNDFGPYEGGGPVAGLDDSGGPTPSSYAPSHPPRPLLPLDMQGNQILVFPSSSSSSSSQAPGQPPGNQAEHGAVTVGGTSVGSLGVPGSVGGVPGGTGSGDGNKIFLCHCGKAFSHKSMRDRHVNMHLNLRPFDCPVCNKKFKMKHHLTEHMKTHTGLKPYECGVCAKKFMWRDSFMRHRGHCERRHRLGGVGAVPGPGTPTGPSLPSKRESPGVGGGSGDEASAATPPSSRRVWSPPRVHKVEMGFGGGGGAN

SEQ ID NO: 98540 - protein, 634 aa, Homo sapiens; identical to SEQ ID NO: 98539
  Payload ID: 19671
  Gene Name: zinc finger and BTB domain containing 22
  Uniprot ID: O15209
  ENSP ID: ENSP00000388191

SEQ ID NO: 98541 - protein, 149 aa, Homo sapiens
  Payload ID: 19671
  Gene Name: zinc finger and BTB domain containing 22
  ENSP ID: ENSP00000391135
MEPSPLSPSGAALPLPLSLAPPPLPLPAAAVVHVSFPEVTSALLESLNQQRLQGQLCDVSIRVQGREFRAHRAVLAASSPYFHDQVLLKGMTSISLPSVMDPGAFETVLASAYTGRLSMAAADIVNFLTVGSVLQMWHIVDKCTELLRE

SEQ ID NO: 98542 - protein, 634 aa, Homo sapiens; identical to SEQ ID NO: 98539
  Payload ID: 19671
  Gene Name: zinc finger and BTB domain containing 22
  Uniprot ID: O15209
  ENSP ID: ENSP00000393514

SEQ ID NO: 98543 - protein, 149 aa, Homo sapiens; identical to SEQ ID NO: 98541
  Payload ID: 19671
  Gene Name: zinc finger and BTB domain containing 22
  ENSP ID: ENSP00000394349

SEQ ID NO: 98544 - protein, 634 aa, Homo sapiens
  Payload ID: 19671
  Gene Name: zinc finger and BTB domain containing 22
  Uniprot ID: O15209
  ENSP ID: ENSP00000396292
MEPSPLSPSGAALPLPLSLAPPPLPLPAAAVVHVSFPEVTSALLESLNQQRLQGQLCDVSIRVQGREFRAHRAVLAASSPYFHDQVLLKGMTSISLPSVMDPGAFETVLASAYTGRLSMAAADIVNFLTVGSVLQMWHIVDKCTELLREGRASATTTITTAAATSVTVPGAGVPSGSGGTVAPATMGSARSHASSRASENQSPSSSNYFSPRESTDFSSSSQEAFAASAVGSGERRGGGPVFPAPVVGSGGATSGKLLLEADELCDDGGDGRGAVVPGAGLRRPTYTPPSIMPQKHWVYVKRGGNCPAPTPLVPQDPDLEEEEEEEDLVLTCEDDEDEELGGSSRVPVGGGPEATLSISDVRTLSEPPDKGEEQVNFCESSNDFGPYEGGGPVAGLDDSGGPTPSSYAPSHPPRPLLPLDMQGNQILVFPSSSSSSSSQAPGQPPGNQAEHGAVTVGGTSVGSLGVPGSVGGVPGGTGSGDGNKIFLCHCGKAFSHKSMRDRHVNMHLNLRPFDCPVCNKKFKMKHHLTEHMKTHTGLKPYECGVCAKKFMWRDSFMRHRGHCERRHRLGGVGAVPGPGTPTGPSLPSKRESPGVGGGSGDEASAATPPSSRRVWSPPRVHKVEMGFGGGGGAN

SEQ ID NO: 98545 - protein, 149 aa, Homo sapiens; identical to SEQ ID NO: 98541
  Payload ID: 19671
  Gene Name: zinc finger and BTB domain containing 22
  ENSP ID: ENSP00000402785

SEQ ID NO: 98546 - protein, 634 aa, Homo sapiens; identical to SEQ ID NO: 98544
  Payload ID: 19671
  Gene Name: zinc finger and BTB domain containing 22
  Uniprot ID: O15209
  ENSP ID: ENSP00000404403

SEQ ID NO: 98547 - protein, 634 aa, Homo sapiens; identical to SEQ ID NO: 98544
  Payload ID: 19671
  Gene Name: zinc finger and BTB domain containing 22
  Uniprot ID: O15209
  ENSP ID: ENSP00000407545

SEQ ID NO: 98548 - protein, 149 aa, Homo sapiens; identical to SEQ ID NO: 98541
  Payload ID: 19671
  Gene Name: zinc finger and BTB domain containing 22
  ENSP ID: ENSP00000412427

SEQ ID NO: 98549 - protein, 149 aa, Homo sapiens; identical to SEQ ID NO: 98541
  Payload ID: 19671
  Gene Name: zinc finger and BTB domain containing 22
  ENSP ID: ENSP00000413172

SEQ ID NO: 98550 - protein, 697 aa, Homo sapiens
  Payload ID: 19672
  Gene Name: zinc finger and BTB domain containing 24
  Uniprot ID: O43167
  ENSP ID: ENSP00000230122
MAETSPEPSGQLVVHSDAHSDTVLASFEDQRKKGFLCDITLIVENVHFRAHKALLAASSEYFSMMFAEEGEIGQSIYMLEGMVADTFGILLEFIYTGYLHASEKSTEQILATAQFLKVYDLVKAYTDFQNNHSSPKPTTLNTAGAPVVVISNKKNDPPKRKRGRPKKVNTLQEEKSELAAEEEIQLRVNNSVQNRQNFVVKGDSGVLNEQIAAKEKEESEPTCEPSREEEMPVEKDENYDPKTEDGQASQSRYSKRRIWRSVKLKDYKLVGDQEDHGSAKRICGRRKRPGGPEARCKDCGKVFKYNHFLAIHQRSHTGERPFKCNECGKGFAQKHSLQVHTRMHTGERPYTCTVCSKALTTKHSLLEHMSLHSGQKSFTCDQCGKYFSQNRQLKSHYRVHTGHSLPECKDCHRKFMDVSQLKKHLRTHTGEKPFTCEICGKSFTAKSSLQTHIRIHRGEKPYSCGICGKSFSDSSAKRRHCILHTGKKPFSCPECNLQFARLDNLKAHLKIHSKEKHASDASSISGSSNTEEVRNILQLQPYQLSTSGEQEIQLLVTDSVHNINFMPGPSQGISIVTAESSQNMTADQAANLTLLTQQPEQLQNLILSAQQEQTEHIQSLNMIESQMGPSQTEPVHVITLSKETLEHLHAHQEQTEELHLATSTSDPAQHLQLTQEPGPPPPTHHVPQPTPLGQEQS

SEQ ID NO: 98551 - protein, 435 aa, Homo sapiens
  Payload ID: 19673
  Gene Name: zinc finger and BTB domain containing 25
  Uniprot ID: P24278
  ENSP ID: ENSP00000378204
MDTASHSLVLLQQLNMQREFGFLCDCTVAIGDVYFKAHRAVLAAFSNYFKMIFIHQTSECIKIQPTDIQPDIFSYLLHIMYTGKGPKQIVDHSRLEEGIRFLHADYLSHIATEMNQVFSPETVQSSNLYGIQISTTQKTVVKQGLEVKEAPSSNSGNRAAVQGDHPQLQLSLAIGLDDGTADQQRACPATQALEEHQKPPVSIKQERCDPESVISQSHPSPSSEVTGPTFTENSVKIHLCHYCGERFDSRSNLRQHLHTHVSGSLPFGVPASILESNDLGEVHPLNENSEALECRRLSSFIVKENEQQPDHTNRGTTEPLQISQVSLISKDTEPVELNCNFSFSRKRKMSCTICGHKFPRKSQLLEHMYTHKGKSYRYNRCQRFGNALAQRFQPYCDSWSDVSLKSSRLSQEHLDLPCALESELTQENVDTILVE

SEQ ID NO: 98552 - protein, 86 aa, Homo sapiens
  Payload ID: 19673
  Gene Name: zinc finger and BTB domain containing 25
  ENSP ID: ENSP00000450718
MDTASHSLVLLQQLNMQREFGFLCDCTVAIGDVYFKAHRAVLAAFSNYFKMIFIHQTRQQITHLEVIKELEAAGCLCCSLDGLSQG

SEQ ID NO: 98553 - protein, 94 aa, Homo sapiens
  Payload ID: 19673
  Gene Name: zinc finger and BTB domain containing 25
  ENSP ID: ENSP00000451046
MDTASHSLVLLQQLNMQREFGFLCDCTVAIGDVYFKAHRAVLAAFSNYFKMIFIHQTRKRKMSCTICGHKFPRKSQLLEHMYTHKDSKSPTLRS

SEQ ID NO: 98554 - protein, 435 aa, Homo sapiens; identical to SEQ ID NO: 98551
  Payload ID: 19673
  Gene Name: zinc finger and BTB domain containing 25
  Uniprot ID: P24278
  ENSP ID: ENSP00000476746

SEQ ID NO: 98555 - protein, 441 aa, Homo sapiens
  Payload ID: 19674
  Gene Name: zinc finger and BTB domain containing 26
  Uniprot ID: Q9HCK0
  ENSP ID: ENSP00000362758
MSERSDLLHFKFENYGDSMLQKMNKLREENKFCDVTVLIDDIEVQGHKIVFAAGSPFLRDQFLLNDSREVKISILQSSEVGRQLLLSCYSGVLEFPEMELVNYLTAASFLQMSHIVERCTQALWKFIKPKQPMDSKEGCEPQSASPQSKEQQGDARGSPKQDSPCIHPSEDSMDMEDSDIQIVKVESIGDVSEVRSKKDQNQFISSEPTALHSSEPQHSLINSTVENRVSEIEQNHLHNYALSYTGSDNIIMASKDVFGPNIRGVDKGLQWHHQCPKCTRVFRHLENYANHLKMHKLFMCLLCGKTFTQKGNLHRHMRVHAGIKPFQCKICGKTFSQKCSLQDHLNLHSGDKPHKCNYCDMVFAHKPVLRKHLKQLHGKNSFDNANERNVQDLTVDFDSFACTTVTDSKGCQPQPDATQVLDAGKLAQAVLNLRNDSTCVN

SEQ ID NO: 98556 - protein, 441 aa, Homo sapiens; identical to SEQ ID NO: 98555
  Payload ID: 19674
  Gene Name: zinc finger and BTB domain containing 26
  Uniprot ID: Q9HCK0
  ENSP ID: ENSP00000362760

SEQ ID NO: 98557 - protein, 574 aa, Homo sapiens
  Payload ID: 19675
  Gene Name: zinc finger and BTB domain containing 3
  Uniprot ID: Q9H5J0
  ENSP ID: ENSP00000378286
MLREFSKWGVEASPGKAWERKRSLLRGAVGRYRGATGGDLFWAPFPSWGTMEFPEHSQQLLQSLREQRSQGFLCDCTVMVGSTQFLAHRAVLASCSPFFQLFYKERELDKRDLVCIHNEIVTAPAFGLLLDFMYAGQLTLRGDTPVEDVLAAASYLHMNDIVKVCKRRLQARALAEADSTKKEEETNSQLPSLEFLSSTSRGTQPSLASAETSGHWGKGEWKGSAAPSPTVRPPDEPPMSSGADTTQPGMEVDAPHLRAPHPPVADVSLASPSSSTETIPTNYFSSGISAVSLEPLPSLDVGPESLRVVEPKDPGGPLQGFYPPASAPTSAPAPVSAPVPSQAPAPAEAELVQVKVEAIVISDEETDVSDEQPQGPERAFPSGGAVYGAQPSQPEAFEDPGAAGLEEVGPSDHFLPTDPHLPYHLLPGAGQYHRGLVTSPLPAPASLHEPLYLSSEYEAAPGSFGVFTEDVPTCKTCGKTFSCSYTLRRHATVHTRERPYECRYCLRSYTQSGDLYRHIRKAHNEDLAKRSKPDPEVGPLLGVQPLPGSPTADRQSSSGGGPPKDFVLAPKTNI

SEQ ID NO: 98558 - protein, 115 aa, Homo sapiens
  Payload ID: 19675
  Gene Name: zinc finger and BTB domain containing 3
  ENSP ID: ENSP00000432731
MEFPEHSQQLLQSLREQRSQGFLCDCTVMVGSTQFLAHRAVLASCSPFFQLFYKERELDKRDLVCIHNEIVTAPAFGLLLDFMYAGQLTLRGDTPVEDVLAAASYLHMNDIVKVC

SEQ ID NO: 98559 - protein, 3 aa, Homo sapiens
  Payload ID: 19675
  Gene Name: zinc finger and BTB domain containing 3
  ENSP ID: ENSP00000433691
  MOD_RES (1)..(1): Any amino acid
XNI

SEQ ID NO: 98560 - protein, 487 aa, Homo sapiens
  Payload ID: 19676
  Gene Name: zinc finger and BTB domain containing 32
  Uniprot ID: Q9Y2Y4
  ENSP ID: ENSP00000262630
MSLPPIRLPSPYGSDRLVQLAARLRPALCDTLITVGSQEFPAHSLVLAGVSQQLGRRGQWALGEGISPSTFAQLLNFVYGESVELQPGELRPLQEAARALGVQSLEEACWRARGDRAKKPDPGLKKHQEEPEKPSRNPERELGDPGEKQKPEQVSRTGGREQEMLHKHSPPRGRPEMAGATQEAQQEQTRSKEKRLQAPVGQRGADGKHGVLTWLRENPGGSEESLRKLPGPLPPAGSLQTSVTPRPSWAEAPWLVGGQPALWSILLMPPRYGIPFYHSTPTTGAWQEVWREQRIPLSLNAPKGLWSQNQLASSSPTPGSLPQGPAQLSPGEMEESDQGHTGALATCAGHEDKAGCPPRPHPPPAPPARSRPYACSVCGKRFSLKHQMETHYRVHTGEKPFSCSLCPQRSRDFSAMTKHLRTHGAAPYRCSLCGAGCPSLASMQAHMRGHSPSQLPPGWTIRSTFLYSSSRPSRPSTSPCCPSSSTT

SEQ ID NO: 98561 - protein, 487 aa, Homo sapiens; identical to SEQ ID NO: 98560
  Payload ID: 19676
  Gene Name: zinc finger and BTB domain containing 32
  Uniprot ID: Q9Y2Y4
  ENSP ID: ENSP00000376035

SEQ ID NO: 98562 - protein, 302 aa, Homo sapiens
  Payload ID: 19676
  Gene Name: zinc finger and BTB domain containing 32
  ENSP ID: ENSP00000433657
MSLPPIRLPSPYGSDRLVQLAARLRPALCDTLITVGSQEFPAHSLVLAGVSQQLGRRGQWALGEGISPSTFAQLLNFVYGESVELQPGELRPLQEAARALGVQSLEEACWRARGDRAKKPDPGLKKHQEEPEKPSRNPERELGDPGEKQKPEQVSRTGGREQEMLHKHSPPRGRPEMAGATQEAQQEQTRSKEKRLQAPVGQRGADGKHGVLTWLRENPGGSEESLRKLPGPLPPAGSLQTSVTPRPSWAEAPWLVGGQPALWSILLMPPRYGIPFYHSTPTTGAWQEVWREQRRTCNLCGS

SEQ ID NO: 98563 - protein, 71 aa, Homo sapiens
  Payload ID: 19676
  Gene Name: zinc finger and BTB domain containing 32
  ENSP ID: ENSP00000466524
MEESDQGHTGALATCAGHEDKAGCPPRPHPPPAPPARSRPYACSVCGKRFSLKHQMETHYRVHTGEKPFSC

SEQ ID NO: 98564 - protein, 672 aa, Homo sapiens
  Payload ID: 19677
  Gene Name: zinc finger and BTB domain containing 33
  Uniprot ID: Q86T24
  ENSP ID: ENSP00000314153
MESRKLISATDIQYSGSLLNSLNEQRGHGLFCDVTVIVEDRKFRAHKNILSASSTYFHQLFSVAGQVVELSFIRAEIFAEILNYIYSSKIVRVRSDLLDELIKSGQLLGVKFIAELGVPLSQVKSISGTAQDGNTEPLPPDSGDKNLVIQKSKDEAQDNGATIMPIITESFSLSAEDYEMKKIIVTDSDDDDDDVIFCSEILPTKETLPSNNTVAQVQSNPGPVAISDVAPSASNNSPPLTNITPTQKLPTPVNQATLSQTQGSEKLLVSSAPTHLTPNIILLNQTPLSTPPNVSSSLPNHMPSSINLLVQNQQTPNSAILTGNKANEEEEEEIIDDDDDTISSSPDSAVSNTSLVPQADTSQNTSFDGSLIQKMQIPTLLQEPLSNSLKISDIITRNTNDPGVGSKHLMEGQKIITLDTATEIEGLSTGCKVYANIGEDTYDIVIPVKDDPDEGEARLENEIPKTSGSEMANKRMKVKHDDHYELIVDGRVYYICIVCKRSYVCLTSLRRHFNIHSWEKKYPCRYCEKVFPLAEYRTKHEIHHTGERRYQCLACGKSFINYQFMSSHIKSVHSQDPSGDSKLYRLHPCRSLQIRQYAYLSDRSSTIPAMKDDGIGYKVDTGKEPPVGTTTSTQNKPMTWEDIFIQQENDSIFKQNVTDGSTEFEFIIPESY

SEQ ID NO: 98565 - protein, 672 aa, Homo sapiens; identical to SEQ ID NO: 98564
  Payload ID: 19677
  Gene Name: zinc finger and BTB domain containing 33
  Uniprot ID: Q86T24
  ENSP ID: ENSP00000450969

SEQ ID NO: 98566 - protein, 504 aa, Homo sapiens
  Payload ID: 19678
  Gene Name: zinc finger and BTB domain containing 34
  ENSP ID: ENSP00000317534
MSVEMDSSSFIQFDVPEYSSTVLSQLNELRLQGKLCDIIVHIQGQPFRAHKAVLAASSPYFRDHSALSTMSGLSISVIKNPNVFEQLLSFCYTGRMSLQLKDVVSFLTAASFLQMQCVIDKCTQILESIHSKISVGDVDSVTVGAEENPESRNGVKDSSFFANPVEISPPYCSQGRQPTASSDLRMETTPSKALRSRLQEEGHSDRGSSGSVSEYEIQIEGDHEQGDLLVRESQITEVKVKMEKSDRPSCSDSSSLGDDGYHTEMVDGEQVVAVNVGSYGSVLQHAYSYSQAASQPTNVSEAFGSLSNSSPSRSMLSCFRGGRARQKRALSVHLHSDLQGLVQGSDSEAMMNNPGYESSPRERSARGHWYPYNERLICIYCGKSFNQKGSLDRHMRLHMGITPFVCKFCGKKYTRKDQLEYHIRGHTDDKPFRCEICGKCFPFQGTLNQHLRKNHPGVAEVRSRIESPERTDVYVEQKLENDASASEMGLDSRMEIHTVSDAPD

SEQ ID NO: 98567 - protein, 500 aa, Homo sapiens
  Payload ID: 19678
  Gene Name: zinc finger and BTB domain containing 34
  Uniprot ID: Q8NCN2
  ENSP ID: ENSP00000362551
MDSSSFIQFDVPEYSSTVLSQLNELRLQGKLCDIIVHIQGQPFRAHKAVLAASSPYFRDHSALSTMSGLSISVIKNPNVFEQLLSFCYTGRMSLQLKDVVSFLTAASFLQMQCVIDKCTQILESIHSKISVGDVDSVTVGAEENPESRNGVKDSSFFANPVEISPPYCSQGRQPTASSDLRMETTPSKALRSRLQEEGHSDRGSSGSVSEYEIQIEGDHEQGDLLVRESQITEVKVKMEKSDRPSCSDSSSLGDDGYHTEMVDGEQVVAVNVGSYGSVLQHAYSYSQAASQPTNVSEAFGSLSNSSPSRSMLSCFRGGRARQKRALSVHLHSDLQGLVQGSDSEAMMNNPGYESSPRERSARGHWYPYNERLICIYCGKSFNQKGSLDRHMRLHMGITPFVCKFCGKKYTRKDQLEYHIRGHTDDKPFRCEICGKCFPFQGTLNQHLRKNHPGVAEVRSRIESPERTDVYVEQKLENDASASEMGLDSRMEIHTVSDAPD

SEQ ID NO: 98568 - protein, 503 aa, Homo sapiens
  Payload ID: 19679
  Gene Name: zinc finger and BTB domain containing 37
  Uniprot ID: Q5TC79
  ENSP ID: ENSP00000356674
MEKGGNIQLEIPDFSNSVLSHLNQLRMQGRLCDIVVNVQGQAFRAHKVVLAASSPYFRDHMSLNEMSTVSISVIKNPTVFEQLLSFCYTGRICLQLADIISYLTAASFLQMQHIIDKCTQILEGIHFKINVAEVEAELSQTRTKHQERPPESHRVTPNLNRSLSPRHNTPKGNRRGQVSAVLDIRELSPPEESTSPQIIEPSSDVESREPILRINRAGQWYVETGVADRGGRSDDEVRVLGAVHIKTENLEEWLGPENQPSGEDGSSAEEVTAMVIDTTGHGSVGQENYTLGSSGAKVARPTSSEVDRFSPSGSVVPLTERHRARSESPGRMDEPKQPSSQVEESAMMGVSGYVEYLREQEVSERWFRYNPRLTCIYCAKSFNQKGSLDRHMRLHMGITPFVCRMCGKKYTRKDQLEYHIRKHTGNKPFHCHVCGKSFPFQAILNQHFRKNHPGCIPLEGPHSISPETTVTSRGQAEEESPSQEETVAPGEAVQGSVSTTGPD

SEQ ID NO: 98569 - protein, 361 aa, Homo sapiens
  Payload ID: 19679
  Gene Name: zinc finger and BTB domain containing 37
  Uniprot ID: Q5TC79
  ENSP ID: ENSP00000356675
MEKGGNIQLEIPDFSNSVLSHLNQLRMQGRLCDIVVNVQGQAFRAHKVVLAASSPYFRDHMSLNEMSTVSISVIKNPTVFEQLLSFCYTGRICLQLADIISYLTAASFLQMQHIIDKCTQILEGIHFKINVAEVEAELSQTRTKHQERPPESHRVTPNLNRSLSPRHNTPKGNRRGQVSAVLDIRELSPPEESTSPQIIEPSSDVESREPILRINRAGQWYVETGVADRGGRSDDEVRVLGAVHIKTENLEEWLGPENQPSGEDGSSAEEVTAMVIDTTGHGSVGQENYTLGSSGAKVARPTSSEVDRFSPSGSVVPLTERHRARSESPGRMDEPKQPSSQVWSCGFRTALVVGGIATVYE

SEQ ID NO: 98570 - protein, 308 aa, Homo sapiens
  Payload ID: 19679
  Gene Name: zinc finger and BTB domain containing 37
  Uniprot ID: Q5TC79
  ENSP ID: ENSP00000356677
MEKGGNIQLEIPDFSNSVLSHLNQLRMQGRLCDIVVNVQGQAFRAHKVVLAASSPYFRDHMSLNEMSTVSISVIKNPTVFEQLLSFCYTGRICLQLADIISYLTAASFLQMQHIIDKCTQILEGIHFKINVAEVEAELSQTRTKHQERPPESHRVTPNLNRSLSPRHNTPKGNRRGQVSAVLDIRELSPPEESTSPQIIEPSSDVESREPILRINRAGQWYVETGVADRGGRSDDEVRVLGAVHIKTENLEEWLGPENQPSGEDGSSAEEVTAMVIDTTGHGSVGQENYTLGSSGAKVARPTSSEVDR

SEQ ID NO: 98571 - protein, 411 aa, Homo sapiens
  Payload ID: 19679
  Gene Name: zinc finger and BTB domain containing 37
  ENSP ID: ENSP00000409408
MPATGRYHQLPNSCQFSANAAYYRQMYTDPGGHSFQINVAEVEAELSQTRTKHQERPPESHRVTPNLNRSLSPRHNTPKGNRRGQVSAVLDIRELSPPEESTSPQIIEPSSDVESREPILRINRAGQWYVETGVADRGGRSDDEVRVLGAVHIKTENLEEWLGPENQPSGEDGSSAEEVTAMVIDTTGHGSVGQENYTLGSSGAKVARPTSSEVDRFSPSGSVVPLTERHRARSESPGRMDEPKQPSSQVEESAMMGVSGYVEYLREQEVSERWFRYNPRLTCIYCAKSFNQKGSLDRHMRLHMGITPFVCRMCGKKYTRKDQLEYHIRKHTGNKPFHCHVCGKSFPFQAILNQHFRKNHPGCIPLEGPHSISPETTVTSRGQAEEESPSQEETVAPGEAVQGSVSTTGPD

SEQ ID NO: 98572 - protein, 503 aa, Homo sapiens; identical to SEQ ID NO: 98568
  Payload ID: 19679
  Gene Name: zinc finger and BTB domain containing 37
  Uniprot ID: Q5TC79
  ENSP ID: ENSP00000415293

SEQ ID NO: 98573 - protein, 1195 aa, Homo sapiens
  Payload ID: 19680
  Gene Name: zinc finger and BTB domain containing 38
  Uniprot ID: Q8NAP3
  ENSP ID: ENSP00000372635
MTVMSLSRDLKDDFHSDTVLSILNEQRIRGILCDVTIIVEDTKFKAHSNVLAASSLYFKNIFWSHTICISSHVLELDDLKAEVFTEILNYIYSSTVVVKRQETVTDLAAAGKKLGISFLEDLTDRNFSNSPGPYVFCITEKGVVKEEKNEKRHEEPAITNGPRITNAFSIIETENSNNMFSPLDLRASFKKVSDSMRTASLCLERTDVCHEAEPVRTLAEHSYAVSSVAEAYRSQPVREHDGSSPGNTGKENCEALAAKPKTCRKPKTFSIPQDSDSATENIPPPPVSNLEVNQERSPQPAAVLTRSKSPNNEGDVHFSREDENQSSDVPGPPAAEVPPLVYNCSCCSKAFDSSTLLSAHMQLHKPTQEPLVCKYCNKQFTTLNRLDRHEQICMRSSHMPIPGGNQRFLENYPTIGQNGGSFTGPEPLLSENRIGEFSSTGSTLPDTDHMVKFVNGQMLYSCVVCKRSYVTLSSLRRHANVHSWRRTYPCHYCNKVFALAEYRTRHEIWHTGERRYQCIFCLETFMTYYILKNHQKSFHAIDHRLSISKKTANGGLKPSVYPYKLYRLLPMKCKRAPYKSYRNSSYENARENSQMNESAPGTYVVQNPHSSELPTLNFQDTVNTLTNSPAIPLETSACQDIPTSANVQNAEGTKWGEEALKMDLDNNFYSTEVSVSSTENAVSSDLRAGDVPVLSLSNSSENAASVISYSGSAPSVIVHSSQFSSVIMHSNAIAAMTSSNHRAFSDPAVSQSLKDDSKPEPDKVGRFASRPKSIKEKKKTTSHTRGEIPEESNYVADPGGSLSKTTNIAEETSKIETYIAKPALPGTSTNSNVAPLCQITVKIGNEAIVKRHILGSKLFYKRGRRPKYQMQEEPLPQGNDPEPSGDSPLGLCQSECMEMSEVFDDASDQDSTDKPWRPYYNYKPKKKSRQLKKMRKVNWRKEHGNRSPSHKCKYPAELDCAVGKAPQDKPFEEEETKEMPKLQCELCDGDKAVGAGNQGRPHRHLTSRPYACELCAKQFQSPSTLKMHMRCHTGEKPYQCKTCGRCFSVQGNLQKHERIHLGLKEFVCQYCNKAFTLNETLKIHERIHTGEKRYHCQFCFQRFLYLSTKRNHEQRHIREHNGKGYACFQCPKICKTAAALGMHQKKHLFKSPSQQEKIGDVCHENSNPLENQHFIGSEDNDQKDNIQTGVENVVL

SEQ ID NO: 98574 - protein, 1195 aa, Homo sapiens; identical to SEQ ID NO: 98573
  Payload ID: 19680
  Gene Name: zinc finger and BTB domain containing 38
  Uniprot ID: Q8NAP3
  ENSP ID: ENSP00000406955

SEQ ID NO: 98575 - protein, 118 aa, Homo sapiens
  Payload ID: 19680
  Gene Name: zinc finger and BTB domain containing 38
  ENSP ID: ENSP00000421037
MTVMSLSRDLKDDFHSDTVLSILNEQRIRGILCDVTIIVEDTKFKAHSNVLAASSLYFKNIFWSHTICISSHVLELDDLKAEVFTEILNYIYSSTVVVKRQETVTDLAAAGKKLGISF

SEQ ID NO: 98576 - protein, 34 aa, Homo sapiens
  Payload ID: 19680
  Gene Name: zinc finger and BTB domain containing 38
  ENSP ID: ENSP00000422051
MTVMSLSRDLKDDFHSDTVLSILNEQRIRGILCD

SEQ ID NO: 98577 - protein, 210 aa, Homo sapiens
  Payload ID: 19680
  Gene Name: zinc finger and BTB domain containing 38
  ENSP ID: ENSP00000422081
MTVMSLSRDLKDDFHSDTVLSILNEQRIRGILCDVTIIVEDTKFKAHSNVLAASSLYFKNIFWSHTICISSHVLELDDLKAEVFTEILNYIYSSTVVVKRQETVTDLAAAGKKLGISFLEDLTDRNFSNSPGPYVFCITEKGVVKEEKNEKRHEEPAITNGPRITNAFSIIETENSNNMFSPLDLRASFKKVSDSMRTASLCLERTDVCH

SEQ ID NO: 98578 - protein, 94 aa, Homo sapiens
  Payload ID: 19680
  Gene Name: zinc finger and BTB domain containing 38
  ENSP ID: ENSP00000422347
MTVMSLSRDLKDDFHSDTVLSILNEQRIRGILCDVTIIVEDTKFKAHSNVLAASSLYFKNIFWSHTICISSHVLELDDLKAEVFTEILNYIYSS

SEQ ID NO: 98579 - protein, 69 aa, Homo sapiens
  Payload ID: 19680
  Gene Name: zinc finger and BTB domain containing 38
  ENSP ID: ENSP00000422757
MTVMSLSRDLKDDFHSDTVLSILNEQRIRGILCDVTIIVEDTKFKAHSNVLAASSLYFKNIFWSHTICI

SEQ ID NO: 98580 - protein, 111 aa, Homo sapiens
  Payload ID: 19680
  Gene Name: zinc finger and BTB domain containing 38
  ENSP ID: ENSP00000422894
MTVMSLSRDLKDDFHSDTVLSILNEQRIRGILCDVTIIVEDTKFKAHSNVLAASSLYFKNIFWSHTICISSHVLELDDLKAEVFTEILNYIYSSTVVVKRQETVTDLAAAG

SEQ ID NO: 98581 - protein, 771 aa, Homo sapiens
  Payload ID: 19680
  Gene Name: zinc finger and BTB domain containing 38
  ENSP ID: ENSP00000424254
MTVMSLSRDLKDDFHSDTVLSILNEQRIRGILCDVTIIVEDTKFKAHSNVLAASSLYFKNIFWSHTICISSHVLELDDLKAEVFTEILNYIYSSTVVVKRQETVTDLAAAGKKLGISFLEDLTDRNFSNSPGPYVFCITEKGVVKEEKNEKRHEEPAITNGPRITNAFSIIETENSNNMFSPLDLRASFKKVSDSMRTASLCLERTDVCHEAEPVRTLAEHSYAVSSVAEAYRSQPVREHDGSSPGNTGKENCEALAAKPKTCRKPKTFSIPQDSDSATENIPPPPVSNLEVNQERSPQPAAVLTRSKSPNNEGDVHFSREDENQSSDVPGPPAAEVPPLVYNCSCCSKAFDSSTLLSAHMQLHKPTQEPLVCKYCNKQFTTLNRLDRHEQICMRSSHMPIPGGNQRFLENYPTIGQNGGSFTGPEPLLSENRIGEFSSTGSTLPDTDHMVKFVNGQMLYSCVVCKRSYVTLSSLRRHANVHSWRRTYPCHYCNKVFALAEYRTRHEIWHTGERRYQCIFCLETFMTYYILKNHQKSFHAIDHRLSISKKTANGGLKPSVYPYKLYRLLPMKCKRAPYKSYRNSSYENARENSQMNESAPGTYVVQNPHSSELPTLNFQDTVNTLTNSPAIPLETSACQDIPTSANVQNAEGTKWGEEALKMDLDNNFYSTEVSVSSTENAVSSDLRAGDVPVLSLSNSSENAASVISYSGSAPSVIVHSSQFSSVIMHSNAIAAMTSSNHRAFSDPAVSQSLKDDSKPEPDKVGRFASRP

SEQ ID NO: 98582 - protein, 146 aa, Homo sapiens
  Payload ID: 19680
  Gene Name: zinc finger and BTB domain containing 38
  ENSP ID: ENSP00000425705
MTVMSLSRDLKDDFHSDTVLSILNEQRIRGILCDVTIIVEDTKFKAHSNVLAASSLYFKNIFWSHTICISSHVLELDDLKAEVFTEILNYIYSSTVVVKRQETVTDLAAAGKKLGISFLEDLTDRNFSNSPGPYVFCITEKGVVKE

SEQ ID NO: 98583 - protein, 108 aa, Homo sapiens
  Payload ID: 19680
  Gene Name: zinc finger and BTB domain containing 38
  ENSP ID: ENSP00000426288
MTVMSLSRDLKDDFHSDTVLSILNEQRIRGILCDVTIIVEDTKFKAHSNVLAASSLYFKNIFWSHTICISSHVLELDDLKAEVFTEILNYIYSSTVVVKRQETVTDLA

SEQ ID NO: 98584 - protein, 1195 aa, Homo sapiens; identical to SEQ ID NO: 98573
  Payload ID: 19680
  Gene Name: zinc finger and BTB domain containing 38
  Uniprot ID: Q8NAP3
  ENSP ID: ENSP00000426387

SEQ ID NO: 98585 - protein, 150 aa, Homo sapiens
  Payload ID: 19680
  Gene Name: zinc finger and BTB domain containing 38
  ENSP ID: ENSP00000426931
MTVMSLSRDLKDDFHSDTVLSILNEQRIRGILCDVTIIVEDTKFKAHSNVLAASSLYFKNIFWSHTICISSHVLELDDLKAEVFTEILNYIYSSTVVVKRQETVTDLAAAGKKLGISFLEDLTDRNFSNSPGPYVFCITEKGVVKEEKNE

SEQ ID NO: 98586 - protein, 712 aa, Homo sapiens
  Payload ID: 19681
  Gene Name: zinc finger and BTB domain containing 39
  Uniprot ID: O15060
  ENSP ID: ENSP00000300101
MGMRIKLQSTNHPNNLLKELNKCRLSETMCDVTIVVGSRSFPAHKAVLACAAGYFQNLFLNTGLDAARTYVVDFITPANFEKVLSFVYTSELFTDLINVGVIYEVAERLGMEDLLQACHSTFPDLESTARAKPLTSTSESHSGTLSCPSAEPAHPLGELRGGGDYLGADRNYVLPSDAGGSYKEEEKNVASDANHSLHLPQPPPPPPKTEDHDTPAPFTSIPSMMTQPLLGTVSTGIQTSTSSCQPYKVQSNGDFSKNSFLTPDNAVDITTGTNSCLSNSEHSKDPGFGQMDELQLEDLGDDDLQFEDPAEDIGTTEEVIELSDDSEDELAFGENDNRENKAMPCQVCKKVLEPNIQLIRQHARDHVDLLTGNCKVCETHFQDRNSRVTHVLSHIGIFLFSCDMCETKFFTQWQLTLHRRDGIFENNIIVHPNDPLPGKLGLFSGAASPELKCAACGKVLAKDFHVVRGHILDHLNLKGQACSVCDQRHLNLCSLMWHTLSHLGISVFSCSVCANSFVDWHLLEKHMAVHQSLEDALFHCRLCSQSFKSEAAYRYHVSQHKCNSGLDARPGFGLQHPALQKRKLPAEEFLGEELALQGQPGNSKYSCKVCGKRFAHTSEFNYHRRIHTGEKPYQCKVCHKFFRGRSTIKCHLKTHSGALMYRCTVCGHYSSTLNLMSKHVGVHKGSLPPDFTIEQTFMYIIHSKEADKNPDS

SEQ ID NO: 98587 - protein, 1013 aa, Homo sapiens
  Payload ID: 19682
  Gene Name: zinc finger and BTB domain containing 4
  Uniprot ID: Q9P1Z0
  ENSP ID: ENSP00000307858
MPPPAEVTDPSHAPAVLRQLNEQRLRGLFCDVTLIAGDTKFPAHRSVLAASSPFFREALLTSAPLPLPPATGGAAPNPATTTAASSSSSSSSSSSSSSSSASSSSSSSSSSPPPASPPASSPPRVLELPGVPAAAFSDVLNFIYSARLALPGGGGDGAAVAEIGALGRRLGISRLQGLGEGGDAWVPPTPAPMATSQPEEDSFGPGPRPAGEWEGDRAEAQAPDLQCSLPRRPLPCPQCGKSFIHPKRLQTHEAQCRRGASTRGSTGLGAGGAGPGGPAGVDASALPPPVGFRGGPEHVVKVVGGHVLYVCAACERSYVTLSSLKRHSNVHSWRRKYPCRYCEKVFALAEYRTKHEVWHTGERRYQCIFCWETFVTYYNLKTHQRAFHGISPGLLASEKTPNGGYKPKLNTLKLYRLLPMRAAKRPYKTYSQGAPEAPLSPTLNTPAPVAMPASPPPGPPPAPEPGPPPSVITFAHPAPSVIVHGGSSSGGGGSGTASTGGSQAASVITYTAPPRPPKKREYPPPPPEPAATPTSPATAVSPATAAGPAMATTTEEAKGRNPRAGRTLTYTAKPVGGIGGGGGPPTGAGRGPSQLQAPPPLCQITVRIGEEAIVKRRISETDLRPGELSGEEMEESEEDEEEEDEEEEEEDEEESKAGGEDQLWRPYYSYKPKRKAGAAGGASVGGSGLPRGRRPPRWRQKLERRSWEETPAAESPAGRARTERRHRCGDCAQTFTTLRKLRKHQEAHGGGSHSSRAGRRPSTRFTCPHCAKVCKTAAALSRHGQRHAAERPGGTPTPVIAYSKGSAGTRPGDVKEEAPQEMQVSSSSGEAGGGSTAAEEASETASLQDPIISGGEEPPVVASGGSYVYPPVQEFPLALIGGGREPGGGRGKSGSEGPVGAGEGDRMEGIGAAKVTFYPEPYPLVYGPQLLAAYPYNFSNLAALPVALNMVLPDEKGAGALPFLPGVFGYAVNPQAAPPAPPTPPPPTLPPPIPPKGEGERAGVERTQKGDVG

SEQ ID NO: 98588 - protein, 1013 aa, Homo sapiens; identical to SEQ ID NO: 98587
  Payload ID: 19682
  Gene Name: zinc finger and BTB domain containing 4
  Uniprot ID: Q9P1Z0
  ENSP ID: ENSP00000369973

SEQ ID NO: 98589 - protein, 1127 aa, Homo sapiens
  Payload ID: 19683
  Gene Name: zinc finger and BTB domain containing 40
  ENSP ID: ENSP00000363782
MELPNYSRQLLQQLYTLCKEQQFCDCTISIGTIYFRAHKLVLAAASLLFKTLLDNTDTISIDASVVSPEEFALLLEMMYTGKLPVGKHNFSKIISLADSLQMFDVAVSCKNLLTSLVNCSVQGQVVRDVSAPSSETFRKEPEKPQVEILSSEGAGEPHSSPELAATPGGPVKAETEEAAHSVSQEMSVNSPTAQESQRNAETPAETPTTAEACSPSPAVQTFSEAKKTSTEPGCERKHYQLNFLLENEGVFSDALMVTQDVLKKLEMCSEIKGPQKEVILNCCEGRTPKETIENLLHRMTEEKTLTAEGLVKLLQAVKTTFPNLGLLLEKLQKSATLPSTTVQPSPDDYGTELLRRYHENLSEIFTDNQILLKMISHMTSLAPGEREVMEKLVKRDSGSGGFNSLISAVLEKQTLSATAIWQLLLVVQETKTCPLDLLMEEIRREPGADAFFRAVTTPEHATLETILRHNQLILEAIQQKIEYKLFTSEEEHLAETVKEILSIPSETASPEASLRAVLSRAMEKSVPAIEICHLLCSVHKSFPGLQPVMQELAYIGVLTKEDGEKETWKVSNKFHLEANNKEDEKAAKEDSQPGEQNDQGETGSLPGQQEKEASASPDPAKKSFICKACDKSFHFYCRLKVHMKRCRVAKSKQVQCKECSETKDSKKELDKHQLEAHGAGGEPDAPKKKKKRLPVTCDLCGREFAHASGMQYHKLTEHFDEKPFSCEECGAKFAANSTLKNHLRLHTGDRPFMCKHCLMTFTQASALAYHTKKKHSEGKMYACQYCDAVFAQSIELSRHVRTHTGDKPYVCRDCGKGFRQANGLSIHLHTFHNIEDPYDCKKCRMSFPTLQDHRKHIHEVHSKEYHPCPTCGKIFSAPSMLERHVVTHVGGKPFSCGICNKAYQQLSGLWYHNRTHHPDVFAAQNHRSSKFSSLQCSSCDKTFPNTIEHKKHIKAEHADMKFHECDQCKELFPTPALLQVHVKCQHSGSQPFRCLYCAATFRFPGALQHHVTTEHFKQSETTFPCELCGELFTSQAQLDSHLESEHPKVMSTETQAAASQMAQVIQTPEPVAPTEQVITLEETQLAGSQVFVTLPDSQASQASSELVAVTVEDLLDGTVTLICGEAK

SEQ ID NO: 98590 - protein, 1239 aa, Homo sapiens
  Payload ID: 19683
  Gene Name: zinc finger and BTB domain containing 40
  Uniprot ID: Q9NUA8
  ENSP ID: ENSP00000364798
MELPNYSRQLLQQLYTLCKEQQFCDCTISIGTIYFRAHKLVLAAASLLFKTLLDNTDTISIDASVVSPEEFALLLEMMYTGKLPVGKHNFSKIISLADSLQMFDVAVSCKNLLTSLVNCSVQGQVVRDVSAPSSETFRKEPEKPQVEILSSEGAGEPHSSPELAATPGGPVKAETEEAAHSVSQEMSVNSPTAQESQRNAETPAETPTTAEACSPSPAVQTFSEAKKTSTEPGCERKHYQLNFLLENEGVFSDALMVTQDVLKKLEMCSEIKGPQKEMIVKCFEGEGGHSAFQRILGKVREESLDVQTVVSLLRLYQYSNPAVKTALLDRKPEDVDTVQPKGSTEEGKTLSVLLLEHKEDLIQCVTQLRPIMESLETAKEEFLTGTEKRVILNCCEGRTPKETIENLLHRMTEEKTLTAEGLVKLLQAVKTTFPNLGLLLEKLQKSATLPSTTVQPSPDDYGTELLRRYHENLSEIFTDNQILLKMISHMTSLAPGEREVMEKLVKRDSGSGGFNSLISAVLEKQTLSATAIWQLLLVVQETKTCPLDLLMEEIRREPGADAFFRAVTTPEHATLETILRHNQLILEAIQQKIEYKLFTSEEEHLAETVKEILSIPSETASPEASLRAVLSRAMEKSVPAIEICHLLCSVHKSFPGLQPVMQELAYIGVLTKEDGEKETWKVSNKFHLEANNKEDEKAAKEDSQPGEQNDQGETGSLPGQQEKEASASPDPAKKSFICKACDKSFHFYCRLKVHMKRCRVAKSKQVQCKECSETKDSKKELDKHQLEAHGAGGEPDAPKKKKKRLPVTCDLCGREFAHASGMQYHKLTEHFDEKPFSCEECGAKFAANSTLKNHLRLHTGDRPFMCKHCLMTFTQASALAYHTKKKHSEGKMYACQYCDAVFAQSIELSRHVRTHTGDKPYVCRDCGKGFRQANGLSIHLHTFHNIEDPYDCKKCRMSFPTLQDHRKHIHEVHSKEYHPCPTCGKIFSAPSMLERHVVTHVGGKPFSCGICNKAYQQLSGLWYHNRTHHPDVFAAQNHRSSKFSSLQCSSCDKTFPNTIEHKKHIKAEHADMKFHECDQCKELFPTPALLQVHVKCQHSGSQPFRCLYCAATFRFPGALQHHVTTEHFKQSETTFPCELCGELFTSQAQLDSHLESEHPKVMSTETQAAASQMAQVIQTPEPVAPTEQVITLEETQLAGSQVFVTLPDSQASQASSELVAVTVEDLLDGTVTLICGEAK

SEQ ID NO: 98591 - protein, 453 aa, Homo sapiens
  Payload ID: 19683
  Gene Name: zinc finger and BTB domain containing 40
  ENSP ID: ENSP00000383098
MELPNYSRQLLQQLYTLCKEQQFCDCTISIGTIYFRAHKLVLAAASLLFKTLLDNTDTISIDASVVSPEEFALLLEMMYTGKLPVGKHNFSKIISLADSLQMFDVAVSCKNLLTSLVNCSVQGQVVRDVSAPSSETFRKEPEKPQVEILSSEGAGEPHSSPELAATPGGPVKAETEEAAHSVSQEMSVNSPTAQESQRNAETPAETPTTAEACSPSPAVQTFSEAKKTSTEPGCERKHYQLNFLLENEGVFSDALMVTQDVLKKLEMCSEIKGPQKEMIVKCFEGEGGHSAFQRILGKVREESLDVQTVVSLLRLYQYSNPAVKTALLDRKPEDVDTVQPKGSTEEGKTLSVLLLEHKEDLIQCVTQLRPIMESLETAKEEFLTGTEKRVILNCCEGRTPKETIENLLHRMTEEKTLTAEGLVKLLQAVKTTFPNLGLLLEKLQKSATLPSTT

SEQ ID NO: 98592 - protein, 1239 aa, Homo sapiens; identical to SEQ ID NO: 98590
  Payload ID: 19683
  Gene Name: zinc finger and BTB domain containing 40
  Uniprot ID: Q9NUA8
  ENSP ID: ENSP00000384527

SEQ ID NO: 98593 - protein, 909 aa, Homo sapiens
  Payload ID: 19684
  Gene Name: zinc finger and BTB domain containing 41
  Uniprot ID: Q5SVQ8
  ENSP ID: ENSP00000356375
MKKRRKVTSNLEKIHLGYHKDSSEGNVAVECDQVTYTHSAGRPTPEALHCYQELPPSPDQRKLLSSLQYNKNLLKYLNDDRQKQPSFCDLLIIVEGKEFSAHKVVVAVGSSYFHACLSKNPSTDVVTLDHVTHSVFQHLLEFLYTSEFFVYKYEIPLVLEAAKFLDIIDAVKLLNNENVAPFHSELTEKSSPEETLNELTGRLSNNHQCKFCSRHFCYKKSLENHLAKTHRSLLLGKKHGLKMLERSFSARRSKRNRKCPVKFDDTSDDEQESGDGSDNLNQENFDKEKSDRNDSEDPGSEYNAEEDELEEEMSDEYSDIEEQSEKDHNDAEEEPEAGDSVGNVHEGLTPVVIQNSNKKILQCPKCDKTFDRIGKYESHTRVHTGEKPFECDICHQRYSTKSNLTVHRKKHSNETEFHKKEHKCPYCNKLHASKKTLAKHVKRFHPENAQEFISIKKTKSESWKCDICKKSFTRRPHLEEHMILHSQDKPFKCTYCEEHFKSRFARLKHQEKFHLGPFPCDICGRQFNDTGNLKRHIECTHGGKRKWTCFICGKSVRERTTLKEHLRIHSGEKPHLCSICGQSFRHGSSYRLHLRVHHDDKRYECDECGKTFIRHDHLTKHKKIHSGEKAHQCEECGKCFGRRDHLTVHYKSVHLGEKVWQKYKATFHQCDVCKKIFKGKSSLEMHFRTHSGEKPYKCQICNQSFRIKKTLTKHLVIHSDARPFNCQHCNATFKRKDKLKYHIDHVHEIKSPDDPLSTSEEKLVSLPVEYSSDDKIFQTETKQYMDQPKVYQSEAKTMLQNVSAEVCVPVTLVPVQMPDTPSDLVRHTTTLPPSSHEILSPQPQSTDYPRAADLAFLEKYTLTPQPANIVHPVRPEQMLDPREQSYLGTLLGLDSTTGVQNISTNEHHS

SEQ ID NO: 98594 - protein, 422 aa, Homo sapiens
  Payload ID: 19685
  Gene Name: zinc finger and BTB domain containing 42
  Uniprot ID: B2RXF5
  ENSP ID: ENSP00000409107
MEFPEHGGRLLGRLRQQRELGFLCDCTVLVGDARFPAHRAVLAACSVYFHLFYRDRPAGSRDTVRLNGDIVTAPAFGRLLDFMYEGRLDLRSLPVEDVLAAASYLHMYDIVKVCKGRLQEKDRSLDPGNPAPGAEPAQPPCPWPVWTADLCPAARKAKLPPFGVKAALPPRASGPPPCQVPEESDQALDLSLKSGPRQERVHPPCVLQTPLCSQRQPGAQPLVKDERDSLSEQEESSSSRSPHSPPKPPPVPAAKGLVVGLQPLPLSGEGSRELELGAGRLASEDELGPGGPLCICPLCSKLFPSSHVLQLHLSAHFRERDSTRARLSPDGVAPTCPLCGKTFSCTYTLKRHERTHSGEKPYTCVQCGKSFQYSHNLSRHTVVHTREKPHACRWCERRFTQSGDLYRHVRKFHCGLVKSLLV

SEQ ID NO: 98595 - protein, 422 aa, Homo sapiens; identical to SEQ ID NO: 98594
  Payload ID: 19685
  Gene Name: zinc finger and BTB domain containing 42
  Uniprot ID: B2RXF5
  ENSP ID: ENSP00000450673

SEQ ID NO: 98596 - protein, 467 aa, Homo sapiens
  Payload ID: 19686
  Gene Name: zinc finger and BTB domain containing 43
  Uniprot ID: O43298
  ENSP ID: ENSP00000362556
MEPGTNSFRVEFPDFSSTILQKLNQQRQQGQLCDVSIVVQGHIFRAHKAVLAASSPYFCDQVLLKNSRRIVLPDVMNPRVFENILLSSYTGRLVMPAPEIVSYLTAASFLQMWHVVDKCTEVLEGNPTVLCQKLNHGSDHQSPSSSSYNGLVESFELGSGGHTDFPKAQELRDGENEEESTKDELSSQLTEHEYLPSNSSTEHDRLSTEMASQDGEEGASDSAEFHYTRPMYSKPSIMAHKRWIHVKPERLEQACEGMDVHATYDEHQVTESINTVQTEHTVQPSGVEEDFHIGEKKVEAEFDEQADESNYDEQVDFYGSSMEEFSGERSDGNLIGHRQEAALAAGYSENIEMVTGIKEEASHLGFSATDKLYPCQCGKSFTHKSQRDRHMSMHLGLRPYGCGVCGKKFKMKHHLVGHMKIHTGIKPYECNICAKRFMWRDSFHRHVTSCTKSYEAAKAEQNTTEAN

SEQ ID NO: 98597 - protein, 467 aa, Homo sapiens; identical to SEQ ID NO: 98596
  Payload ID: 19686
  Gene Name: zinc finger and BTB domain containing 43
  Uniprot ID: O43298
  ENSP ID: ENSP00000362563

SEQ ID NO: 98598 - protein, 467 aa, Homo sapiens; identical to SEQ ID NO: 98596
  Payload ID: 19686
  Gene Name: zinc finger and BTB domain containing 43
  Uniprot ID: O43298
  ENSP ID: ENSP00000390344

SEQ ID NO: 98599 - protein, 195 aa, Homo sapiens
  Payload ID: 19686
  Gene Name: zinc finger and BTB domain containing 43
  ENSP ID: ENSP00000412145
MEPGTNSFRVEFPDFSSTILQKLNQQRQQGQLCDVSIVVQGHIFRAHKAVLAASSPYFCDQVLLKNSRRIVLPDVMNPRVFENILLSSYTGRLVMPAPEIVSYLTAASFLQMWHVVDKCTEVLEGNPTVLCQKLNHGSDHQSPSSSSYNGLVESFELGSGGHTDFPKAQELRDGENEEESTKDELSSQLTEHEYL

SEQ ID NO: 98600 - protein, 570 aa, Homo sapiens
  Payload ID: 19687
  Gene Name: zinc finger and BTB domain containing 44
  ENSP ID: ENSP00000350574
MGVKTFTHSSSSHSQEMLGKLNMLRNDGHFCDITIRVQDKIFRAHKVVLAACSDFFRTKLVGQAEDENKNVLDLHHVTVTGFIPLLEYAYTATLSINTENIIDVLAAASYMQMFSVASTCSEFMKSSILWNTPNSQPEKGLDAGQENNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRVKVERLSDEEVHEEVSQPVSASQSSLSDQQTVPGSEQVQEDLLISPQSSSIGSVDEGVSEGLPTLQSTSSTNAPPDDDDRLENVQYPYQLYIAPSTSSTERPSPNGPDRPFQCPTCGVRFTRIQNLKQHMLIHSGIKPFQCDRCGKKFTRAYSLKMHRLKHEGKRCFRCQICSATFTSFGEYKHHMRVSRHIIRKPRIYECKTCGAMFTNSGNLIVHLRSLNHEASELANYFQSSDFLVPDYLNQEQEETLVQYDLGEHGFESNSSVQMPVISQYHSKGKEP

SEQ ID NO: 98601 - protein, 570 aa, Homo sapiens; identical to SEQ ID NO: 98600
  Payload ID: 19687
  Gene Name: zinc finger and BTB domain containing 44
  ENSP ID: ENSP00000380861

SEQ ID NO: 98602 - protein, 467 aa, Homo sapiens
  Payload ID: 19687
  Gene Name: zinc finger and BTB domain containing 44
  Uniprot ID: Q8NCP5
  ENSP ID: ENSP00000408079
MGVKTFTHSSSSHSQEMLGKLNMLRNDGHFCDITIRVQDKIFRAHKVVLAACSDFFRTKLVGQAEDENKNVLDLHHVTVTGFIPLLEYAYTATLSINTENIIDVLAAASYMQMFSVASTCSEFMKSSILWNTPNSQPEKGLDAGQENNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRVKVERLSDEEVHEEVSQPVSASQSSLSDQQTVPGSEQVQEDLLISPQSSSIGSVDEGVSEGLPTLQSTSSTNAPPDDDDRLENVQYPYQLYIAPSTSSTERPSPNGPDRPFQCPTCGVRFTRIQNLKQHMLIHSGIKPFQCDRCGKKFTRAYSLKMHRLKHEGHPRKSASRSSSATNCC

SEQ ID NO: 98603 - protein, 328 aa, Homo sapiens
  Payload ID: 19687
  Gene Name: zinc finger and BTB domain containing 44
  ENSP ID: ENSP00000432558
  MOD_RES (1)..(1): Any amino acid
XNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRVKVERLSDEEVHEEVSQPVSASQSSLSDQQTVPGSEQVQEDLLISPQSSSIGSVDEGVSEGLPTLQSTSSTNAPPDDDDRLENVQYPYQLYIAPSTSSTERPSPNGPDRPFQCPTCGVRFTRIQNLKQHMLIHSGIKPFQCDRCGKKFTRAYSLKMHRLKHEVPLQRQGTMIDNSQAVDEMTRNGE

SEQ ID NO: 98604 - protein, 453 aa, Homo sapiens
  Payload ID: 19687
  Gene Name: zinc finger and BTB domain containing 44
  Uniprot ID: Q8NCP5
  ENSP ID: ENSP00000433457
MGVKTFTHSSSSHSQEMLGKLNMLRNDGHFCDITIRVQDKIFRAHKVVLAACSDFFRTKLVGQAEDENKNVLDLHHVTVTGFIPLLEYAYTATLSINTENIIDVLAAASYMQMFSVASTCSEFMKSSILWNTPNSQPEKGLDAGQENNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRVKVERLSDEEVHEEVSQPVSASQSSLSDQQTVPGSEQVQEDLLISPQSSSIGSVDEGVSEGLPTLQSTSSTNAPPDDDDRLENVQYPYQLYIAPSTSSTERPSPNGPDRPFQCPTCGVRFTRIQNLKQHMLIHSGIKPFQCDRCGKKFTRAYSLKMHRLKHEVIS

SEQ ID NO: 98605 - protein, 474 aa, Homo sapiens
  Payload ID: 19687
  Gene Name: zinc finger and BTB domain containing 44
  Uniprot ID: Q8NCP5
  ENSP ID: ENSP00000434177
MGVKTFTHSSSSHSQEMLGKLNMLRNDGHFCDITIRVQDKIFRAHKVVLAACSDFFRTKLVGQAEDENKNVLDLHHVTVTGFIPLLEYAYTATLSINTENIIDVLAAASYMQMFSVASTCSEFMKSSILWNTPNSQPEKGLDAGQENNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRVKVERLSDEEVHEEVSQPVSASQSSLSDQQTVPGSEQVQEDLLISPQSSSIGSVDEGVSEGLPTLQSTSSTNAPPDDDDRLENVQYPYQLYIAPSTSSTERPSPNGPDRPFQCPTCGVRFTRIQNLKQHMLIHSGIKPFQCDRCGKKFTRAYSLKMHRLKHEVPLQRQGTMIDNSQAVDEMTRNGE

SEQ ID NO: 98606 - protein, 180 aa, Homo sapiens
  Payload ID: 19687
  Gene Name: zinc finger and BTB domain containing 44
  ENSP ID: ENSP00000435413
  MOD_RES (1)..(1): Any amino acid
XELPGPSETGRRMADYVTCESTKTTLPLGTEEDVRVKVERLSDEEVHEEVSQPVSASQSSLSDQQTVPGSEQVQEDLLISPQSSSIGSVDEGVSEGLPTLQSTSSTNAPPDDDDRSTERPSPNGPDRPFQCPTCGVRFTRIQNLKQHMLIHSGIKPFQCDRCGKKFTRAYSLKMHRLKHE

SEQ ID NO: 98607 - protein, 595 aa, Homo sapiens
  Payload ID: 19687
  Gene Name: zinc finger and BTB domain containing 44
  ENSP ID: ENSP00000436187
  MOD_RES (1)..(1): Any amino acid
XTFTHSSSSHSQEMLGKLNMLRNDGHFCDITIRVQDKIFRAHKVVLAACSDFFRTKLVGQAEDENKNVLDLHHVTVTGFIPLLEYAYTATLSINTENIIDVLAAASYMQMFSVASTCSEFMKSSILWNTPNSQPEKGLDAGQENNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRVKVERLSDEEVHEEVSQPVSASQSSLSDQQTVPGSEQVQEDLLISPQSSSIGSVDEGVSEGLPTLQSTSSTNAPPDDDDRTERPSPNGPDRPFQCPTCGVRFTRIQNLKQHMLIHSGIKPFQCDRCGKKFTRAYSLKMHRLKHEGKRCFRCQICSATFTSFGEYKHHMRVSRHIIRKPRIYECKTCGAMFTNSGNLIVHLRSLNHEASELANYFQSSDFLVPDYLNQEQEETLVQYDLGEHGFESNSSVQMPVISQVSSTQNCESTFPLGSLGGLAEKEEEVPEQPKSSACAEATRDDPPKSELSSITIE

SEQ ID NO: 98608 - protein, 202 aa, Homo sapiens
  Payload ID: 19687
  Gene Name: zinc finger and BTB domain containing 44
  ENSP ID: ENSP00000479214
MLTATLSINTENIIDVLAAASYMQMFSVASTCSEFMKSSILWNTPNSQPEKGLDAGQENNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRSK

SEQ ID NO: 98609 - protein, 511 aa, Homo sapiens
  Payload ID: 19688
  Gene Name: zinc finger and BTB domain containing 45
  Uniprot ID: Q96K62
  ENSP ID: ENSP00000346603
MAAAEAVHHIHLQNFSRSLLETLNGQRLGGHFCDVTVRIREASLRAHRCVLAAGSPFFQDKLLLGHSEIRVPPVVPAQTVRQLVEFLYSGSLVVAQGEALQVLTAASVLRIQTVIDECTQIIARARAPGTSAPTPLPTPVPPPLAPAQLRHRLRHLLAARPPGHPGAAHSRKQRQPARLQLPAPPTPAKAEGPDADPSLSAAPDDRGDEDDEESDDETDGEDGEGGGPGEGQAPPSFPDCAAGFLTAAADSACEEPPAPTGLADYSGAGRDFLRGAGSAEDVFPDSYVSTWHDEDGAVPEGCPTETPVQPDCILSGSRPPGVKTPGPPVALFPFHLGAPGPPAPPPSAPSGPAPAPPPAFYPTLQPEAAPSTQLGEVPAPSAAPTTAPSGTPARTPGAEPPTYECSHCRKTFSSRKNYTKHMFIHSGEKPHQCAVCWRSFSLRDYLLKHMVTHTGVRAFQCAVCAKRFTQKSSLNVHMRTHRPERAPCPACGKVFSHRALLERHLAAHPAP

SEQ ID NO: 98610 - protein, 511 aa, Homo sapiens; identical to SEQ ID NO: 98609
  Payload ID: 19688
  Gene Name: zinc finger and BTB domain containing 45
  Uniprot ID: Q96K62
  ENSP ID: ENSP00000469089

SEQ ID NO: 98611 - protein, 121 aa, Homo sapiens
  Payload ID: 19688
  Gene Name: zinc finger and BTB domain containing 45
  ENSP ID: ENSP00000470316
MAAAEAVHHIHLQNFSRSLLETLNGQRLGGHFCDVTVRIREASLRAHRCVLAAGSPFFQDKLLLGHSEIRVPPVVPAQTVRQLVEFLYSGSLVVAQGEALQVLTAASVLRIQTVIDECTQI

SEQ ID NO: 98612 - protein, 17 aa, Homo sapiens
  Payload ID: 19688
  Gene Name: zinc finger and BTB domain containing 45
  ENSP ID: ENSP00000471885
MAAAEAVHHIHLQNFSR

SEQ ID NO: 98613 - protein, 511 aa, Homo sapiens; identical to SEQ ID NO: 98609
  Payload ID: 19688
  Gene Name: zinc finger and BTB domain containing 45
  Uniprot ID: Q96K62
  ENSP ID: ENSP00000473072

SEQ ID NO: 98614 - protein, 589 aa, Homo sapiens
  Payload ID: 19689
  Gene Name: zinc finger and BTB domain containing 46
  Uniprot ID: Q86UZ6
  ENSP ID: ENSP00000245663
MNNRKEDMEITSHYRHLLRELNEQRQHGVLCDVCVVVEGKVFKAHKNVLLGSSRYFKTLYCQVQKTSEQATVTHLDIVTAQGFKAIIDFMYSAHLALTSRNVIEVMSAASFLQMTDIVQACHDFIKAALDISIKSDASDELAEFEIGASSSSSTEALISAVMAGRSISPWLARRTSPANSSGDSAIASCHDGGSSYGKEDQEPKADGPDDVSSQPLWPGDVGYGPLRIKEEQVSPSQYGGSELPSAKDGAVQNSFSEQSAGDAWQPTGRRKNRKNKETVRHITQQVEDDSRASSPVPSFLPTSGWPFSSRDSNADLSVTEASSSDSRGERAELYAQVEEGLLGGEASYLGPPLTPEKDDALHQATAVANLRAALMSKNSLLSLKADVLGDDGSLLFEYLPRGAHSLSLNEFTVIRKKFKCPYCSFSAMHQCILKRHMRSHTGERPYPCEICGKKFTRREHMKRHTLVHSKDKKYVCKVCSRVFMSAASVGIRHGSRRHGVCTDCAGRGMAGPLDHGGGGGEGSPEALFPGDGPYLEDPEDPRGEAEELGEDDEGLAPEDALLADDKDEEDSPRPRSPPGGPDKDFAWLS

SEQ ID NO: 98615 - protein, 589 aa, Homo sapiens; identical to SEQ ID NO: 98614
  Payload ID: 19689
  Gene Name: zinc finger and BTB domain containing 46
  Uniprot ID: Q86UZ6
  ENSP ID: ENSP00000303102

SEQ ID NO: 98616 - protein, 589 aa, Homo sapiens; identical to SEQ ID NO: 98614
  Payload ID: 19689
  Gene Name: zinc finger and BTB domain containing 46
  Uniprot ID: Q86UZ6
  ENSP ID: ENSP00000378536

SEQ ID NO: 98617 - protein, 747 aa, Homo sapiens
  Payload ID: 19690
  Gene Name: zinc finger and BTB domain containing 47
  Uniprot ID: Q9UFB7
  ENSP ID: ENSP00000232974
MGRLNEQRLFQPDLCDVDLVLVPQRSVFPAHKGVLAAYSQFFHSLFTQNKQLQRVELSLEALAPGGLQQILNFIYTSKLLVNAANVHEVLSAASLLQMADIAASCQELLDARSLGPPGPGTVALAQPAASCTPAAPPYYCDIKQEADTPGLPKIYAREGPDPYSVRVEDGAGTAGGTVPATIGPAQPFFKEEKEGGVEEAGGPPASLCKLEGGEELEEELGGSGTYSRREQSQIIVEVNLNNQTLHVSTGPEGKPGAGPSPATVVLGREDGLQRHSDEEEEDDEEEEEEEEEEEGGGSGREEEEEEEGGSQGEEEEEEEDGHSEQEEEEEEEEEEGPSEQDQESSEEEEGEEGEAGGKQGPRGSRSSRADPPPHSHMATRSRENARRRGTPEPEEAGRRGGKRPKPPPGVASASARGPPATDGLGAKVKLEEKQHHPCQKCPRVFNNRWYLEKHMNVTHSRMQICDQCGKRFLLESELLLHRQTDCERNIQCVTCGKAFKKLWSLHEHNKIVHGYAEKKFSCEICEKKFYTMAHVRKHMVAHTKDMPFTCETCGKSFKRSMSLKVHSLQHSGEKPFRCENCNERFQYKYQLRSHMSIHIGHKQFMCQWCGKDFNMKQYFDEHMKTHTGEKPYICEICGKSFTSRPNMKRHRRTHTGEKPYPCDVCGQRFRFSNMLKAHKEKCFRVSHTLAGDGVPAAPGLPPTQPQAHALPLLPGLPQTLPPPPHLPPPPPLFPTTASPGGRMNANN

SEQ ID NO: 98618 - protein, 293 aa, Homo sapiens
  Payload ID: 19690
  Gene Name: zinc finger and BTB domain containing 47
  ENSP ID: ENSP00000420968
MNVTHSRMQICDQCGKRFLLESELLLHRQTDCERNIQCVTCGKAFKKLWSLHEHNKIVHGYAEKKFSCEICEKKFYTMAHVRKHMVAHTKDMPFTCETCGKSFKRSMSLKVHSLQHSGEKPFRCENCNERFQYKYQLRSHMSIHIGHKQFMCQWCGKDFNMKQYFDEHMKTHTGEKPYICEICGKSFTSRPNMKRHRRTHTGEKPYPCDVCGQRFRFSNMLKAHKEKCFRVSHTLAGDGVPAAPGLPPTQPQAHALPLLPGLPQTLPPPPHLPPPPPLFPTTASPGGRMNANN

SEQ ID NO: 98619 - protein, 310 aa, Homo sapiens
  Payload ID: 19691
  Gene Name: zinc finger and BTB domain containing 48
  ENSP ID: ENSP00000313416
MDGSFVQHSVRVLQELNKQREKGQYCDATLDVGGLVFKAHWSVLACCSHFFQSLYGDGSGGSVVLPAGFAEIFGLLLDFFYTGHLALTSGNRDQVLLAARELRVPEAVELCQSFKPKTSVGQAAGGQSGLGPPASQNVNSHVKEPAGLEEEEVSRTLGLVPRDQEPRGSHSPQRPQLHSPAQSEGPSSLCGKLKQALKPCPLEDKKPEDCKVPPRPLEAEGAQLQGGSNEWEVVVQVEDDGDGDYMSEPEAVLTRRKSNVIRKPCAAEPALSAGSLAAEPAENRKGTAVPVECPTCHKKFLSKYYLKVHN

SEQ ID NO: 98620 - protein, 688 aa, Homo sapiens
  Payload ID: 19691
  Gene Name: zinc finger and BTB domain containing 48
  Uniprot ID: P10074
  ENSP ID: ENSP00000366902
MDGSFVQHSVRVLQELNKQREKGQYCDATLDVGGLVFKAHWSVLACCSHFFQSLYGDGSGGSVVLPAGFAEIFGLLLDFFYTGHLALTSGNRDQVLLAARELRVPEAVELCQSFKPKTSVGQAAGGQSGLGPPASQNVNSHVKEPAGLEEEEVSRTLGLVPRDQEPRGSHSPQRPQLHSPAQSEGPSSLCGKLKQALKPCPLEDKKPEDCKVPPRPLEAEGAQLQGGSNEWEVVVQVEDDGDGDYMSEPEAVLTRRKSNVIRKPCAAEPALSAGSLAAEPAENRKGTAVPVECPTCHKKFLSKYYLKVHNRKHTGEKPFECPKCGKCYFRKENLLEHEARNCMNRSEQVFTCSVCQETFRRRMELRVHMVSHTGEMPYKCSSCSQQFMQKKDLQSHMIKLHGAPKPHACPTCAKCFLSRTELQLHEAFKHRGEKLFVCEECGHRASSRNGLQMHIKAKHRNERPHVCEFCSHAFTQKANLNMHLRTHTGEKPFQCHLCGKTFRTQASLDKHNRTHTGERPFSCEFCEQRFTEKGPLLRHVASRHQEGRPHFCQICGKTFKAVEQLRVHVRRHKGVRKFECTECGYKFTRQAHLRRHMEIHDRVENYNPRQRKLRNLIIEDEKMVVVALQPPAELEVGSAEVIVESLAQGGLASQLPGQRLCAEESFTGPGVLEPSLIITAAVPEDCDT

SEQ ID NO: 98621 - protein, 292 aa, Homo sapiens
  Payload ID: 19691
  Gene Name: zinc finger and BTB domain containing 48
  ENSP ID: ENSP00000416054
MDGSFVQHSVRVLQELNKQREKGQYCDATLDVGGLVFKAHWSVLACCSHFFQSLYGDGSGGSVVLPAGFAEIFGLLLDFFYTGHLALTSGNRDQVLLAARELRVPEAVELCQSFKPKTSVGQAAGGQSGLGPPASQNVNSHVKEPAGLEEEEVSRTLGLVPRDQEPRGSHSPQRPQLHSPAQSEGPSSLCGKLKQALKPCPLEDKKPEDCKVPPRPLEAEGAQLQGGSNEWEVVVQVEDDGDGDYMSEPEAVLTRRKSNVIRKPCAAEPALSAGSLAAEPAENRKGTAVPVE

SEQ ID NO: 98622 - protein, 230 aa, Homo sapiens
  Payload ID: 19691
  Gene Name: zinc finger and BTB domain containing 48
  ENSP ID: ENSP00000466390
MSEPEAVLTRRKSNVIRKPCAAEPALSAGSLAAEPAENRKGTAVPVECPTCHKKFLSKYYLKVHNRKHTGEKPFECPKCGKCYFRKENLLEHEARNCMNRSEQVFTCSVCQETFRRRMELRVHMVSHTGEMPYKCSSCSQQFMQKKDLQSHMIKLHGAPKPHACPTCAKCFLSRTELQLHEAFKHRGEKLFVCEECGHRASSRNGLQMHIKAKHRNERPHVCEFCSHAFT

SEQ ID NO: 98623 - protein, 128 aa, Homo sapiens
  Payload ID: 19691
  Gene Name: zinc finger and BTB domain containing 48
  ENSP ID: ENSP00000467104
MIKLHGAPKPHASCSCMKLSSTVVRSCLCVRSVGTGPRAGMACRCTSRPSTGMRGHTYVSSAATPSPKRPISTCTCAHTRVRSPSSATSVARPSEPKPAWTSTTAPTPGKGPSVASSVNSASLRRGPS

SEQ ID NO: 98624 - protein, 131 aa, Homo sapiens
  Payload ID: 19691
  Gene Name: zinc finger and BTB domain containing 48
  ENSP ID: ENSP00000482731
MELRVHMVSHTGEMPYKVRLGLSPGPGLGGPRILPAEPFTWGAVRHLPHSSCQGACLPCLPCLSSAPLSRQGLSAASPPRSLLGPCFFPWRTGLASSGQLSPEALLCTILHTRSGVLPESSHRGLPLVPAL

SEQ ID NO: 98625 - protein, 765 aa, Homo sapiens
  Payload ID: 19692
  Gene Name: zinc finger and BTB domain containing 49
  Uniprot ID: Q6ZSB9
  ENSP ID: ENSP00000338807
MDPVATHSCHLLQQLHEQRIQGLLCDCMLVVKGVCFKAHKNVLAAFSQYFRSLFQNSSSQKNDVFHLDVKNVSGIGQILDFMYTSHLDLNQDNIQVMLDTAQCLQVQNVLSLCHTFLKSATVVQPPGMPCNSTLSLQSTLTPDATCVISENYPPHLLQECSADAQQNKTLDESHPHASPSVNRHHSAGEISKQAPDTSDGSCTELPFKQPNYYYKLRNFYSKQYHKHAAGPSQERVVEQPFAFSTSTDLTTVESQPCAVSHSECILESPEHLPSNFLAQPVNDSAPHPESDATCQQPVKQMRLKKAIHLKKLNFLKSQKYAEQVSEPKSDDGLTKRLESASKNTLEKASSQSAEEKESEEVVSCENFNCISETERPEDPAALEDQSQTLQSQRQYACELCGKPFKHPSNLELHKRSHTGEKPFECNICGKHFSQAGNLQTHLRRHSGEKPYICEICGKRFAASGDVQRHIIIHSGEKPHLCDICGRGFSNFSNLKEHKKTHTADKVFTCDECGKSFNMQRKLVKHRIRHTGERPYSCSACGKCFGGSGDLRRHVRTHTGEKPYTCEICNKCFTRSAVLRRHKKMHCKAGDESPDVLEELSQAIETSDLEKSQSSDSFSQDTSVTLMPVSVKLPVHPVENSVAEFDSHSGGSYCKLRSMIQPHGVSDQEKLSLDPGKLAKPQMQQTQPQAYAYSDVDTPAGGEPLQADGMAMIRSSLAALDNHGGDPLGSRASSTTYRNSEGQFFSSMTLWGLAMKTLQNENELDQ

SEQ ID NO: 98626 - protein, 174 aa, Homo sapiens
  Payload ID: 19692
  Gene Name: zinc finger and BTB domain containing 49
  ENSP ID: ENSP00000421654
  MOD_RES (1)..(1): Any amino acid
XILESPEHLPSNFLAQPVNDSAPHPESDATCQQPVKQMRLKKAIHLKKLNFLKSQKYAEQVSEPKSDDGLTKRLESASKNTLEKASSQSAEEKESEEVVSCENFNCISETERPEDPAALEDQSQTLQSQRQYACELCGKPFKHPSNLELHKRSHTGKCFGGSGDLRRHVRTHTG

SEQ ID NO: 98627 - protein, 453 aa, Homo sapiens
  Payload ID: 19692
  Gene Name: zinc finger and BTB domain containing 49
  ENSP ID: ENSP00000422321
MDPVATHSCHLLQQLHEQRIQGLLCDCMLVVKGVCFKAHKNVLAAFSQYFRSLFQNSSSQKNDVFHLDVKNVSGIGQILDFMYTSHLDLNQDNIQVMLDTAQCLQVQNVLSLCHTFLKSATVVQPPGMPCNSTLSLQSTLTPDATCVISENYPPHLLQECSADAQQNKTLDESHPHASPSVNRHHSAGEISKQAPDTSDGSCTELPFKQPNYYYKLRNFYSKQYHKHAAGPSQERVVEQPFAFSTSTDLTTVESQPCAVSHSECILESPEHLPSNFLAQPVNDSAPHPESDATCQQPVKQMRLKKAIHLKKLNFLKSQKYAEQVSEPKSDDGLTKRLESASKNTLEKASSQSAEEKESEEVVSCENFNCISETERPEDPAALEDQSQTLQSQRQYACELCGKPFKHPSNLELHKRSHTGLQPLATSSVTLLFTQEKNHTCVTSVVEGLVTSVI

SEQ ID NO: 98628 - protein, 144 aa, Homo sapiens
  Payload ID: 19692
  Gene Name: zinc finger and BTB domain containing 49
  ENSP ID: ENSP00000424525
MDPVATHSCHLLQQLHEQRIQGLLCDCMLVVKGVCFKAHKNVLAAFSQYFRNVQQMHSRTKRWMNRIRMLHHQLIVITPQVKSQNKLLILQMAAAQNCLSNSQITITNSETFTVSSTINTQLVPVRRELLSSLLLSAPLQTLPR

SEQ ID NO: 98629 - protein, 146 aa, Homo sapiens
  Payload ID: 19692
  Gene Name: zinc finger and BTB domain containing 49
  ENSP ID: ENSP00000425747
MDPVATHSCHLLQQLHEQRIQGLLCDCMLVVKGVCFKAHKNVLAAFSQYFRSLFQNSSSQKNDVFHLDVKNVSGIGQILDFMYTSHLDLNQDNIQVMLDTAQCLQVQNVLSLCHTFLKSATVVQPPGMPCNSTLSLQSTLTPDATC

SEQ ID NO: 98630 - protein, 122 aa, Homo sapiens
  Payload ID: 19692
  Gene Name: zinc finger and BTB domain containing 49
  ENSP ID: ENSP00000426765
  MOD_RES (1)..(1): Any amino acid
XQMRLKKAIHLKKLNFLKSQKYAEQVSEPKSDDGLTKRLESASKNTLEKASSQSAEEKESEEVVSCENFNCISETERPEDPAALEDQSQTLQSQRQYACELCGKPFKHPSNLELHKRSHTGR

SEQ ID NO: 98631 - protein, 677 aa, Homo sapiens
  Payload ID: 19693
  Gene Name: zinc finger and BTB domain containing 5
  Uniprot ID: O15062
  ENSP ID: ENSP00000307604
MDFPGHFEQIFQQLNYQRLHGQLCDCVIVVGNRHFKAHRSVLAACSTHFRALFSVAEGDQTMNMIQLDSEVVTAEAFAALIDMMYTSTLMLGESNVMDVLLAASHLHLNSVVKACKHYLTTRTLPMSPPSERVQEQSARMQRSFMLQQLGLSIVSSALNSSQNGEEQPAPMSSSMRSNLDQRTPFPMRRLHKRKQSAEERARQRLRPSIDESAISDVTPENGPSGVHSREEFFSPDSLKIVDNPKADGMTDNQEDSAIMFDQSFGTQEDAQVPSQSDNSAGNMAQLSMASRATQVETSFDQEAAPEKSSFQCENPEVGLGEKEHMRVVVKSEPLSSPEPQDEVSDVTSQAEGSESVEVEGVVVSAEKIDLSPESSDRSFSDPQSSTDRVGDIHILEVTNNLEHKSTFSISNFLNKSRGNNFTANQNNDDNIPNTTSDCRLESEAPYLLSPEAGPAGGPSSAPGSHVENPFSEPADSHFVRPMQEVMGLPCVQTSGYQGGEQFGMDFSRSGLGLHSSFSRVMIGSPRGGASNFPYYRRIAPKMPVVTSVRSSQIPENSTSSQLMMNGATSSFENGHPSQPGPPQLTRASADVLSKCKKALSEHNVLVVEGARKYACKICCKTFLTLTDCKKHIRVHTGEKPYACLKCGKRFSQSSHLYKHSKTTCLRWQSSNLPSTLL

SEQ ID NO: 98632 - protein, 424 aa, Homo sapiens
  Payload ID: 19694
  Gene Name: zinc finger and BTB domain containing 6
  Uniprot ID: Q15916
  ENSP ID: ENSP00000362763
MAAESDVLHFQFEQQGDVVLQKMNLLRQQNLFCDVSIYINDTEFQGHKVILAACSTFMRDQFLLTQSKHVRITILQSAEVGRKLLLSCYTGALEVKRKELLKYLTAASYLQMVHIVEKCTEALSKYLEIDLSMKNNNQHTDLCQSSDPDVKNEDENSDKDCEIIEISEDSPVNIDFHVKEEESNALQSTVESLTSERKEMKSPELSTVDIGFKDNEICILHVESISTAGVENGQFSQPCTSSKASMYFSETQHSLINSTVESRVAEVPGNQDQGLFCENTEGSYGTVSEIQNLEEGYSLRHQCPRCPRGFLHVENYLRHLKMHKLFLCLQCGKTFTQKKNLNRHIRGHMGIRPFQCTVCLKTFTAKSTLQDHLNIHSGDRPYKCHCCDMDFKHKSALKKHLTSVHGRSSGEKLSRPDLKRQSLL

SEQ ID NO: 98633 - protein, 584 aa, Homo sapiens
  Payload ID: 19695
  Gene Name: zinc finger and BTB domain containing 7A
  Uniprot ID: O95365
  ENSP ID: ENSP00000323670
MAGGVDGPIGIPFPDHSSDILSGLNEQRTQGLLCDVVILVEGREFPTHRSVLAACSQYFKKLFTSGAVVDQQNVYEIDFVSAEALTALMDFAYTATLTVSTANVGDILSAARLLEIPAVSHVCADLLDRQILAADAGADAGQLDLVDQIDQRNLLRAKEYLEFFQSNPMNSLPPAAAAAAASFPWSAFGASDDDLDATKEAVAAAVAAVAAGDCNGLDFYGPGPPAERPPTGDGDEGDSNPGLWPERDEDAPTGGLFPPPVAPPAATQNGHYGRGGEEEAASLSEAAPEPGDSPGFLSGAAEGEDGDGPDVDGLAASTLLQQMMSSVGRAGAAAGDSDEESRADDKGVMDYYLKYFSGAHDGDVYPAWSQKVEKKIRAKAFQKCPICEKVIQGAGKLPRHIRTHTGEKPYECNICKVRFTRQDKLKVHMRKHTGEKPYLCQQCGAAFAHNYDLKNHMRVHTGLRPYQCDSCCKTFVRSDHLHRHLKKDGCNGVPSRRGRKPRVRGGAPDPSPGATATPGAPAQPSSPDARRNGQEKHFKDEDEDEDVASPDGLGRLNVAGAGGGGDSGGGPGAATDGNFTAGLA

SEQ ID NO: 98634 - protein, 584 aa, Homo sapiens; identical to SEQ ID NO: 98633
  Payload ID: 19695
  Gene Name: zinc finger and BTB domain containing 7A
  Uniprot ID: O95365
  ENSP ID: ENSP00000471865

SEQ ID NO: 98635 - protein, 539 aa, Homo sapiens
  Payload ID: 19696
  Gene Name: zinc finger and BTB domain containing 7B
  Uniprot ID: O15156
  ENSP ID: ENSP00000292176
MGSPEDDLIGIPFPDHSSELLSCLNEQRQLGHLCDLTIRTQGLEYRTHRAVLAACSHYFKKLFTEGGGGAVMGAGGSGTATGGAGAGVCELDFVGPEALGALLEFAYTATLTTSSANMPAVLQAARLLEIPCVIAACMEILQGSGLEAPSPDEDDCERARQYLEAFATATASGVPNGEDSPPQVPLPPPPPPPPRPVARRSRKPRKAFLQTKGARANHLVPEVPTVPAHPLTYEEEEVAGRVGSSGGSGPGDSYSPPTGTASPPEGPQSYEPYEGEEEEEELVYPPAYGLAQGGGPPLSPEELGSDEDAIDPDLMAYLSSLHQDNLAPGLDSQDKLVRKRRSQMPQECPVCHKIIHGAGKLPRHMRTHTGEKPFACEVCGVRFTRNDKLKIHMRKHTGERPYSCPHCPARFLHSYDLKNHMHLHTGDRPYECHLCHKAFAKEDHLQRHLKGQNCLEVRTRRRRKDDAPPHYPPPSTAAASPAGLDLSNGHLDTFRLSLARFWEQSAPTGPPVSTPGPPDDDEEEGAPTTPQAEGAMESS

SEQ ID NO: 98636 - protein, 539 aa, Homo sapiens; identical to SEQ ID NO: 98635
  Payload ID: 19696
  Gene Name: zinc finger and BTB domain containing 7B
  Uniprot ID: O15156
  ENSP ID: ENSP00000357411

SEQ ID NO: 98637 - protein, 573 aa, Homo sapiens
  Payload ID: 19696
  Gene Name: zinc finger and BTB domain containing 7B
  Uniprot ID: O15156
  ENSP ID: ENSP00000406286
MLQPGPHPPSPQAAAPGEAWPGPSQAPWQSLEEKMGSPEDDLIGIPFPDHSSELLSCLNEQRQLGHLCDLTIRTQGLEYRTHRAVLAACSHYFKKLFTEGGGGAVMGAGGSGTATGGAGAGVCELDFVGPEALGALLEFAYTATLTTSSANMPAVLQAARLLEIPCVIAACMEILQGSGLEAPSPDEDDCERARQYLEAFATATASGVPNGEDSPPQVPLPPPPPPPPRPVARRSRKPRKAFLQTKGARANHLVPEVPTVPAHPLTYEEEEVAGRVGSSGGSGPGDSYSPPTGTASPPEGPQSYEPYEGEEEEEELVYPPAYGLAQGGGPPLSPEELGSDEDAIDPDLMAYLSSLHQDNLAPGLDSQDKLVRKRRSQMPQECPVCHKIIHGAGKLPRHMRTHTGEKPFACEVCGVRFTRNDKLKIHMRKHTGERPYSCPHCPARFLHSYDLKNHMHLHTGDRPYECHLCHKAFAKEDHLQRHLKGQNCLEVRTRRRRKDDAPPHYPPPSTAAASPAGLDLSNGHLDTFRLSLARFWEQSAPTGPPVSTPGPPDDDEEEGAPTTPQAEGAMESS

SEQ ID NO: 98638 - protein, 539 aa, Homo sapiens; identical to SEQ ID NO: 98635
  Payload ID: 19696
  Gene Name: zinc finger and BTB domain containing 7B
  Uniprot ID: O15156
  ENSP ID: ENSP00000438647

SEQ ID NO: 98639 - protein, 619 aa, Homo sapiens
  Payload ID: 19697
  Gene Name: zinc finger and BTB domain containing 7C
  Uniprot ID: A1YPR0
  ENSP ID: ENSP00000439781
MANDIDELIGIPFPNHSSEVLCSLNEQRHDGLLCDVLLVVQEQEYRTHRSVLAACSKYFKKLFTAGTLASQPYVYEIDFVQPEALAAILEFAYTSTLTITAGNVKHILNAARMLEIQCIVNVCLEIMEPGGDGGEEDDKEDDDDDEDDDDEEDEEEEEEEEEDDDDDTEDFADQENLPDPQDISCHQSPSKTDHLTEKAYSDTPRDFPDSFQAGSPGHLGVIRDFSIESLLRENLYPKANIPDRRPSLSPFAPDFFPHLWPGDFGAFAQLPEQPMDSGPLDLVIKNRKIKEEEKEELPPPPPPPFPNDFFKDMFPDLPGGPLGPIKAENDYGAYLNFLSATHLGGLFPPWPLVEERKLKPKASQQCPICHKVIMGAGKLPRHMRTHTGEKPYMCTICEVRFTRQDKLKIHMRKHTGERPYLCIHCNAKFVHNYDLKNHMRIHTGVRPYQCEFCYKSFTRSDHLHRHIKRQSCRMARPRRGRKPAAWRAASLLFGPGGPAPDKAAFVMPPALGEVGGHLGGAAVCLPGPSPAKHFLAAPKGALSLQELERQFEETQMKLFGRAQLEAERNAGGLLAFALAENVAAARPYFPLPDPWAAGLAGLPGLAGLNHVASMSEANN

SEQ ID NO: 98640 - protein, 25 aa, Homo sapiens
  Payload ID: 19697
  Gene Name: zinc finger and BTB domain containing 7C
  ENSP ID: ENSP00000464724
MANDIDELIGIPFPNHSSEVLCSLN

SEQ ID NO: 98641 - protein, 18 aa, Homo sapiens
  Payload ID: 19697
  Gene Name: zinc finger and BTB domain containing 7C
  ENSP ID: ENSP00000465160
MANDIDELIGIPFPNHSS

SEQ ID NO: 98642 - protein, 25 aa, Homo sapiens
  Payload ID: 19697
  Gene Name: zinc finger and BTB domain containing 7C
  ENSP ID: ENSP00000465265
MANDIDELIGIPFPNHSSEVLCSLN

SEQ ID NO: 98643 - protein, 15 aa, Homo sapiens
  Payload ID: 19697
  Gene Name: zinc finger and BTB domain containing 7C
  ENSP ID: ENSP00000465494
MANDIDELIGIPFPN

SEQ ID NO: 98644 - protein, 25 aa, Homo sapiens
  Payload ID: 19697
  Gene Name: zinc finger and BTB domain containing 7C
  ENSP ID: ENSP00000465760
MANDIDELIGIPFPNHSSEVLCSLN

SEQ ID NO: 98645 - protein, 15 aa, Homo sapiens
  Payload ID: 19697
  Gene Name: zinc finger and BTB domain containing 7C
  ENSP ID: ENSP00000465832
MANDIDELIGIPFPN

SEQ ID NO: 98646 - protein, 25 aa, Homo sapiens
  Payload ID: 19697
  Gene Name: zinc finger and BTB domain containing 7C
  ENSP ID: ENSP00000465835
MANDIDELIGIPFPNHSSEVLCSLN

SEQ ID NO: 98647 - protein, 25 aa, Homo sapiens
  Payload ID: 19697
  Gene Name: zinc finger and BTB domain containing 7C
  ENSP ID: ENSP00000466006
MANDIDELIGIPFPNHSSEVLCSLN

SEQ ID NO: 98648 - protein, 18 aa, Homo sapiens
  Payload ID: 19697
  Gene Name: zinc finger and BTB domain containing 7C
  ENSP ID: ENSP00000466088
MANDIDELIGIPFPNHSS

SEQ ID NO: 98649 - protein, 18 aa, Homo sapiens
  Payload ID: 19697
  Gene Name: zinc finger and BTB domain containing 7C
  ENSP ID: ENSP00000466944
MANDIDELIGIPFPNHSS

SEQ ID NO: 98650 - protein, 25 aa, Homo sapiens
  Payload ID: 19697
  Gene Name: zinc finger and BTB domain containing 7C
  ENSP ID: ENSP00000467147
MANDIDELIGIPFPNHSSEVLCSLN

SEQ ID NO: 98651 - protein, 66 aa, Homo sapiens
  Payload ID: 19697
  Gene Name: zinc finger and BTB domain containing 7C
  ENSP ID: ENSP00000467323
MANDIDELIGIPFPNHSSEVLCSLNEQRHDGLLCDVLLVVQEQEYRTHRSVLAACSKYFKKLFTAG

SEQ ID NO: 98652 - protein, 15 aa, Homo sapiens
  Payload ID: 19697
  Gene Name: zinc finger and BTB domain containing 7C
  ENSP ID: ENSP00000467338
MANDIDELIGIPFPN

SEQ ID NO: 98653 - protein, 15 aa, Homo sapiens
  Payload ID: 19697
  Gene Name: zinc finger and BTB domain containing 7C
  ENSP ID: ENSP00000467456
MANDIDELIGIPFPN

SEQ ID NO: 98654 - protein, 18 aa, Homo sapiens
  Payload ID: 19697
  Gene Name: zinc finger and BTB domain containing 7C
  ENSP ID: ENSP00000467758
MANDIDELIGIPFPNHSS

SEQ ID NO: 98655 - protein, 619 aa, Homo sapiens; identical to SEQ ID NO: 98639
  Payload ID: 19697
  Gene Name: zinc finger and BTB domain containing 7C
  Uniprot ID: A1YPR0
  ENSP ID: ENSP00000467877

SEQ ID NO: 98656 - protein, 25 aa, Homo sapiens
  Payload ID: 19697
  Gene Name: zinc finger and BTB domain containing 7C
  ENSP ID: ENSP00000468019
MANDIDELIGIPFPNHSSEVLCSLN

SEQ ID NO: 98657 - protein, 25 aa, Homo sapiens
  Payload ID: 19697
  Gene Name: zinc finger and BTB domain containing 7C
  ENSP ID: ENSP00000468087
MANDIDELIGIPFPNHSSEVLCSLN

SEQ ID NO: 98658 - protein, 15 aa, Homo sapiens
  Payload ID: 19697
  Gene Name: zinc finger and BTB domain containing 7C
  ENSP ID: ENSP00000468152
MANDIDELIGIPFPN

SEQ ID NO: 98659 - protein, 619 aa, Homo sapiens; identical to SEQ ID NO: 98639
  Payload ID: 19697
  Gene Name: zinc finger and BTB domain containing 7C
  Uniprot ID: A1YPR0
  ENSP ID: ENSP00000468254

SEQ ID NO: 98660 - protein, 25 aa, Homo sapiens
  Payload ID: 19697
  Gene Name: zinc finger and BTB domain containing 7C
  ENSP ID: ENSP00000468306
MANDIDELIGIPFPNHSSEVLCSLN

SEQ ID NO: 98661 - protein, 25 aa, Homo sapiens
  Payload ID: 19697
  Gene Name: zinc finger and BTB domain containing 7C
  ENSP ID: ENSP00000468502
MANDIDELIGIPFPNHSSEVLCSLN

SEQ ID NO: 98662 - protein, 25 aa, Homo sapiens
  Payload ID: 19697
  Gene Name: zinc finger and BTB domain containing 7C
  ENSP ID: ENSP00000468537
MANDIDELIGIPFPNHSSEVLCSLN

SEQ ID NO: 98663 - protein, 25 aa, Homo sapiens
  Payload ID: 19697
  Gene Name: zinc finger and BTB domain containing 7C
  ENSP ID: ENSP00000468659
MANDIDELIGIPFPNHSSEVLCSLN

SEQ ID NO: 98664 - protein, 15 aa, Homo sapiens
  Payload ID: 19697
  Gene Name: zinc finger and BTB domain containing 7C
  ENSP ID: ENSP00000468752
MANDIDELIGIPFPN

SEQ ID NO: 98665 - protein, 619 aa, Homo sapiens; identical to SEQ ID NO: 98639
  Payload ID: 19697
  Gene Name: zinc finger and BTB domain containing 7C
  Uniprot ID: A1YPR0
  ENSP ID: ENSP00000468782

SEQ ID NO: 98666 - protein, 18 aa, Homo sapiens
  Payload ID: 19697
  Gene Name: zinc finger and BTB domain containing 7C
  ENSP ID: ENSP00000468814
MANDIDELIGIPFPNHSS

SEQ ID NO: 98667 - protein, 76 aa, Homo sapiens
  Payload ID: 19698
  Gene Name: zinc finger and BTB domain containing 8 opposite strand
  ENSP ID: ENSP00000343760
MKGGSRVSNPAVMAQEEEDVRDYNLTEEQKAIKAKYPPVNRKYEYQQTHLLQSPHRIYSHLHSSAIWNPYLHLMGT

SEQ ID NO: 98668 - protein, 131 aa, Homo sapiens
  Payload ID: 19698
  Gene Name: zinc finger and BTB domain containing 8 opposite strand
  Uniprot ID: Q8IWT0
  ENSP ID: ENSP00000362600
MFQSWLHAWGDTLEEAFEQCAMAMFGYMTDTGTVEPLQTVEVETQGDDLQSLLFHFLDEWLYKFSADEFFIPREVKVLSIDQRNFKLRSIGWGEEFSLSKHPQGTEVKAITYSAMQVYNEENPEVFVIIDI

SEQ ID NO: 98669 - protein, 147 aa, Homo sapiens
  Payload ID: 19698
  Gene Name: zinc finger and BTB domain containing 8 opposite strand
  ENSP ID: ENSP00000413485
  MOD_RES (1)..(1): Any amino acid
XGGSRVSNPAVMAQEEEDVRDYNLTEEQKAIKAKYPPVNRKYEYLDHTADVQLHAWGDTLEEAFEQCAMAMFGYMTDTGTVEPLQTVEVETQGDDLQSLLFHFLDEWLYKFSADEFFIPRVGRRIFIVQAPSGNRSQSNNIFSNAGL

SEQ ID NO: 98670 - protein, 179 aa, Homo sapiens
  Payload ID: 19698
  Gene Name: zinc finger and BTB domain containing 8 opposite strand
  ENSP ID: ENSP00000417677
MKGGSRVSNPAVMAQEEEDVRDYNLTEEQKAIKAKYPPVNRKYEYLDHTADVQLHAWGDTLEEAFEQCAMAMFGYMTDTGTVEPLQTVEVETQGDDLQSLLFHFLDEWLYKFSADEFFIPREVKVLSIDQRNFKLRSIGWGEEFSLSKHPQGTEVKAITYSAMQVYNEENPEVFVIIDI

SEQ ID NO: 98671 - protein, 78 aa, Homo sapiens
  Payload ID: 19698
  Gene Name: zinc finger and BTB domain containing 8 opposite strand
  ENSP ID: ENSP00000474993
AVMAQEEEDVRDYNLTEEQKAIKAKYPPVNRKYEYLDHTADVHGLYYTEHEYTSLGYTHGEILWRKHLSNVQWPCLVT

SEQ ID NO: 98672 - protein, 56 aa, Homo sapiens
  Payload ID: 19698
  Gene Name: zinc finger and BTB domain containing 8 opposite strand
  ENSP ID: ENSP00000477945
MKGGSRVSNPAVMAQEEEDVRDYNLTEEQKAIKAKYPPVNRKYELDCITQSMNILL

SEQ ID NO: 98673 - protein, 56 aa, Homo sapiens
  Payload ID: 19698
  Gene Name: zinc finger and BTB domain containing 8 opposite strand
  ENSP ID: ENSP00000478932
RVSNPAVMAQEEEDVRDYNLTEEQKAIKAKYPPVNRKYECEFGSYSRCPWIVLHRA

SEQ ID NO: 98674 - protein, 72 aa, Homo sapiens
  Payload ID: 19698
  Gene Name: zinc finger and BTB domain containing 8 opposite strand
  ENSP ID: ENSP00000479853
  MOD_RES (1)..(1): Any amino acid
XGDTLEEAFEQCAMAMFGYMTDTGTVEPLQTVEVETQGDDLQSLLFHFLDEWLYKFSADEFFIPRKLCAIVF

SEQ ID NO: 98675 - protein, 110 aa, Homo sapiens
  Payload ID: 19698
  Gene Name: zinc finger and BTB domain containing 8 opposite strand
  ENSP ID: ENSP00000481039
MAMFGYMTDTGTVEPLQTVEVETQGDDLQSLLFHFLDEWLYKFSADEFFIPREVKVLSIDQRNFKLRSIGWGEEFSLSKHPQGTEVKAITYSAMQVYNEENPEVFVIIDI

SEQ ID NO: 98676 - protein, 169 aa, Homo sapiens
  Payload ID: 19698
  Gene Name: zinc finger and BTB domain containing 8 opposite strand
  ENSP ID: ENSP00000483675
  MOD_RES (1)..(1): Any amino acid
XSRVSNPAVMAQEEEDVRDYNLTEEQKAIKAKYPPVNRKYECELHAWGDTLEEAFEQCAMAMFGYMTDTGTVEPLQTVEVETQGDDLQSLLFHFLDEWLYKFSADEFFIPREVKVLSIDQRNFKLRSIGWGEEFSLSKHPQGTEVKAITYSAMQVYNEENPEVFVIIDI

SEQ ID NO: 98677 - protein, 88 aa, Homo sapiens
  Payload ID: 19698
  Gene Name: zinc finger and BTB domain containing 8 opposite strand
  ENSP ID: ENSP00000484207
  MOD_RES (1)..(1): Any amino acid
XVSNPAVMAQEEEDVRDYNLTEEQKAIKAKYPPVNRKYEYLDHTADVQWGEEFSLSKHPQGTEVKAITYSAMQVYNEENPEVFVIIDI

SEQ ID NO: 98678 - protein, 340 aa, Homo sapiens
  Payload ID: 19699
  Gene Name: zinc finger and BTB domain containing 8A
  ENSP ID: ENSP00000317561
MEISSHQSHLLQQLNEQRRQDVFCDCSILVEGKVFKAHRNVLFASSGYFKMLLSQNSKETSQPTTATFQAFSPDTFTVILDFVYSGKLSLTGQNVIEVMSAASFLQMTDVISVCKTFIKSSLDISEKEKDRYFSLSDKDANSNGVERSSFYSGGWQEGSSSPRSHLSPEQGTGIISGKSWNKYNYHPASQKNTQQPLAKHEPRKESIKKTKHLRLSQPSEVTHYKSSKREVRTSDSSSHVSQSEEQAQIDAEMDSTPVGYQYGQGSDVTSKSFPDDLPRMRFKCPYCTHVVKRKADLKRHLRCHTGERPYPCQACGKRFSRLDHLSSHFRTMEIRIPDGT

SEQ ID NO: 98679 - protein, 441 aa, Homo sapiens
  Payload ID: 19699
  Gene Name: zinc finger and BTB domain containing 8A
  Uniprot ID: Q96BR9
  ENSP ID: ENSP00000362609
MEISSHQSHLLQQLNEQRRQDVFCDCSILVEGKVFKAHRNVLFASSGYFKMLLSQNSKETSQPTTATFQAFSPDTFTVILDFVYSGKLSLTGQNVIEVMSAASFLQMTDVISVCKTFIKSSLDISEKEKDRYFSLSDKDANSNGVERSSFYSGGWQEGSSSPRSHLSPEQGTGIISGKSWNKYNYHPASQKNTQQPLAKHEPRKESIKKTKHLRLSQPSEVTHYKSSKREVRTSDSSSHVSQSEEQAQIDAEMDSTPVGYQYGQGSDVTSKSFPDDLPRMRFKCPYCTHVVKRKADLKRHLRCHTGERPYPCQACGKRFSRLDHLSSHFRTIHQACKLICRKCKRHVTDLTGQVVQEGTRRYRLCNECLAEFGIDSLPIDLEAEQHLMSPSDGDKDSRWHLSEDENRSYVEIVEDGSADLVIQQVDDSEEEEEKEIKPNIR

SEQ ID NO: 98680 - protein, 495 aa, Homo sapiens
  Payload ID: 19700
  Gene Name: zinc finger and BTB domain containing 8B
  Uniprot ID: Q8NAP8
  ENSP ID: ENSP00000476499
MEMQSYYAKLLGELNEQRKRDFFCDCSIIVEGRIFKAHRNILFANSGYFRALLIHYIQDSGRHSTASLDIVTSDAFSIILDFLYSGKLDLCGENVIEVMSAASYLQMNDVVNFCKTYIRSSLDICRKMEKEAAVAAAVAAAAAAAAAAAAAAAHQVDSESPSSGREGTSCGTKSLVSSPAEGEKSVECLRESPCGDCGDCHPLELVVRDSLGGGSADSNLSTPPKRIEPKVEFDADEVEVDVGEQLQQYAAPLNLAHVEEALPSGQAVDLAYSNYHVKQFLEALLRNSAAPSKDDADHHFSRSLEGRPEGAGVAMSSMMDVQADWYGEDSGDVLVVPIKLHKCPFCPYTAKQKGILKRHIRSHTGERPYPCETCGKRFTRQEHLRSHALSVHRSNRPIICKGCRRTFTSHLSQGLRRFGLCDSCTCVTDTPDDDDDLMPINLSLVEASSESQEKSDTDNDWPIYVESGEENDPAGDDSDDKPQIQPNLSDRETLT

SEQ ID NO: 98681 - protein, 473 aa, Homo sapiens
  Payload ID: 19701
  Gene Name: zinc finger and BTB domain containing 9
  Uniprot ID: Q96C00
  ENSP ID: ENSP00000378503
METPTPLPPVPASPTCNPAPRTIQIEFPQHSSSLLESLNRHRLEGKFCDVSLLVQGRELRAHKAVLAAASPYFHDKLLLGDAPRLTLPSVIEADAFEGLLQLIYSGRLRLPLDALPAHLLVASGLQMWQVVDQCSEILRELETSGGGISARGGNSYHALLSTTSSTGGWCIRSSPFQTPVQSSASTESPASTESPVGGEGSELGEVLQIQVEEEEEEEEDDDDEDQGSATLSQTPQPQRVSGVFPRPHGPHPLPMTATPRKLPEGESAPLELPAPPALPPKIFYIKQEPFEPKEEISGSGTQPGGAKEETKVFSGGDTEGNGELGFLLPSGPGPTSGGGGPSWKPVDLHGNEILSGGGGPGGAGQAVHGPVKLGGTPPADGKRFGCLCGKRFAVKPKRDRHIMLTFSLRPFGCGICNKRFKLKHHLTEHMKTHAGALHACPHCGRRFRVHACFLRHRDLCKGQGWATAHWTYK

SEQ ID NO: 98682 - protein, 473 aa, Homo sapiens; identical to SEQ ID NO: 98681
  Payload ID: 19701
  Gene Name: zinc finger and BTB domain containing 9
  Uniprot ID: Q96C00
  ENSP ID: ENSP00000413557

SEQ ID NO: 98683 - protein, 116 aa, Homo sapiens
  Payload ID: 19701
  Gene Name: zinc finger and BTB domain containing 9
  ENSP ID: ENSP00000478118
  MOD_RES (1)..(1): Any amino acid
XIYSGRLRLPLDALPAHLLVASGLQMWQEAGAFALRLSRPQYSPLLLLKALLPLRALWEGREVNWEKCCKFRWKKKRRRRKMMMMRTRGQPHSLRLLSPREYQGFFPVLMDPTHCP

SEQ ID NO: 98684 - protein, 138 aa, Homo sapiens
  Payload ID: 19701
  Gene Name: zinc finger and BTB domain containing 9
  ENSP ID: ENSP00000484265
METPTPLPPVPASPTCNPAPRTIQIEFPQHSSSLLESLNRHRLEGKFCDVSLLVQGRELRAHKAVLAAASPYFHDKLLLGDAPRLTLPSVIEADAFEGLLQLIYSGRLRLPLDALPAHLLVASGLQMWQVVDQCSEIL

SEQ ID NO: 98685 - protein, 79 aa, Homo sapiens
  Payload ID: 19701
  Gene Name: zinc finger and BTB domain containing 9
  ENSP ID: ENSP00000484571
METPTPLPPVPASPTCNPAPRTIQIEFPQHSSSLLESLNRHRLEGKFCDVSLLVQGRELRAHKAVLAAASPYFHDKLLL

SEQ ID NO: 98686 - protein, 408 aa, Homo sapiens
  Payload ID: 19702
  Gene Name: zinc finger and SCAN domain containing 1
  Uniprot ID: Q8NBB4
  ENSP ID: ENSP00000282326
MLPRPKAPASPRRPQTPTPSEQDADPGPASPRDTEAQRLRFRQFQYHVASGPHLALGQLWTLCRQWLRPEARSKEQMLELLVLEQFLGALPSKMRTWVQSQGPRSCREAASLVEDLTQMCQQEVLVSLDSVEPQDWSFGEEEDGKSPRSQKEPSQASELILDAVAAAPALPEESEWLETTQLQQSLHTRAEAEAPRAPGLLGSRARLPLKPSIWDEPEDLLAGPSSDLRAEGTVISSPKGPSAQRISPRRRNRNTDQSGRHQPSLKHTKGGTQEAVAGISVVPRGPRGGRPFQCADCGMVFTWVTHFIEHQKTHREEGPFPCPECGKVFLHNSVLTEHGKIHLLEPPRKKAPRSKGPRESVPPRDGAQGPVAPRSPKRPFQCSVCGKAFPWMVHLIDHQKLHTAHGHM

SEQ ID NO: 98687 - protein, 178 aa, Homo sapiens
  Payload ID: 19702
  Gene Name: zinc finger and SCAN domain containing 1
  ENSP ID: ENSP00000375581
MLPRPKAPASPRRPQTPTPSEQDADPGPASPRDTEAQRLRFRQFQYHVASGPHLALGQLWTLCRQWLRPEARSKEQMLELLVLEQFLGALPSKMRTWVQSQGPRSCREAASLVEDLTQMCQQEGERRRLPAPGRARGPDVSEDRTALLPAHIAPTPARPLPTSKPLLPRGCVFNYFYI

SEQ ID NO: 98688 - protein, 178 aa, Homo sapiens; identical to SEQ ID NO: 98687
  Payload ID: 19702
  Gene Name: zinc finger and SCAN domain containing 1
  ENSP ID: ENSP00000470438

SEQ ID NO: 98689 - protein, 725 aa, Homo sapiens
  Payload ID: 19703
  Gene Name: zinc finger and SCAN domain containing 10
  Uniprot ID: Q96SZ4
  ENSP ID: ENSP00000252463
MGPRASLSRLRELCGHWLRPALHTKKQILELLVLEQFLSVLPPHLLGRLQGQPLRDGEEVVLLLEGIHREPSHAGPLDFSCNAGKSCPRADVTLEEKGCASQVPSHSPKKELPAEEPSVLGPSDEPPRPQPRAAQPAEPGQWRLPPSSKQPLSPGPQKTFQALQESSPQGPSPWPEESSRDQELAAVLECLTFEDVPENKAWPAHPLGFGSRTPDKEEFKQEEPKGAAWPTPILAESQADSPGVPGEPCAQSLGRGAAASGPGEDGSLLGSSEILEVKVAEGVPEPNPELQFICADCGVSFPQLSRLKAHQLRSHPAGRSFLCLCCGKSFGRSSILKLHMRTHTDERPHACHLCGHRFRQSSHLSKHLLTHSSEPAFLCAECGRGFQRRASLVQHLLAHAQDQKPPCAPESKAEAPPLTDVLCSHCGQSFQRRSSLKRHLRIHARDKDRRSSEGSGSRRRDSDRRPFVCSDCGKAFRRSEHLVAHRRVHTGERPFSCQACGRSFTQSSQLVSHQRVHTGEKPYACPQCGKRFVRRASLARHLLTHGGPRPHHCTQCGKSFGQTQDLARHQRSHTGEKPCRCSECGEGFSQSAHLARHQRIHTGEKPHACDTCGHRFRNSSNLARHRRSHTGERPYSCQTCGRSFRRNAHLRRHLATHAEPGQEQAEPPQECVECGKSFSRSCNLLRHLLVHTGARPYSCTQCGRSFSRNSHLLRHLRTHARETLY

SEQ ID NO: 98690 - protein, 643 aa, Homo sapiens
  Payload ID: 19703
  Gene Name: zinc finger and SCAN domain containing 10
  Uniprot ID: Q96SZ4
  ENSP ID: ENSP00000440047
MLPVSGGHGATGVPEPAPGALRPLAAAGSAHQETDPGAAGAGAVPECAASAPPGPPAGAAAQGWGGGGAAARGHPPGAQPRGAAGPQGPSPWPEESSRDQELAAVLECLTFEDVPENKAWPAHPLGFGSRTPDKEEFKQEEPKGAAWPTPILAESQADSPGVPGEPCAQSLGRGAAASGPGEDGSLLGSSEILEVKVAEGVPEPNPELQFICADCGVSFPQLSRLKAHQLRSHPAGRSFLCLCCGKSFGRSSILKLHMRTHTDERPHACHLCGHRFRQSSHLSKHLLTHSSEPAFLCAECGRGFQRRASLVQHLLAHAQDQKPPCAPESKAEAPPLTDVLCSHCGQSFQRRSSLKRHLRIHARDKDRRSSEGSGSRRRDSDRRPFVCSDCGKAFRRSEHLVAHRRVHTGERPFSCQACGRSFTQSSQLVSHQRVHTGEKPYACPQCGKRFVRRASLARHLLTHGGPRPHHCTQCGKSFGQTQDLARHQRSHTGEKPCRCSECGEGFSQSAHLARHQRIHTGEKPHACDTCGHRFRNSSNLARHRRSHTGERPYSCQTCGRSFRRNAHLRRHLATHAEPGQEQAEPPQECVECGKSFSRSCNLLRHLLVHTGARPYSCTQCGRSFSRNSHLLRHLRTHARETLY

SEQ ID NO: 98691 - protein, 161 aa, Homo sapiens
  Payload ID: 19703
  Gene Name: zinc finger and SCAN domain containing 10
  ENSP ID: ENSP00000458260
MLGESVPAAVEQEQLGEVKLEEEEAVSPEDPRRPESRLRPEVAHQLFRCFQYQEDMGPRASLSRLRELCGHWLRPALHTKKQILELLVLEQFLSVLPPHLLGRLQGQPLRDGEEVVLLLEGIHREPSHAGPLDFSCNAGKSCPRADVTLEEKGCASQVPSH

SEQ ID NO: 98692 - protein, 780 aa, Homo sapiens
  Payload ID: 19703
  Gene Name: zinc finger and SCAN domain containing 10
  ENSP ID: ENSP00000458879
MLGESVPAAVEQEQLGEVKLEEEEAVSPEDPRRPESRLRPEVAHQLFRCFQYQEDMGPRASLSRLRELCGHWLRPALHTKKQILELLVLEQFLSVLPPHLLGRLQGQPLRDGEEVVLLLEGIHREPSHAGPLDFSCNAGKSCPRADVTLEEKGCASQVPSHSPKKELPAEEPSVLGPSDEPPRPQPRAAQPAEPGQWRLPPSSKQPLSPGPQKTFQALQESSPQGPSPWPEESSRDQELAAVLECLTFEDVPENKAWPAHPLGFGSRTPDKEEFKQEEPKGAAWPTPILAESQADSPGVPGEPCAQSLGRGAAASGPGEDGSLLGSSEILEVKVAEGVPEPNPELQFICADCGVSFPQLSRLKAHQLRSHPAGRSFLCLCCGKSFGRSSILKLHMRTHTDERPHACHLCGHRFRQSSHLSKHLLTHSSEPAFLCAECGRGFQRRASLVQHLLAHAQDQKPPCAPESKAEAPPLTDVLCSHCGQSFQRRSSLKRHLRIHARDKDRRSSEGSGSRRRDSDRRPFVCSDCGKAFRRSEHLVAHRRVHTGERPFSCQACGRSFTQSSQLVSHQRVHTGEKPYACPQCGKRFVRRASLARHLLTHGGPRPHHCTQCGKSFGQTQDLARHQRSHTGEKPCRCSECGEGFSQSAHLARHQRIHTGEKPHACDTCGHRFRNSSNLARHRRSHTGERPYSCQTCGRSFRRNAHLRRHLATHAEPGQEQAEPPQECVECGKSFSRSCNLLRHLLVHTGARPYSCTQCGRSFSRNSHLLRHLRTHARETLY

SEQ ID NO: 98693 - protein, 386 aa, Homo sapiens
  Payload ID: 19703
  Gene Name: zinc finger and SCAN domain containing 10
  Uniprot ID: Q96SZ4
  ENSP ID: ENSP00000459520
MRTHTDERPHACHLCGHRFRQSSHLSKHLLTHSSEPAFLCAECGRGFQRRASLVQHLLAHAQDQKPPCAPESKAEAPPLTDVLCSHCGQSFQRRSSLKRHLRIHARDKDRRSSEGSGSRRRDSDRRPFVCSDCGKAFRRSEHLVAHRRVHTGERPFSCQACGRSFTQSSQLVSHQRVHTGEKPYACPQCGKRFVRRASLARHLLTHGGPRPHHCTQCGKSFGQTQDLARHQRSHTGEKPCRCSECGEGFSQSAHLARHQRIHTGEKPHACDTCGHRFRNSSNLARHRRSHTGERPYSCQTCGRSFRRNAHLRRHLATHAEPGQEQAEPPQECVECGKSFSRSCNLLRHLLVHTGARPYSCTQCGRSFSRNSHLLRHLRTHARETLY

SEQ ID NO: 98694 - protein, 6 aa, Homo sapiens
  Payload ID: 19703
  Gene Name: zinc finger and SCAN domain containing 10
  ENSP ID: ENSP00000460473
MRTHTD

SEQ ID NO: 98695 - protein, 111 aa, Homo sapiens
  Payload ID: 19703
  Gene Name: zinc finger and SCAN domain containing 10
  ENSP ID: ENSP00000461871
MLGESVPAAVEQEQLGEVKLEEEEAVSPEDPRRPESRLRPEVAHQLFRCFQYQEDMGPRASLSRLRELCGHWLRPALHTKKQILELLVPRAPHHGQRRVPEIRSWRLCWSA

SEQ ID NO: 98696 - protein, 604 aa, Homo sapiens
  Payload ID: 19704
  Gene Name: zinc finger and SCAN domain containing 12
  Uniprot ID: O43309
  ENSP ID: ENSP00000354305
MASTWAIQAHMDQDEPLEVKIEEEKYTTRQDWDLRKNNTHSREVFRQYFRQFCYQETSGPREALSRLRELCHQWLRPETHTKEQILELLVLEQFLTILPEELQAWVQEQHPESGEEVVTVLEDLERELDEPGEQVSVHTGEQEMFLQETVRLRKEGEPSMSLQSMKAQPKYESPELESQQEQVLDVETGNEYGNLKQEVSEEMEPHGKTSSKFENDMSKSARCGETREPEEITEEPSACSREDKQPTCDENGVSLTENSDHTEHQRICPGEESYGCDDCGKAFSQHSHLIEHQRIHTGDRPYKCEECGKAFRGRTVLIRHKIIHTGEKPYKCNECGKAFGRWSALNQHQRLHTGEKHYHCNDCGKAFSQKAGLFHHIKIHTRDKPYQCTQCNKSFSRRSILTQHQGVHTGAKPYECNECGKAFVYNSSLVSHQEIHHKEKCYQCKECGKSFSQSGLIQHQRIHTGEKPYKCDVCEKAFIQRTSLTEHQRIHTGERPYKCDKCGKAFTQRSVLTEHQRIHTGERPYKCDECGNAFRGITSLIQHQRIHTGEKPYQCDECGKAFRQRKKTSYKEILLKNHSEPQAGVNLLLSSLIPEWQSCFRRDL

SEQ ID NO: 98697 - protein, 604 aa, Homo sapiens; identical to SEQ ID NO: 98696
  Payload ID: 19704
  Gene Name: zinc finger and SCAN domain containing 12
  Uniprot ID: O43309
  ENSP ID: ENSP00000380039

SEQ ID NO: 98698 - protein, 348 aa, Homo sapiens
  Payload ID: 19705
  Gene Name: zinc finger and SCAN domain containing 16
  Uniprot ID: Q9H4T2
  ENSP ID: ENSP00000366527
MTTALEPEDQKGLLIIKAEDHYWGQDSSSQKCSPHRRELYRQHFRKLCYQDAPGPREALTQLWELCRQWLRPECHTKEQILDLLVLEQFLSILPKDLQAWVRAHHPETGEEAVTVLEDLERELDEPGKQVPGNSERRDILMDKLAPLGRPYESLTVQLHPKKTQLEQEAGKPQRNGDKTRTKNEELFQKEDMPKDKEFLGEINDRLNKDTPQHPKSKDIIENEGRSEWQQRERRRYKCDECGKSFSHSSDLSKHRRTHTGEKPYKCDECGKAFIQRSHLIGHHRVHTGVKPYKCKECGKDFSGRTGLIQHQRIHTGEKPYECDECGRPFRVSSALIRHQRIHTANKLY

SEQ ID NO: 98699 - protein, 510 aa, Homo sapiens
  Payload ID: 19706
  Gene Name: zinc finger and SCAN domain containing 18
  Uniprot ID: Q8TBC5
  ENSP ID: ENSP00000240727
MLPLEKAFASPRSSPAPPDLPTPGSAAGVQQEEPETIPERTPADLEFSRLRFREFVYQEAAGPHQTLARLHELCRQWLMPEARSKEQMLELLVLEQFLGILPDKVRPWVVAQYPESCKKAASLVEGLADVLEEPGMLLGSPAGSSSILSDGVYERHMDPLLLPGELASPSQALGAGEIPAPSETPWLSPDPLFLEQRRVREAKTEEDGPANTEQKLKSFPEDPQHLGEWGHLDPAEENLKSYRKLLLWGYQLSQPDAASRLDTEELRLVERDPQGSSLPEGGRRQESAGCACEEAAPAGVLPELPTEAPPGDALADPPSGTTEEEEEQPGKAPDPQDPQDAESDSATGSQRQSVIQQPAPDRGTAKLGTKRPHPEDGDGQSLEGVSSSGDSAGLEAGQGPGADEPGLSRGKPYACGECGEAFAWLSHLMEHHSSHGGRKRYACQGCWKTFHFSLALAEHQKTHEKEKSYALGGARGPQPSTREAQAGARAGGPPESVEGEAPPAPPEAQR

SEQ ID NO: 98700 - protein, 374 aa, Homo sapiens
  Payload ID: 19706
  Gene Name: zinc finger and SCAN domain containing 18
  Uniprot ID: Q8TBC5
  ENSP ID: ENSP00000392653
MLLGSPAGSSSILSDGVYERHMDPLLLPGELASPSQALGAGEIPAPSETPWLSPDPLFLEQRRVREAKTEEDGPANTEQKLKSFPEDPQHLGEWGHLDPAEENLKSYRKLLLWGYQLSQPDAASRLDTEELRLVERDPQGSSLPGGRRQESAGCACEEAAPAGVLPELPTEAPPGDALADPPSGTTEEEEEQPGKAPDPQDPQDAESDSATGSQRQSVIQQPAPDRGTAKLGTKRPHPEDGDGQSLEGVSSSGDSAGLEAGQGPGADEPGLSRGKPYACGECGEAFAWLSHLMEHHSSHGGRKRYACQGCWKTFHFSLALAEHQKTHEKEKSYALGGARGPQPSTREAQAGARAGGPPESVEGEAPPAPPEAQR

SEQ ID NO: 98701 - protein, 407 aa, Homo sapiens
  Payload ID: 19706
  Gene Name: zinc finger and SCAN domain containing 18
  ENSP ID: ENSP00000412253
DKVRPWVVAQYPESCKKAASLVEGLADVLEEPGMLLGSPAGSSSILSDGVYERHMDPLLLPGELASPSQALGAGEIPAPSETPWLSPDPLFLEQRRVREAKTEEDGPANTEQKLKSFPEDPQHLGEWGHLDPAEENLKSYRKLLLWGYQLSQPDAASRLDTEELRLVERDPQGSSLPGGRRQESAGCACEEAAPAGVLPELPTEAPPGDALADPPSGTTEEEEEQPGKAPDPQDPQDAESDSATGSQRQSVIQQPAPDRGTAKLGTKRPHPEDGDGQSLEGVSSSGDSAGLEAGQGPGADEPGLSRGKPYACGECGEAFAWLSHLMEHHSSHGGRKRYACQGCWKTFHFSLALAEHQKTHEKEKSYALGGARGPQPSTREAQAGARAGGPPESVEGEAPPAPPEAQR

SEQ ID NO: 98702 - protein, 510 aa, Homo sapiens; identical to SEQ ID NO: 98699
  Payload ID: 19706
  Gene Name: zinc finger and SCAN domain containing 18
  Uniprot ID: Q8TBC5
  ENSP ID: ENSP00000468934

SEQ ID NO: 98703 - protein, 11 aa, Homo sapiens
  Payload ID: 19706
  Gene Name: zinc finger and SCAN domain containing 18
  ENSP ID: ENSP00000469201
MLPLEKAFASP

SEQ ID NO: 98704 - protein, 566 aa, Homo sapiens
  Payload ID: 19706
  Gene Name: zinc finger and SCAN domain containing 18
  Uniprot ID: Q8TBC5
  ENSP ID: ENSP00000470123
MRRVGGRADEDATAAGSLWVLAPPEPTGHLVIPGTSPLEPPCPWLDSHIFQCRFGKMLPLEKAFASPRSSPAPPDLPTPGSAAGVQQEEPETIPERTPADLEFSRLRFREFVYQEAAGPHQTLARLHELCRQWLMPEARSKEQMLELLVLEQFLGILPDKVRPWVVAQYPESCKKAASLVEGLADVLEEPGMLLGSPAGSSSILSDGVYERHMDPLLLPGELASPSQALGAGEIPAPSETPWLSPDPLFLEQRRVREAKTEEDGPANTEQKLKSFPEDPQHLGEWGHLDPAEENLKSYRKLLLWGYQLSQPDAASRLDTEELRLVERDPQGSSLPEGGRRQESAGCACEEAAPAGVLPELPTEAPPGDALADPPSGTTEEEEEQPGKAPDPQDPQDAESDSATGSQRQSVIQQPAPDRGTAKLGTKRPHPEDGDGQSLEGVSSSGDSAGLEAGQGPGADEPGLSRGKPYACGECGEAFAWLSHLMEHHSSHGGRKRYACQGCWKTFHFSLALAEHQKTHEKEKSYALGGARGPQPSTREAQAGARAGGPPESVEGEAPPAPPEAQR

SEQ ID NO: 98705 - protein, 52 aa, Homo sapiens
  Payload ID: 19706
  Gene Name: zinc finger and SCAN domain containing 18
  ENSP ID: ENSP00000470329
  MOD_RES (1)..(1): Any amino acid
XEQRRVREAKTEEDGPANTEQGISFPSLTLPPGWTLRNSGWWKEIHKEAASQ

SEQ ID NO: 98706 - protein, 39 aa, Homo sapiens
  Payload ID: 19706
  Gene Name: zinc finger and SCAN domain containing 18
  ENSP ID: ENSP00000471570
MRRVGGRADEDATAAGTWETKVKWKHQLGMVLGRNYPIW

SEQ ID NO: 98707 - protein, 184 aa, Homo sapiens
  Payload ID: 19706
  Gene Name: zinc finger and SCAN domain containing 18
  ENSP ID: ENSP00000472129
MLPLEKAFASPRSSPAPPDLPTPGSAAGVQQEEPETIPERTPADLEFSRLRFREFVYQEAAGPHQTLARLHELCRQWLMPEARSKEQMLELLVLEQFLGILPDKVRPWVVAQYPESCKKAASLVEGLADVLEEPGMLLGSPAGSSSILSDGVYERHMDPLLLPGELASPSQALGAGEIPAPSET

SEQ ID NO: 98708 - protein, 185 aa, Homo sapiens
  Payload ID: 19706
  Gene Name: zinc finger and SCAN domain containing 18
  ENSP ID: ENSP00000473019
MLPLEKAFASPRSSPAPPDLPTPGSAAGVQQEEPETIPERTPADLEFSRLRFREFVYQEAAGPHQTLARLHELCRQWLMPEARSKEQMLELLVLEQFLGILPDKVRPWVVAQYPESCKKAASLVEGLADVLEEPGMLLGSPAGSSSILSDGVYERHMDPLLLPGELASPSQALGAGEIPAPSETR

SEQ ID NO: 98709 - protein, 113 aa, Homo sapiens
  Payload ID: 19706
  Gene Name: zinc finger and SCAN domain containing 18
  ENSP ID: ENSP00000473134
MRRVGGRADEDATAAGSEFRPLAASRVCFLRSRPPVAEPRPSEGLWVLAPPEPTGHLVIPGTSPLEPPCPWLDSHIFQCRFGKMLPLEKAFASPRSSPAPPDLPTPGSAAGVQ

SEQ ID NO: 98710 - protein, 613 aa, Homo sapiens
  Payload ID: 19707
  Gene Name: zinc finger and SCAN domain containing 2
  ENSP ID: ENSP00000325123
MMAADIPRVTTPLSSLVQVPQEEDRQEEEVTTMILEDDSWVQEAVLQEDGPESEPFPQSAGKGGPQEEVTRGPQGALGRLRELCRRWLRPEVHTKEQMLTMLPKEIQAWLQEHRPESSEEAAALVEDLTQTLQDNFEIQSENGENCNQDMFENESRKIFSEMPEGESAQHSDGESDFERDAGIQRLQGHSPGEDHGEVVSQDREVGQLIGLQGTYLGEKPYECPQCGKTFSRKSHLITHERTHTGEKYYKCDECGKSFSDGSNFSRHQTTHTGEKPYKCRDCGKSFSRSANLITHQRIHTGEKPFQCAECGKSFSRSPNLIAHQRTHTGEKPYSCPECGKSFGNRSSLNTHQGIHTGEKPYECKECGESFSYNSNLIRHQRIHTGEKPYKCTDCGQRFSQSSALITHRRTHTGEKPYQCSECGKSFSRSSNLATHRRTHMVEKPYKCGVCGKSFSQSSSLIAHQGMHTGEKPYECLTCGESFSWSSNLLKHQRIHTGEKPYKCSECGKCFSQRSQLVVHQRTHTGEKPYKCLMCGKSFSRGSILVMHQRAHLGDKPYRCPECGKGFSWNSVLIIHQRIHTGEKPYKCPECGKGFSNSSNFITHQRTHMKEKLY

SEQ ID NO: 98711 - protein, 150 aa, Homo sapiens
  Payload ID: 19707
  Gene Name: zinc finger and SCAN domain containing 2
  Uniprot ID: Q7Z7L9
  ENSP ID: ENSP00000333895
MMAADIPRVTTPLSSLVQVPQEEDRQEEEVTTMILEDDSWVQEAVLQEDGPESEPFPQSAGKGGPQEEVTRGPQGALGRLRELCRRWLRPEVHTKEQMLTMLPKEIQAWLQEHRPESSEEAAALVEDLTQTLQDSAVAVVASLPVEVTSL

SEQ ID NO: 98712 - protein, 464 aa, Homo sapiens
  Payload ID: 19707
  Gene Name: zinc finger and SCAN domain containing 2
  ENSP ID: ENSP00000351257
MFENESRKIFSEMPEGESAQHSDGESDFERDAGIQRLQGHSPGEDHGEVVSQDREVGQLIGLQGTYLGEKPYECPQCGKTFSRKSHLITHERTHTGEKYYKCDECGKSFSDGSNFSRHQTTHTGEKPYKCRDCGKSFSRSANLITHQRIHTGEKPFQCAECGKSFSRSPNLIAHQRTHTGEKPYSCPECGKSFGNRSSLNTHQGIHTGEKPYECKECGESFSYNSNLIRHQRIHTGEKPYKCTDCGQRFSQSSALITHRRTHTGEKPYQCSECGKSFSRSSNLATHRRTHMVEKPYKCGVCGKSFSQSSSLIAHQGMHTGEKPYECLTCGESFSWSSNLLKHQRIHTGEKPYKCSECGKCFSQRSQLVVHQRTHTGEKPYKCLMCGKSFSRGSILVMHQRAHLGDKPYRCPECGKGFSWNSVLIIHQRIHTGEKPYKCPECGKGFSNSSNFITHQRTHMKEKLY

SEQ ID NO: 98713 - protein, 146 aa, Homo sapiens
  Payload ID: 19707
  Gene Name: zinc finger and SCAN domain containing 2
  Uniprot ID: Q7Z7L9
  ENSP ID: ENSP00000368663
MMAADIPRVTTPLSSLVQVPQEEDRQEEEVTTMILEDDSWVQEAVLQEDGPESEPFPQSAGKGGPQEEVTRGPQGALGRLRELCRRWLRPEVHTKEQMLTMLPKEIQAWLQEHRPESSEEAAALVEDLTQTLQDSETASCVHGCPV

SEQ ID NO: 98714 - protein, 614 aa, Homo sapiens
  Payload ID: 19707
  Gene Name: zinc finger and SCAN domain containing 2
  Uniprot ID: Q7Z7L9
  ENSP ID: ENSP00000410198
MMAADIPRVTTPLSSLVQVPQEEDRQEEEVTTMILEDDSWVQEAVLQEDGPESEPFPQSAGKGGPQEEVTRGPQGALGRLRELCRRWLRPEVHTKEQMLTMLPKEIQAWLQEHRPESSEEAAALVEDLTQTLQDSDFEIQSENGENCNQDMFENESRKIFSEMPEGESAQHSDGESDFERDAGIQRLQGHSPGEDHGEVVSQDREVGQLIGLQGTYLGEKPYECPQCGKTFSRKSHLITHERTHTGEKYYKCDECGKSFSDGSNFSRHQTTHTGEKPYKCRDCGKSFSRSANLITHQRIHTGEKPFQCAECGKSFSRSPNLIAHQRTHTGEKPYSCPECGKSFGNRSSLNTHQGIHTGEKPYECKECGESFSYNSNLIRHQRIHTGEKPYKCTDCGQRFSQSSALITHRRTHTGEKPYQCSECGKSFSRSSNLATHRRTHMVEKPYKCGVCGKSFSQSSSLIAHQGMHTGEKPYECLTCGESFSWSSNLLKHQRIHTGEKPYKCSECGKCFSQRSQLVVHQRTHTGEKPYKCLMCGKSFSRGSILVMHQRAHLGDKPYRCPECGKGFSWNSVLIIHQRIHTGEKPYKCPECGKGFSNSSNFITHQRTHMKEKLY

SEQ ID NO: 98715 - protein, 27 aa, Homo sapiens
  Payload ID: 19707
  Gene Name: zinc finger and SCAN domain containing 2
  ENSP ID: ENSP00000438628
MMAADIPRVTTPLSSLVQVPQEEDRQE

SEQ ID NO: 98716 - protein, 238 aa, Homo sapiens
  Payload ID: 19707
  Gene Name: zinc finger and SCAN domain containing 2
  ENSP ID: ENSP00000439132
MMAADIPRVTTPLSSLVQVPQEEDRQEEEVTTMILEDDSWVQEAVLQEDGPESEPFPQSAGKGGPQEEVTRGPQGALGRLRELCRRWLRPEVHTKEQMLTMLPKEIQAWLQEHRPESSEEAAALVEDLTQTLQDSDFEIQSENGENCNQDMFENESRKIFSEMPEGESAQHSDGESDFERDAGIQRLQGHSPGQDGGASPVLSHPREGKDPFYFQKVSGAQKLEEVQPGASVPVSFPL

SEQ ID NO: 98717 - protein, 32 aa, Homo sapiens
  Payload ID: 19707
  Gene Name: zinc finger and SCAN domain containing 2
  ENSP ID: ENSP00000439584
MMAADIPRVTTPLSSLVQVPQEEDRQEEEVTT

SEQ ID NO: 98718 - protein, 200 aa, Homo sapiens
  Payload ID: 19707
  Gene Name: zinc finger and SCAN domain containing 2
  ENSP ID: ENSP00000440004
MMAADIPRVTTPLSSLVQVPQEEDRQEEEVTTMILEDDSWVQEAVLQEDGPESEPFPQSAGKGGPQEEVTRGPQGALGRLRELCRRWLRPEVHTKEQMLTMLPKEIQAWLQEHRPESSEEAAALVEDLTQTLQDSDFEIQSENGENCNQDMFENESRKIFSEMPEGESAQHSDGESDFERDAGIQRLQGHSPESVRSTET

SEQ ID NO: 98719 - protein, 210 aa, Homo sapiens
  Payload ID: 19707
  Gene Name: zinc finger and SCAN domain containing 2
  ENSP ID: ENSP00000441342
MMAADIPRVTTPLSSLVQVPQEEDRQEEEVTTMILEDDSWVQEAVLQEDGPESEPFPQSAGKGGPQEEVTRGPQGALGRLRELCRRWLRPEVHTKEQMLTMLPKEIQAWLQEHRPESSEEAAALVEDLTQTLQDSDFEIQSENGENCNQDMFENESRKIFSEMPEGESAQHSDGESDFERDAGIQRLQGHSPVETGFHRVSQDGFDLLSS

SEQ ID NO: 98720 - protein, 614 aa, Homo sapiens; identical to SEQ ID NO: 98714
  Payload ID: 19707
  Gene Name: zinc finger and SCAN domain containing 2
  Uniprot ID: Q7Z7L9
  ENSP ID: ENSP00000441855

SEQ ID NO: 98721 - protein, 53 aa, Homo sapiens
  Payload ID: 19707
  Gene Name: zinc finger and SCAN domain containing 2
  ENSP ID: ENSP00000442693
MMAADIPRVTTPLSSLVQVPQEEDRQEEEVTTMILEDDSWVQEAVLQEDGPES

SEQ ID NO: 98722 - protein, 614 aa, Homo sapiens; identical to SEQ ID NO: 98714
  Payload ID: 19707
  Gene Name: zinc finger and SCAN domain containing 2
  Uniprot ID: Q7Z7L9
  ENSP ID: ENSP00000445451

SEQ ID NO: 98723 - protein, 107 aa, Homo sapiens
  Payload ID: 19707
  Gene Name: zinc finger and SCAN domain containing 2
  ENSP ID: ENSP00000446041
MMAADIPRVTTPLSSLVQVPQEEDRQEEEVTTMILEDDSWVQEAVLQEDGPESEPFPQSAGKGGPQEEVTRGPQGALGRLRELCRRWLRPEILRYRVKMGRTVIKTC

SEQ ID NO: 98724 - protein, 1043 aa, Homo sapiens
  Payload ID: 19708
  Gene Name: zinc finger and SCAN domain containing 20
  Uniprot ID: P17040
  ENSP ID: ENSP00000355053
MAMALELQAQASPQPEPEELLIVKLEEDSWGSESKLWEKDRGSVSGPEASRQRFRQFQYRDAAGPHEAFSQLWALCCRWLRPEIRLKEQILELLVLEQFLTILPREVQTWVQARHPESGEEAVALVEDWHRETRTAGQSGLELHTEETRPLKTGEEAQSFQLQPVDPWPEGQSQKKGVKNTCPDLPNHLNAEVAPQPLKESAVLTPRVPTLPKMGSVGDWEVTAESQEALGPGKHAEKELCKDPPGDDCGNSVCLGVPVSKPSNTSEKEQGPEFWGLSLINSGKRSTADYSLDNEPAQALTWRDSRAWEEQYQWDVEDMKVSGVHWGYEETKTFLAILSESPFSEKLRTCHQNRQVYRAIAEQLRARGFLRTLEQCRYRVKNLLRNYRKAKSSHPPGTCPFYEELEALVRARTAIRATDGPGEAVALPRLGYSDAEMDEQEEGGWDPEEMAEDCNGAGLVNVESTQGPRIAGAPALFQSRIAGVHWGYEETKAFLAILSESPFSEKLRTCHQNSQVYRAIAERLCALGFLRTLEQCRYRFKNLLRSYRKAKSSHPPGTCPFYEELDSLMRARAAVRAMGTVREAAGLPRCGQSSAETDAQEAWGEVANEDAVKPSTLCPKAPDMGFEMRHEDEDQISEQDIFEGLPGALSKCPTEAVCQPLDWGEDSENENEDEGQWGNPSQEQWQESSSEEDLEKLIDHQGLYLAEKPYKCDTCMKSFSRSSHFIAHQRIHTGEKPYKCLECGKNFSDRSNLNTHQRIHTGEKPYKCLECGKSFSDHSNLITHQRIHTGEKPYKCGECWKSFNQSSNLLKHQRIHLGGNPDQCSEPGGNFAQSPSFSAHWRNSTEETAPEQPQSISKDLNSPGPHSTNSGEKLYECSECGRSFSKSSALISHQRIHTGEKPYECAECGKSFSKSSTLANHQRTHTGEKPYKCVDCGKCFSERSKLITHQRVHTGEKPYKCLECGKFFRDRSNLITHQRIHTGEKPYKCRECGKCFNQSSSLIIHQRIHTGEKPYKCTECGKDFNNSSHFSAHRRTHAGGKAS

SEQ ID NO: 98725 - protein, 433 aa, Homo sapiens
  Payload ID: 19708
  Gene Name: zinc finger and SCAN domain containing 20
  Uniprot ID: P17040
  ENSP ID: ENSP00000362512
MAMALELQAQASPQPEPEELLIVKLEEDSWGSESKLWEKDRGSVSGPEASRQRFRQFQYRDAAGPHEAFSQLWALCCRWLRPEIRLKEQILELLVLEQFLTILPREVQTWVQARHPESGEEAVALVEDWHRETRTAGQSGLELHTEETRPLKTGEEAQSFQLQPVDPWPEGQSQKKGVKNTCPDLPNHLNAEVAPQPLKESGVPVSKPSNTSEKEQGPEFWGLSLINSGKRSTADYSLDNEPAQALTWRDSRAWEEQYQWDVEDMKVSGVHWGYEETKTFLAILSESPFSEKLRTCHQNRQVYRAIAEQLRARGFLRTLEQCRYRVKNLLRNYRKAKSSHPPGTCPFYEELEALVRARTAIRATDGPGEAVALPRLGYSDAEMDEQEEGGWDPEEMAEDCNGAGLVNVESTQGPRIAGAPALFQSRIGKNMGV

SEQ ID NO: 98726 - protein, 473 aa, Homo sapiens
  Payload ID: 19709
  Gene Name: zinc finger and SCAN domain containing 21
  Uniprot ID: Q9Y5A6
  ENSP ID: ENSP00000292450
MMTKVLGMAPVLGPRPPQEQVGPLMVKVEEKEEKGKYLPSLEMFRQRFRQFGYHDTPGPREALSQLRVLCCEWLRPEIHTKEQILELLVLEQFLTILPQELQAWVQEHCPESAEEAVTLLEDLERELDEPGHQVSTPPNEQKPVWEKISSSGTAKESPSSMQPQPLETSHKYESWGPLYIQESGEEQEFAQDPRKVRDCRLSTQHEESADEQKGSEAEGLKGDIISVIIANKPEASLERQCVNLENEKGTKPPLQEAGSKKGRESVPTKPTPGERRYICAECGKAFSNSSNLTKHRRTHTGEKPYVCTKCGKAFSHSSNLTLHYRTHLVDRPYDCKCGKAFGQSSDLLKHQRMHTEEAPYQCKDCGKAFSGKGSLIRHYRIHTGEKPYQCNECGKSFSQHAGLSSHQRLHTGEKPYKCKECGKAFNHSSNFNKHHRIHTGEKPYWCHHCGKTFCSKSNLSKHQRVHTGEGEAP

SEQ ID NO: 98727 - protein, 450 aa, Homo sapiens
  Payload ID: 19709
  Gene Name: zinc finger and SCAN domain containing 21
  ENSP ID: ENSP00000390960
MMTKVLGMAPVLGPRPPQEQVGPLMVKVEEKEEKGKYLPSLEMFRQRFRQFGYHDTPGPREALSQLRVLCCEWLRPEIHTKEQILELLVLEQFLTILPQELQAWVQEHCPESAEEAVTLLEDLERELDEPGHQVSTPPNEQKPVWEKISSSGTAKESPSSMQPQPLETSHKYESWGPLYIQESGEEQEFAQDPRKVRDCRLSTQHEESADEQKGSEAEGLKGDIISVIIANKPEASLERQCVNLENEKGTKPPLQEAGSKKGEHTLGRNLTCAPSVGKLSATAQTSPSTTEHTWWTGPMTVSVEKLLGRAQTFLNIRECTQKRRHISAKIVARLSAGKAASFVTIGSTLGRSLISVTNVGRASVSMRASAPTRDSTPERSHISVRSVGKPSTTAPTSINTTESTPGKSPTGVITVERPSVASPIFPNISESTLEREKHRNFQALLLLSLF

SEQ ID NO: 98728 - protein, 181 aa, Homo sapiens
  Payload ID: 19709
  Gene Name: zinc finger and SCAN domain containing 21
  ENSP ID: ENSP00000404207
MMTKVLGMAPVLGPRPPQEQVGPLMVKVEEKEEKGKYLPSLEMFRQRFRQFGYHDTPGPREALSQLRVLCCEWLRPEIHTKEQILELLVLEQFLTILPQELQAWVQEHCPESAEEAVTLLEDLERELDEPGHQVSTPPNEQKPVWEKISSSGTAKESPSSMQPQPLETSHKYESWGPLYIQ

SEQ ID NO: 98729 - protein, 436 aa, Homo sapiens
  Payload ID: 19709
  Gene Name: zinc finger and SCAN domain containing 21
  ENSP ID: ENSP00000441212
MMTKVLGMAPVLGPRPPQEQVGPLMVKVEEKEEKGKYLPSLEMFRQRFRQFGYHDTPGPREALSQLRVLCCEWLRPEIHTKEQILELLVLDEPGHQVSTPPNEQKPVWEKISSSGTAKESPSSMQPQPLETSHKYESWGPLYIQESGEEQEFAQDPRKVRDCRLSTQHEESADEQKGSEAEGLKGDIISVIIANKPEASLERQCVNLENEKGTKPPLQEAGSKKGRESVPTKPTPGERRYICAECGKAFSNSSNLTKHRRTHTGEKPYVCTKCGKAFSHSSNLTLHYRTHLVDRPYDCKCGKAFGQSSDLLKHQRMHTEEAPYQCKDCGKAFSGKGSLIRHYRIHTGEKPYQCNECGKSFSQHAGLSSHQRLHTGEKPYKCKECGKAFNHSSNFNKHHRIHTGEKPYWCHHCGKTFCSKSNLSKHQRVHTGEGEAP

SEQ ID NO: 98730 - protein, 491 aa, Homo sapiens
  Payload ID: 19710
  Gene Name: zinc finger and SCAN domain containing 22
  Uniprot ID: P10073
  ENSP ID: ENSP00000332433
MAIPKHSLSPVPWEEDSFLQVKVEEEEEASLSQGGESSHDHIAHSEAARLRFRHFRYEEASGPHEALAHLRALCCQWLQPEAHSKEQILELLVLEQFLGALPPEIQAWVGAQSPKSGEEAAVLVEDLTQVLDKRGWDPGAEPTEASCKQSDLGESEPSNVTETLMGGVSLGPAFVKACEPEGSSERSGLSGEIWTKSVTQQIHFKKTSGPYKDVPTDQRGRESGASRNSSSAWPNLTSQEKPPSEDKFDLVDAYGTEPPYTYSGKRSSKCRECRKMFQSASALEAHQKTHSRKTPYACSECGKAFSRSTHLAQHQVVHTGAKPHECKECGKAFSRVTHLTQHQRIHTGEKPYKCGECGKTFSRSTHLTQHQRVHTGERPYECDACGKAFSQSTHLTQHQRIHTGEKPYKCDACGRAFSDCSALIRHLRIHSGEKPYQCKVCPKAFAQSSSLIEHQRIHTGEKPYKCSDCGKAFSRSSALMVHLRIHITVLQ

SEQ ID NO: 98731 - protein, 389 aa, Homo sapiens
  Payload ID: 19711
  Gene Name: zinc finger and SCAN domain containing 23
  Uniprot ID: Q3MJ62
  ENSP ID: ENSP00000289788
MAITLTLQTAEMQEGLLAVKVKEEEEEHSCGPESGLSRNNPHTREIFRRRFRQFCYQESPGPREALQRLQELCHQWLRPEMHTKEQILELLVLEQFLTILPEELQAWVRQHRPVSGEEAVTVLEDLERELDDPGEQVLSHAHEQEEFVKEKATPGAAQESSNDQFQTLEEQLGYNLREVCPVQEIDGKAGTWNVELAPKREISQEVKSLIQVLGKQNGNITQIPEYGDTCDREGRLEKQRVSSSVERPYICSECGKSFTQNSILIEHQRTHTGEKPYECDECGRAFSQRSGLFQHQRLHTGEKRYQCSVCGKAFSQNAGLFHHLRIHTGEKPYQCNQCNKSFSRRSVLIKHQRIHTGERPYECEECGKNFIYHCNLIQHRKVHPVAESS

SEQ ID NO: 98732 - protein, 146 aa, Homo sapiens
  Payload ID: 19711
  Gene Name: zinc finger and SCAN domain containing 23
  ENSP ID: ENSP00000435430
MAITLTLQTAEMQEGLLAVKVKEEEEEHSCGPESGLSRNNPHTREIFRRRFRQFCYQESPGPREALQRLQELCHQWLRPEMHTKEQILELLVLEQFLTILPEELQAWVRQHRPVSGEEAVTVLEDLERELDDPGEQMARLGLGMWS

SEQ ID NO: 98733 - protein, 465 aa, Homo sapiens
  Payload ID: 19712
  Gene Name: zinc finger and SCAN domain containing 25
  ENSP ID: ENSP00000262941
MAEAPQQQLGIPVVKLEKELPWGRGREDPSPETFRLRFRQFRYQEAAGPQEALRELQELCRRWLRPELHTKEQILELLVLEQFLTILPREFYAWIREHGPESGKALAAMVEDLTERALEAKAVPCHRQGEQEETALCRGAWEPGIQLGPVEVKPEWGMPPGEGVQGPDPGTEEQLSQDPGDETRAFQEQGGGSKEKEAKPPQEDLKGALVALTSERFGEASLQGPGLGRVCEQEPGGPAGSAPGLPPPQHGAIPLPDEVKTHSSFWKPFQCPECGKGFSRSSNLVRHQRTHEEKSYGCVECGKGFTLREYLMKHQRTHLGKRPYVCSECWKTFSQRHHLEVHQRSHTGEKPYKCGDCWKSFSRRQHLQVHRRTHTGEKPYTCECGKSFSRNANLAVHRRAHTGEKPYGCQVCGKRFSKGERLVRHQRIHTGEKPYHCPACGRSFNQRSILNRHQKTQHRQEPLVQ

SEQ ID NO: 98734 - protein, 544 aa, Homo sapiens
  Payload ID: 19712
  Gene Name: zinc finger and SCAN domain containing 25
  Uniprot ID: Q6NSZ9
  ENSP ID: ENSP00000334800
MLKEHPEMAEAPQQQLGIPVVKLEKELPWGRGREDPSPETFRLRFRQFRYQEAAGPQEALRELQELCRRWLRPELHTKEQILELLVLEQFLTILPREFYAWIREHGPESGKALAAMVEDLTERALEAKAVPCHRQGEQEETALCRGAWEPGIQLGPVEVKPEWGMPPGEGVQGPDPGTEEQLSQDPGDETRAFQEQALPVLQAGPGLPAVNPRDQEMAAGFFTAGSQGLGPFKDMALAFPEEEWRHVTPAQIDCFGEYVEPQDCRVSPGGGSKEKEAKPPQEDLKGALVALTSERFGEASLQGPGLGRVCEQEPGGPAGSAPGLPPPQHGAIPLPDEVKTHSSFWKPFQCPECGKGFSRSSNLVRHQRTHEEKSYGCVECGKGFTLREYLMKHQRTHLGKRPYVCSECWKTFSQRHHLEVHQRSHTGEKPYKCGDCWKSFSRRQHLQVHRRTHTGEKPYTCECGKSFSRNANLAVHRRAHTGEKPYGCQVCGKRFSKGERLVRHQRIHTGEKPYHCPACGRSFNQRSILNRHQKTQHRQEPLVQ

SEQ ID NO: 98735 - protein, 162 aa, Homo sapiens
  Payload ID: 19712
  Gene Name: zinc finger and SCAN domain containing 25
  Uniprot ID: Q6NSZ9
  ENSP ID: ENSP00000377706
MLKEHPEMAEAPQQQLGIPVVKLEKELPWGRGREDPSPETFRLRFRQFRYQEAAGPQEALRELQELCRRWLRPELHTKEQILELLVLEQFLTILPREFYAWIREHGPESGKALAAMVEDLTERALEAKAVGSMPQAGRAGGNSTLQRRLGARHPAGASGGQA

SEQ ID NO: 98736 - protein, 544 aa, Homo sapiens; identical to SEQ ID NO: 98734
  Payload ID: 19712
  Gene Name: zinc finger and SCAN domain containing 25
  Uniprot ID: Q6NSZ9
  ENSP ID: ENSP00000377708

SEQ ID NO: 98737 - protein, 70 aa, Homo sapiens
  Payload ID: 19712
  Gene Name: zinc finger and SCAN domain containing 25
  ENSP ID: ENSP00000413144
MLKEHPEMAEAPQQQLGIPVVKLEKELPWGRGREDPSPETFRLRFRQFRYQEAAGPQEALRELQELCRRW

SEQ ID NO: 98738 - protein, 270 aa, Homo sapiens
  Payload ID: 19713
  Gene Name: zinc finger and SCAN domain containing 26
  ENSP ID: ENSP00000478769
MEAHNEGSNLERHQAKPKEKIEYKCSEREQRFIQHLDLIEHASTHTGKKLCESDVCQSSSLTGHKKVLSREKGHQCHECGKAFQRSSHLVRHQKIHLGEKPYQCNECGKVFSQNAGLLEHLRIHTGEKPYLCIHCGKNFRRSSHLNRHQRIHSQEEPCECKECGKTFSQALLLTHHQRIHSHSKSHQCNECGKAFSLTSDLIRHHRIHTGEKPFKCNICQKAFRLNSHLAQHVRIHNEEKPYQCSECGEAFRQRSGLFQHQRYHHKDKLA

SEQ ID NO: 98739 - protein, 344 aa, Homo sapiens
  Payload ID: 19713
  Gene Name: zinc finger and SCAN domain containing 26
  ENSP ID: ENSP00000479314
MATALDPDQPKKQKILVEEMAPLKGVQEQQVRHECEVTKPEKEKGEETRIENGKLIVVTDSCGRVESSGKISEPMEAHNEGSNLERHQAKPKEKIEYKCSEREQRFIQHLDLIEHASTHTGKKLCESDVCQSSSLTGHKKVLSREKGHQCHECGKAFQRSSHLVRHQKIHLGEKPYQCNECGKVFSQNAGLLEHLRIHTGEKPYLCIHCGKNFRRSSHLNRHQRIHSQEEPCECKECGKTFSQALLLTHHQRIHSHSKSHQCNECGKAFSLTSDLIRHHRIHTGEKPFKCNICQKAFRLNSHLAQHVRIHNEEKPYQCSECGEAFRQRSGLFQHQRYHHKDKLA

SEQ ID NO: 98740 - protein, 150 aa, Homo sapiens
  Payload ID: 19713
  Gene Name: zinc finger and SCAN domain containing 26
  ENSP ID: ENSP00000481024
MATALVSAHSLAPLNLKKEGLRVVREDHYSTWEQGFKLQGNSKGLGQEPLCKQFRQLRYEETTGPREALSRLRELCQQWLQPETHTKEQILELLVLEQFLIILPKELQARVQEHHPESREDVVVVLEDLQLDLGETGQQDPDQPKKQKIL

SEQ ID NO: 98741 - protein, 479 aa, Homo sapiens
  Payload ID: 19713
  Gene Name: zinc finger and SCAN domain containing 26
  ENSP ID: ENSP00000481707
MATALVSAHSLAPLNLKKEGLRVVREDHYSTWEQGFKLQGNSKGLGQEPLCKQFRQLRYEETTGPREALSRLRELCQQWLQPETHTKEQILELLVLEQFLIILPKELQARVQEHHPESREDVVVVLEDLQLDLGETGQQVDPDQPKKQKILVEEMAPLKGVQEQQVRHECEVTKPEKEKGEETRIENGKLIVVTDSCGRVESSGKISEPMEAHNEGSNLERHQAKPKEKIEYKCSEREQRFIQHLDLIEHASTHTGKKLCESDVCQSSSLTGHKKVLSREKGHQCHECGKAFQRSSHLVRHQKIHLGEKPYQCNECGKVFSQNAGLLEHLRIHTGEKPYLCIHCGKNFRRSSHLNRHQRIHSQEEPCECKECGKTFSQALLLTHHQRIHSHSKSHQCNECGKAFSLTSDLIRHHRIHTGEKPFKCNICQKAFRLNSHLAQHVRIHNEEKPYQCSECGEAFRQRSGLFQHQRYHHKDKLA

SEQ ID NO: 98742 - protein, 479 aa, Homo sapiens; identical to SEQ ID NO: 98741
  Payload ID: 19713
  Gene Name: zinc finger and SCAN domain containing 26
  ENSP ID: ENSP00000484018

SEQ ID NO: 98743 - protein, 344 aa, Homo sapiens; identical to SEQ ID NO: 98739
  Payload ID: 19713
  Gene Name: zinc finger and SCAN domain containing 26
  ENSP ID: ENSP00000484931

SEQ ID NO: 98744 - protein, 478 aa, Homo sapiens
  Payload ID: 19713
  Gene Name: zinc finger and SCAN domain containing 26
  Uniprot ID: Q16670
  ENSP ID: ENSP00000485228
MATALVSAHSLAPLNLKKEGLRVVREDHYSTWEQGFKLQGNSKGLGQEPLCKQFRQLRYEETTGPREALSRLRELCQQWLQPETHTKEQILELLVLEQFLIILPKELQARVQEHHPESREDVVVVLEDLQLDLGETGQQDPDQPKKQKILVEEMAPLKGVQEQQVRHECEVTKPEKEKGEETRIENGKLIVVTDSCGRVESSGKISEPMEAHNEGSNLERHQAKPKEKIEYKCSEREQRFIQHLDLIEHASTHTGKKLCESDVCQSSSLTGHKKVLSREKGHQCHECGKAFQRSSHLVRHQKIHLGEKPYQCNECGKVFSQNAGLLEHLRIHTGEKPYLCIHCGKNFRRSSHLNRHQRIHSQEEPCECKECGKTFSQALLLTHHQRIHSHSKSHQCNECGKAFSLTSDLIRHHRIHTGEKPFKCNICQKAFRLNSHLAQHVRIHNEEKPYQCSECGEAFRQRSGLFQHQRYHHKDKLA

SEQ ID NO: 98745 - protein, 316 aa, Homo sapiens
  Payload ID: 19714
  Gene Name: zinc finger and SCAN domain containing 29
  ENSP ID: ENSP00000380170
MSRKWRGGSDSRGRFRKRAWKTIFGHSLCEGAGSALGEDDTPEIITRVIKCSAGVSGTPAQGCTQEREGKKPRPGTTGADEPKGEAQTFSKERLEQGEPWIPDLLGSKEKELPSGSHIGDRRVHADLLPSKKDRRSWVEQDHWSFEDEKVAGVHWGYEETRTLLAILSQTEFYEALRNCHRNSQVYGAVAERLREYGFLRTLEQCRTKFKGLQKSYRKVKSGHPPETCPFFEEMEALMSAQVIALPSNGLEAAASHSGLVGSDAETEEPGQRGWQHEEGAEEAVAQESDSDDMDLEATPQDPNSAAPVVFRSPGGA

SEQ ID NO: 98746 - protein, 852 aa, Homo sapiens
  Payload ID: 19714
  Gene Name: zinc finger and SCAN domain containing 29
  Uniprot ID: Q8IWY8
  ENSP ID: ENSP00000380174
MMAKSALRENGTNSETFRQRFRRFHYQEVAGPREAFSQLWELCCRWLRPEVRTKEQIVELLVLEQFLTVLPGEIQNWVQEQCPENGEEAVTLVEDLEREPGRPRSSVTVSVKGQEVRLEKMTPPKSSQELLSVRQESVEPQPRGVPKKERARSPDLGPQEQMNPKEKLKPFQRSGLPFPKSGVVSRLEQGEPWIPDLLGSKEKELPSGSHIGDRRVHADLLPSKKDRRSWVEQDHWSFEDEKVAGVHWGYEETRTLLAILSQTEFYEALRNCHRNSQVYGAVAERLREYGFLRTLEQCRTKFKGLQKSYRKVKSGHPPETCPFFEEMEALMSAQVIALPSNGLEAAASHSGLVGSDAETEEPGQRGWQHEEGAEEAVAQESDSDDMDLEATPQDPNSAAPVVFRSPGGVHWGYEETKTYLAILSETQFYEALRNCHRNSQLYGAVAERLWEYGFLRTPEQCRTKFKSLQTSYRKVKNGQAPETCPFFEEMDALVSVRVAAPPNDGQEETASCPVQGTSEAEAQKQAEEADEATEEDSDDDEEDTEIPPGAVITRAPVLFQSPRGFEAGFENEDNSKRDISEEVQLHRTLLARSERKIPRYLHQGKGNESDCRSGRQWAKTSGEKRGKLTLPEKSLSEVLSQQRPCLGERPYKYLKYSKSFGPNSLLMHQVSHQVENPYKCADCGKSFSRSARLIRHRRIHTGEKPYKCLDCGKSFRDSSNFITHRRIHTGEKPYQCGECGKCFNQSSSLIIHQRTHTGEKPYQCEECGKSFNNSSHFSAHRRIHTGERPHVCPDCGKSFSKSSDLRAHHRTHTGEKPYGCHDCGKCFSKSSALNKHGEIHAREKLLTQSAPK

SEQ ID NO: 98747 - protein, 330 aa, Homo sapiens
  Payload ID: 19714
  Gene Name: zinc finger and SCAN domain containing 29
  ENSP ID: ENSP00000454548
EQCPENGEEAVTLVEDLEREPGRPRSSVTVSVKGQEVRLEKMTPPKSSQELLSVRQESVEPQPRGVPKKERARSPDLGPQEQMNPKEKLKPFQRSGLPFPKSGVVSRLEQGEPWIPDLLGSKEKELPSGSHIGDRRVHADLLPSKKDRRSWVEQDHWSFEDEKVAGVHWGYEETRTLLAILSQTEFYEALRNCHRNSQVYGAVAERLREYGFLRTLEQCRTKFKGLQKSYRKVKSGHPPETCPFFEEMEALMSAQVIALPSNGLEAAASHSGLVGSDAETEEPGQRGWQHEEGAEEAVAQESDSDDMDLEATPQDPNSAAPVVFRSPGGA

SEQ ID NO: 98748 - protein, 556 aa, Homo sapiens
  Payload ID: 19714
  Gene Name: zinc finger and SCAN domain containing 29
  ENSP ID: ENSP00000456089
MAKSALRENGTNSETFRQRFRRFHYQEVAGPREAFSQLWELCCRWLRPEVRTKEQIVELLVLEQFLTVLPGEIQNWVQEQCPENGEEAVTLVEDLEREPGRPRSSVTVSVKGQEVRLEKMTPPKSSQELLSVRQESVEPQPRGVPKKERARSPDLGPQEQMNPKEKLKPFQRSGLPFPKSGVVSRLEQGEPWIPDLLGSKEKELPSGSHIGDRRVHADLLPSKKDRRSWVEQDHWSFEDEKVAGVHWGYEETRTLLAILSQTEFYEALRNCHRNSQVYGAVAERLREYGFLRTLEQCRTKFKGLQKSYRKVKSGHPPETCPFFEEMEALMSAQVIALPSNGLEAAASHSGLVGSDAETEEPGQRGWQHEEGAEEAVAQESDSDDMDLEATPQDPNSAAPVVFRSPGGVHWGYEETKTYLAILSETQFYEALRNCHRNSQLYGAVAERLWEYGFLRTPEQCRTKFKSLQTSYRKVKNGQAPETCPFFEEMDALVLKLDLRMKIIQNGIFLRKYNCIGHYLQDLKGKFPGIFIRVKAMRVTVDQEDSGQRPQGRKEEN

SEQ ID NO: 98749 - protein, 462 aa, Homo sapiens
  Payload ID: 19714
  Gene Name: zinc finger and SCAN domain containing 29
  ENSP ID: ENSP00000456883
MAKSALRENGTNSETFRQRFRRFHYQEVAGPREAFSQLWELCCRWLRPEVRTKEQIVELLVLEQFLTVLPGEIQNWVQEQCPENGEEAVTLVEDLEREPGRPRSSVTVSVKGQEVRLEKMTPPKSSQELLSVRQESVEPQPRGVPKKERARSPDLGPQEQMNPKEKLKPFQRSGFEAGFENEDNSKRDISEEVQLHRTLLARSERKIPRYLHQGKGNESDCRSGRQWAKTSGEKRGKLTLPEKSLSEVLSQQRPCLGERPYKYLKYSKSFGPNSLLMHQVSHQVENPYKCADCGKSFSRSARLIRHRRIHTGEKPYKCLDCGKSFRDSSNFITHRRIHTGEKPYQCGECGKCFNQSSSLIIHQRTHTGEKPYQCEECGKSFNNSSHFSAHRRIHTGERPHVCPDCGKSFSKSSDLRAHHRTHTGEKPYGCHDCGKCFSKSSALNKHGEIHAREKLLTQSAPK

SEQ ID NO: 98750 - protein, 199 aa, Homo sapiens
  Payload ID: 19714
  Gene Name: zinc finger and SCAN domain containing 29
  ENSP ID: ENSP00000457835
MMAKSALRENGTNSETFRQRFRRFHYQEVAGPREAFSQLWELCCRWLRPEVRTKEQIVELLVLEQFLTVLPGEIQNWVQEQCPENGEEAVTLVEDLEREPGRPRSSVTVSVKGQEVRLEKMTPPKSSQELLSVRQESVEPQPRGVPKKERARSPDLGPQEQMNPKEKLKPFQRSGWSKESHGSQICWALRRKNFQVAAT

SEQ ID NO: 98751 - protein, 21 aa, Homo sapiens
  Payload ID: 19714
  Gene Name: zinc finger and SCAN domain containing 29
  ENSP ID: ENSP00000458119
MMAKSALRENGTNSETFRQRF

SEQ ID NO: 98752 - protein, 494 aa, Homo sapiens
  Payload ID: 19715
  Gene Name: zinc finger and SCAN domain containing 30
  Uniprot ID: Q86W11
  ENSP ID: ENSP00000329738
MSGEATVLAYHAPEEQEGLLVVKVEEENYVLDQDFGLQENPWSQEVFRQKFRQFSYSDSTGPREALSRLRELCCQWLRPEVHSKEQILELLMLEQFLAILPEELQAWLREHRPENGEEAVTMLEELEKELEEPRQQDTTHGQEMFWQEMTSTGALKSLSLNSPVQPLENQCKTETQESQAFQERDGRMVAGKVLMAKQEIVECVASAAMISPGKLPGETHSQRIAEEALGGLDNSKKQKGNAAGNKISQLPSQDRHFSLATFNRRIPTEHSVLESHESEGSFSMNSNDITQQSVDTREKLYECFDCGKAFCQSSKLIRHQRIHTGERPYACKECGKAFSLSSDLVRHQRIHSGEKPYECCECGKAFRGSSELIRHRRIHTGEKPYECGECGKAFSRSSALIQHKKIHTGDKSYECIACGKAFGRSSILIEHQRIHTGEKPYECNECGKSFNQSSALTQHQRIHTGEKPYECSECRKTFRHRSGLMQHQRTHTRV

SEQ ID NO: 98753 - protein, 494 aa, Homo sapiens; identical to SEQ ID NO: 98752
  Payload ID: 19715
  Gene Name: zinc finger and SCAN domain containing 30
  Uniprot ID: Q86W11
  ENSP ID: ENSP00000392371

SEQ ID NO: 98754 - protein, 221 aa, Homo sapiens
  Payload ID: 19715
  Gene Name: zinc finger and SCAN domain containing 30
  ENSP ID: ENSP00000465046
MSGEATVLAYHAPEEQEGLLVVKVEEENYVLDQDFGLQENPWSQEVFRQKFRQFSYSDSTGPREALSRLRELCCQWLRPEVHSKEQILELLMLEQFLAILPEELQAWLREHRPENGEEAVTMLEELEKELEEPRQQDTTHGQEMFWQEMTSTGALKSLSLNSPVQPLENQCKTETQESQAFQERDGVSLYHPGWSAVVQPQLTAAALNPWVKVILLPQPPE

SEQ ID NO: 98755 - protein, 47 aa, Homo sapiens
  Payload ID: 19715
  Gene Name: zinc finger and SCAN domain containing 30
  ENSP ID: ENSP00000467308
MSGEATVLAYHAPEEQEGLLVVKVEEENYVLDQDFGLQENPWSQEVF

SEQ ID NO: 98756 - protein, 69 aa, Homo sapiens
  Payload ID: 19715
  Gene Name: zinc finger and SCAN domain containing 30
  ENSP ID: ENSP00000468180
MSGEATVLAYHAPEEQEGLLVVKVEEENYVLDQDFGLQENPWSQEVFRQKFRQFSYSDSTGPREALSRL

SEQ ID NO: 98757 - protein, 145 aa, Homo sapiens
  Payload ID: 19715
  Gene Name: zinc finger and SCAN domain containing 30
  ENSP ID: ENSP00000470443
MSGEATVLAYHAPEEQEGLLVVKVEEENYVLDQDFGLQENPWSQEVFRQKFRQFSYSDSTGPREALSRLRELCCQWLRPEVHSKEQILELLMLEQFLAILPEELQAWLREHRPENGEEAVTMLEELEKELEEPRQQEFSACVSSE

SEQ ID NO: 98758 - protein, 91 aa, Homo sapiens
  Payload ID: 19715
  Gene Name: zinc finger and SCAN domain containing 30
  ENSP ID: ENSP00000470677
ELQAWLREHRPENGEEAVTMLEELEKELEEPRQQDTTHGQEMFWQEMTSTGALKSLSLNSPVQPLENQCKTETQESQAFQERGEKPQSMWG

SEQ ID NO: 98759 - protein, 51 aa, Homo sapiens
  Payload ID: 19715
  Gene Name: zinc finger and SCAN domain containing 30
  ENSP ID: ENSP00000472179
MSGEATVLAYHAPEEQEGLLVVKVEEENYVLDQDFGLQENPWSQEKCSGRK

SEQ ID NO: 98760 - protein, 307 aa, Homo sapiens
  Payload ID: 19715
  Gene Name: zinc finger and SCAN domain containing 30
  ENSP ID: ENSP00000480152
MVAGKVLMAKQEIVECVASAAMISPGKLPGETHSQRIAEEALGGLDNSKKQKGNAAGNKISQLPSQDRHFSLATFNRRIPTEHSVLESHESEGSFSMNSNDITQQSVDTREKLYECFDCGKAFCQSSKLIRHQRIHTGERPYACKECGKAFSLSSDLVRHQRIHSGEKPYECCECGKAFRGSSELIRHRRIHTGEKPYECGECGKAFSRSSALIQHKKIHTGDKSYECIACGKAFGRSSILIEHQRIHTGEKPYECNECGKSFNQSSALTQHQRIHTGEKPYECSECRKTFRHRSGLMQHQRTHTRV

SEQ ID NO: 98761 - protein, 406 aa, Homo sapiens
  Payload ID: 19716
  Gene Name: zinc finger and SCAN domain containing 31
  Uniprot ID: Q96LW9
  ENSP ID: ENSP00000345339
MASTEEQYDLKIVKVEEDPIWDQETHLRGNNFSGQEASRQLFRQFCYQETPGPREALSRLRELCHQWLRPEIHTKEQILELLVLEQFLTILPEELQAWVREHHPESGEEAVAVVEDLEQELSEPGNQAPDHEHGHSEVLLEDVEHLKVKQEPTDIQLQPMVTQLRYESFCLHQFQEQDGESIPENQELASKQEILKEMEHLGDSKLQRDVSLDSKYRETCKRDSKAEKQQAHSTGERRHRCNECGKSFTKSSVLIEHQRIHTGEKPYECEECGKAFSRRSSLNEHRRSHTGEKPYQCKECGKAFSASNGLTRHRRIHTGEKPYECKVCGKAFLLSSCLVQHQRIHTGEKRYQCRECGKAFIQNAGLFQHLRVHTGEKPYQCSQCSKLFSKRTLLKKHQKIHTGERP

SEQ ID NO: 98762 - protein, 406 aa, Homo sapiens; identical to SEQ ID NO: 98761
  Payload ID: 19716
  Gene Name: zinc finger and SCAN domain containing 31
  Uniprot ID: Q96LW9
  ENSP ID: ENSP00000380050

SEQ ID NO: 98763 - protein, 217 aa, Homo sapiens
  Payload ID: 19716
  Gene Name: zinc finger and SCAN domain containing 31
  ENSP ID: ENSP00000389479
MASTEEQYDLKIVKVEEDPIWDQETHLRGNNFSGQEASRQLFRQFCYQETPGPREALSRLRELCHQWLRPEIHTKEQILELLVLEQFLTILPEELQAWVREHHPESGEEAVAVVEDLEQELSEPGNQAPDHEHGHSEVLLEDVEHLKVKQEPTDIQLQPMVTQLRYESFCLHQFQEQDGESIPENQELASKQEILKEMEHLGDSKLQRDVSLDSKYR

SEQ ID NO: 98764 - protein, 406 aa, Homo sapiens; identical to SEQ ID NO: 98761
  Payload ID: 19716
  Gene Name: zinc finger and SCAN domain containing 31
  Uniprot ID: Q96LW9
  ENSP ID: ENSP00000390076

SEQ ID NO: 98765 - protein, 205 aa, Homo sapiens
  Payload ID: 19716
  Gene Name: zinc finger and SCAN domain containing 31
  ENSP ID: ENSP00000391235
MVTQLRYESFCLHQFQEQDGESIPENQELASKQEILKEMEHLGDSKLQRDVSLDSKYRETCKRDSKAEKQQAHSTGERRHRCNECGKSFTKSSVLIEHQRIHTGEKPYECEECGKAFSRRSSLNEHRRSHTGEKPYQCKECGKAFSASNGLTRHRRIHTGEKPYECKVCGKAFLLSSCLVQHQRIHTGEKRYQCRECGKAFIQNA

SEQ ID NO: 98766 - protein, 17 aa, Homo sapiens
  Payload ID: 19716
  Gene Name: zinc finger and SCAN domain containing 31
  ENSP ID: ENSP00000392552
MASTEEQYDLKIVKVEE

SEQ ID NO: 98767 - protein, 88 aa, Homo sapiens
  Payload ID: 19716
  Gene Name: zinc finger and SCAN domain containing 31
  ENSP ID: ENSP00000398680
MGWNLTLGMTVAPDHEHGHSEVLLEDVEHLKVKQEPTDIQLQPMVTQLRYESFCLHQFQEQDGESIPENQELASKQEILKEMEHLGDS

SEQ ID NO: 98768 - protein, 247 aa, Homo sapiens
  Payload ID: 19716
  Gene Name: zinc finger and SCAN domain containing 31
  Uniprot ID: Q96LW9
  ENSP ID: ENSP00000402937
MVTQLRYESFCLHQFQEQDGESIPENQELASKQEILKEMEHLGDSKLQRDVSLDSKYRETCKRDSKAEKQQAHSTGERRHRCNECGKSFTKSSVLIEHQRIHTGEKPYECEECGKAFSRRSSLNEHRRSHTGEKPYQCKECGKAFSASNGLTRHRRIHTGEKPYECKVCGKAFLLSSCLVQHQRIHTGEKRYQCRECGKAFIQNAGLFQHLRVHTGEKPYQCSQCSKLFSKRTLLKKHQKIHTGERP

SEQ ID NO: 98769 - protein, 106 aa, Homo sapiens
  Payload ID: 19716
  Gene Name: zinc finger and SCAN domain containing 31
  ENSP ID: ENSP00000406376
MASTEEQYDLKIVKVEEDPIWDQETHLRGNNFSGQEASRQLFRQFCYQETPGPREALSRLRELCHQWLRPEIHTKEQILELLVLEQFLTILPEELQAWVREHHPES

SEQ ID NO: 98770 - protein, 104 aa, Homo sapiens
  Payload ID: 19716
  Gene Name: zinc finger and SCAN domain containing 31
  ENSP ID: ENSP00000407529
MVTQLRYESFCLHQFQEQDGESIPENQELASKQEILKEMEHLGDSKLQRDVSLDSKYRETCKRDSKAEKQQAHSTGERRHRCNECGKSFTKSSVLIEHQRIHTG

SEQ ID NO: 98771 - protein, 103 aa, Homo sapiens
  Payload ID: 19716
  Gene Name: zinc finger and SCAN domain containing 31
  ENSP ID: ENSP00000411033
MASTEEQYDLKIVKVEEDPIWDQETHLRGNNFSGQEASRQLFRQFCYQETPGPREALSRLRELCHQWLRPEIHTKEQILELLVLEQFLTILPEELQAWVREHH

SEQ ID NO: 98772 - protein, 155 aa, Homo sapiens
  Payload ID: 19716
  Gene Name: zinc finger and SCAN domain containing 31
  ENSP ID: ENSP00000412519
MASTEEQYDLKIVKVEEDPIWDQETHLRGNNFSGQEASRQLFRQFCYQETPGPREALSRLRELCHQWLRPEIHTKEQILELLVLEQFLTILPEELQAWVREHHPESGEEAVAVVEDLEQELSEPGNQAPDHEHGHSEVLLEDVEHLKVKQEPTDI

SEQ ID NO: 98773 - protein, 406 aa, Homo sapiens; identical to SEQ ID NO: 98761
  Payload ID: 19716
  Gene Name: zinc finger and SCAN domain containing 31
  Uniprot ID: Q96LW9
  ENSP ID: ENSP00000413705

SEQ ID NO: 98774 - protein, 24 aa, Homo sapiens
  Payload ID: 19716
  Gene Name: zinc finger and SCAN domain containing 31
  ENSP ID: ENSP00000415040
MASTEEQYDLKIVKVEEDPIWDQE

SEQ ID NO: 98775 - protein, 147 aa, Homo sapiens
  Payload ID: 19716
  Gene Name: zinc finger and SCAN domain containing 31
  ENSP ID: ENSP00000416108
MASTEEQYDLKIVKVEEDPIWDQETHLRGNNFSGQEASRQLFRQFCYQETPGPREALSRLRELCHQWLRPEIHTKEQILELLVLEQFLTILPEELQAWVREHHPESGEEAVAVVEDLEQELSEPGNQAPDHEHGHSEVLLEDVEHLK

SEQ ID NO: 98776 - protein, 78 aa, Homo sapiens
  Payload ID: 19716
  Gene Name: zinc finger and SCAN domain containing 31
  ENSP ID: ENSP00000416225
MASTEEQYDLKIVKVEEDPIWDQETHLRGNNFSGQEASRQLFRQFCYQETPGPREALSRLRELCHQWLRPEIHTKEQI

SEQ ID NO: 98777 - protein, 247 aa, Homo sapiens; identical to SEQ ID NO: 98768
  Payload ID: 19716
  Gene Name: zinc finger and SCAN domain containing 31
  Uniprot ID: Q96LW9
  ENSP ID: ENSP00000480254

SEQ ID NO: 98778 - protein, 485 aa, Homo sapiens
  Payload ID: 19717
  Gene Name: zinc finger and SCAN domain containing 32
  Uniprot ID: Q9NX65
  ENSP ID: ENSP00000302502
MRDNRAVSLCQQEWMCPGPAQRALYRGATQRKDSHVSLATGVPWGYEETKTLLAILSSSQFYGKLQTCQQNSQIYRAMAEGLWEQGFLRTPEQCRTKFKSLQLSYRKVRRGRVPEPCIFYEEMNALSGSWASAPPMASDAVPGQEGSDIEAGELNHQNGEPTEVEDGTVDGADRDEKDFRNPGQEVRKLDLPVLFPNRLGFEFKNEIKKENLKWDDSEEVEINKALQRKSRGVYWHSELQKGLESEPTSRRQCRNSPGESEEKTPSQEKMSHQSFCARDKACTHILCGKNCSQSVHSPHKPALKLEKVSQCPECGKTFSRSSYLVRHQRIHTGEKPHKCSECGKGFSERSNLTAHLRTHTGERPYQCGQCGKSFNQSSSLIVHQRTHTGEKPYQCIVCGKRFNNSSQFSAHRRIHTGESPYKCAVCGKIFNNSSHFSAHRKTHTGEKPYRCSHCERGFTKNSALTRHQTVHMKAVLSSQEGRDAL

SEQ ID NO: 98779 - protein, 697 aa, Homo sapiens
  Payload ID: 19717
  Gene Name: zinc finger and SCAN domain containing 32
  Uniprot ID: Q9NX65
  ENSP ID: ENSP00000380057
MMAAVKSTEAHPSSNKDPTQGQKSALQGNSPDSEASRQRFRQFCYQEVTGPHEAFSKLWELCCQWLRPKTHSKEEILELLVLEQFLTILPEEIQTWVREQHPENGEEAVALVEDVQRAPGQQVLDSEKDLKVLMKEMAPLGATRESLRSQWKQEVQPEEPTFKGSQSSHQRPGEQSEAWLAPQAPRNLPQNTGLHDQETGAVVWTAGSQGPAMRDNRAVSLCQQEWMCPGPAQRALYRGATQRKDSHVSLATGVPWGYEETKTLLAILSSSQFYGKLQTCQQNSQIYRAMAEGLWEQGFLRTPEQCRTKFKSLQLSYRKVRRGRVPEPCIFYEEMNALSGSWASAPPMASDAVPGQEGSDIEAGELNHQNGEPTEVEDGTVDGADRDEKDFRNPGQEVRKLDLPVLFPNRLGFEFKNEIKKENLKWDDSEEVEINKALQRKSRGVYWHSELQKGLESEPTSRRQCRNSPGESEEKTPSQEKMSHQSFCARDKACTHILCGKNCSQSVHSPHKPALKLEKVSQCPECGKTFSRSSYLVRHQRIHTGEKPHKCSECGKGFSERSNLTAHLRTHTGERPYQCGQCGKSFNQSSSLIVHQRTHTGEKPYQCIVCGKRFNNSSQFSAHRRIHTGESPYKCAVCGKIFNNSSHFSAHRKTHTGEKPYRCSHCERGFTKNSALTRHQTVHMKAVLSSQEGRDAL

SEQ ID NO: 98780 - protein, 697 aa, Homo sapiens; identical to SEQ ID NO: 98779
  Payload ID: 19717
  Gene Name: zinc finger and SCAN domain containing 32
  Uniprot ID: Q9NX65
  ENSP ID: ENSP00000380061

SEQ ID NO: 98781 - protein, 408 aa, Homo sapiens
  Payload ID: 19717
  Gene Name: zinc finger and SCAN domain containing 32
  Uniprot ID: Q9NX65
  ENSP ID: ENSP00000391787
MAEGLWEQGFLRTPEQCRTKFKSLQLSYRKVRRGRVPEPCIFYEEMNALSGSWASAPPMASDAVPGQEGSDIEAGELNHQNGEPTEVEDGTVDGADRDEKDFRNPGQEVRKLDLPVLFPNRLGFEFKNEIKKENLKWDDSEEVEINKALQRKSRGVYWHSELQKGLESEPTSRRQCRNSPGESEEKTPSQEKMSHQSFCARDKACTHILCGKNCSQSVHSPHKPALKLEKVSQCPECGKTFSRSSYLVRHQRIHTGEKPHKCSECGKGFSERSNLTAHLRTHTGERPYQCGQCGKSFNQSSSLIVHQRTHTGEKPYQCIVCGKRFNNSSQFSAHRRIHTGESPYKCAVCGKIFNNSSHFSAHRKTHTGEKPYRCSHCERGFTKNSALTRHQTVHMKAVLSSQEGRDAL

SEQ ID NO: 98782 - protein, 215 aa, Homo sapiens
  Payload ID: 19717
  Gene Name: zinc finger and SCAN domain containing 32
  ENSP ID: ENSP00000407312
MRDNRAVSLCQQEWMCPGPAQRALYRGATQRKDSHVSLATGVPWGYEETKTLLAILSSSQFYGKLQTCQQNSQIYRAMAEGLWEQGFLRTPEQCRTKFKSLQLSYRKVRRGRVPEPCIFYEEMNALSGSWASAPPMASDAVPGQEGSDIEAGELNHQNGEPTEVEDGTVDGADRDEKDFRNPGQEVRKLDLPVLFPNRLGKTPLALMVKGWQSPL

SEQ ID NO: 98783 - protein, 186 aa, Homo sapiens
  Payload ID: 19717
  Gene Name: zinc finger and SCAN domain containing 32
  ENSP ID: ENSP00000458899
MRDNRAVSLCQQEWMCPGPAQRALYRGATQRKDSHVSLATGVPWGYEETKTLLAILSSSQFYGKLQTCQQNSQIYRAMAEGLWEQGFLRTPEQCRTKFKSLQLSYRKVRRGRVPEPCIFYEEMNALSGSWASAPPMASDAVPGQEGSDIEAGELNHQNGEPTEVEDGTVDGADRDEKDFRNPGQEV

SEQ ID NO: 98784 - protein, 186 aa, Homo sapiens
  Payload ID: 19717
  Gene Name: zinc finger and SCAN domain containing 32
  ENSP ID: ENSP00000459069
MMAAVKSTEAHPSSNKDPTQGQKSALQGNSPDSEASRQRFRQFCYQEVTGPHEAFSKLWELCCQWLRPKTHSKEEILELLVLEQFLTILPEEIQTWVREQHPENGEEAVALVEDVQRAPGQQQQVCPGAMKRPRRSWLFLVVLNFMENSRPVSRTARSTGPWRKDSGSRVFCGPQNSVAPSSKAYS

SEQ ID NO: 98785 - protein, 427 aa, Homo sapiens
  Payload ID: 19717
  Gene Name: zinc finger and SCAN domain containing 32
  ENSP ID: ENSP00000459772
MMAAVKSTEAHPSSNKDPTQGQKSALQGNSPDSEASRQRFRQFCYQEVTGPHEAFSKLWELCCQWLRPKTHSKEEILELLVLEQFLTILPEEIQTWVREQHPENGEEAVALVEDVQRAPGQQVLDSEKDLKVLMKEMAPLGATRESLRSQWKQEVQPEEPTFKGSQSSHQRPGEQSEAWLAPQAPRNLPQNTGLHDQETGAVVWTAGSQGPAMRDNRAVSLCQQEWMCPGPAQRALYRGATQRKDSHVSLATGVPWGYEETKTLLAILSSSQFYGKLQTCQQNSQIYRAMAEGLWEQGFLRTPEQCRTKFKSLQLSYRKVRRGRVPEPCIFYEEMNALSGSWASAPPMASDAVPGQEGSDIEAGELNHQNGEPTEVEDGTVDGADRDEKDFRNPGQEVRKLDLPVLFPNRLGKTPLALMVKGWQSPL

SEQ ID NO: 98786 - protein, 138 aa, Homo sapiens
  Payload ID: 19717
  Gene Name: zinc finger and SCAN domain containing 32
  ENSP ID: ENSP00000459960
MAEGLWEQGFLRTPEQCRTKFKSLQLSYRKVRRGRVPEPCIFYEEMNALSGSWASAPPMASDAVPGQEGSDIEAGELNHQNGEPTEVEDGTVDGADRDEKDFRNPGQEVRKLDLPVLFPNRLGKTPLALMVKGWQSPL

SEQ ID NO: 98787 - protein, 425 aa, Homo sapiens
  Payload ID: 19717
  Gene Name: zinc finger and SCAN domain containing 32
  ENSP ID: ENSP00000460487
MMAAVKSTEAHPSSNKDPTQGQKSALQGNSPDSEASRQRFRQFCYQEVTGPHEAFSKLWELCCQWLRPKTHSKEEILELLVLEQFLTILPEEIQTWVREQHPENGEEAVALVEDVQRAPGQQVLDSEKDLKVLMKEMAPLGATRESLRSQWKQEVQPEEPTFKGSQSSHQRPGEQSEAWLAPQAPRNLPQNTGLHDQETGAVVWTAGSQGPAMRDNRAVSLCQQEWMCPGPAQRALYRGATQRKDSHVSLATGVPWGYEETKTLLAILSSSQFYGKLQTCQQNSQIYRAMAEGLWEQGFLRTPEQCRTKFKSLQLSYRKVRRGRVPEPCIFYEEMNALSGSWASAPPMASDAVPGQEGSDIEAGELNHQNGEPTEVEDGTVDGADRDEKDFRNPGQEVRKLDLPVLFPNRLGFEFKNEIKKENLK

SEQ ID NO: 98788 - protein, 217 aa, Homo sapiens
  Payload ID: 19717
  Gene Name: zinc finger and SCAN domain containing 32
  ENSP ID: ENSP00000460833
MMAAVKSTEAHPSSNKDPTQGQKSALQGNSPDSEASRQRFRQFCYQEVTGPHEAFSKLWELCCQWLRPKTHSKEEILELLVLEQFLTILPEEIQTWVREQHPENGEEAVALVEDVQRAPGQQVLDSEKDLKVLMKEMAPLGATRESLRSQWKQEVQPEEPTFKGSQSSHQRPGEQSEATGVPWGYEETKTLLAILSSSQFYGKLQTCQQNSQIYRAM

SEQ ID NO: 98789 - protein, 229 aa, Homo sapiens
  Payload ID: 19717
  Gene Name: zinc finger and SCAN domain containing 32
  ENSP ID: ENSP00000461600
MMAAVKSTEAHPSSNKDPTQGQKSALQGNSPDSEASRQRFRQFCYQEVTGPHEAFSKLWELCCQWLRPKTHSKEEILELLVLEQFLTILPEEIQTWVREQHPENGEEAVALVEDVQRAPGQQPGLLLRLPGTCLKTQVSTTRRQVLWSGQLGPRDQPCVTTELYPSVSKNGCAQALHKGPSTGVPPRGRTVTSRWQQVCPGAMKRPRRSWLFLVVLNFMENSRPVSRTA

SEQ ID NO: 98790 - protein, 408 aa, Homo sapiens; identical to SEQ ID NO: 98781
  Payload ID: 19717
  Gene Name: zinc finger and SCAN domain containing 32
  Uniprot ID: Q9NX65
  ENSP ID: ENSP00000483210

SEQ ID NO: 98791 - protein, 433 aa, Homo sapiens
  Payload ID: 19718
  Gene Name: zinc finger and SCAN domain containing 4
  Uniprot ID: Q8NAM6
  ENSP ID: ENSP00000321963
MALDLRTIFQCEPSENNLGSENSAFQQSQGPAVQREEGISEFSRMVLNSFQDSNNSYARQELQRLYRIFHSWLQPEKHSKDEIISLLVLEQFMIGGHCNDKASVKEKWKSSGKNLERFIEDLTDDSINPPALVHVHMQGQEALFSEDMPLRDVIVHLTKQVNAQTTREANMGTPSQTSQDTSLETGQGYEDEQDGWNSSSKTTRVNENITNQGNQIVSLIIIQEENGPRPEEGGVSSDNPYNSKRAELVTARSQEGSINGITFQGVPMVMGAGCISQPEQSSPESALTHQSNEGNSTCEVHQKGSHGVQKSYKCEECPKVFKYLCHLLAHQRRHRNERPFVCPECQKGFFQISDLRVHQIIHTGKKPFTCSMCKKSFSHKTNLRSHERIHTGEKPYTCPFCKTSYRQSSTYHRHMRTHEKITLPSVPSTPEAS

SEQ ID NO: 98792 - protein, 433 aa, Homo sapiens; identical to SEQ ID NO: 98791
  Payload ID: 19718
  Gene Name: zinc finger and SCAN domain containing 4
  Uniprot ID: Q8NAM6
  ENSP ID: ENSP00000480210

SEQ ID NO: 98793 - protein, 496 aa, Homo sapiens
  Payload ID: 19719
  Gene Name: zinc finger and SCAN domain containing 5A
  Uniprot ID: Q9BUG6
  ENSP ID: ENSP00000375593
MAANCTSSWSLGESCNRPGLELPRSMASSETQLGNHDVDPEISHVNFRMFSCPKESDPIQALRKLTELCHLWLRPDLHTKEQILDMLVMEQFMISMPQELQVLVMMNGVQSCKDLEDLLRNNRRPKKWSVVTFHGKEYIVQDSDIEMAEAPSSVRDDLKDVSSQRASSVNQMRPGEGQAHRELQILPRVPALSRRQGEDFLLHKSIDVTGDPKSLRPKQTLEKDLKENREENPGLTSPEPQLPKSPTDLVRAKEGKDPPKIASVENVDADTPSACVVEREASTHSGNRGDALNLSSPKRSKPDASSISQEEPQGEATPVGNRESPGQAGMNSIHSPGPASPVSHPDGQEAKALPPFACDVCEKRFTCNSKLVIHKRSHTGERLFQCNLCGKRFMQLISLQFHQRTHTGERPYTCDVCQKQFTQKSYLKCHKRSHTGEKPFECKDCKKVFTYRGSLKEHQRIHSGEKPYKCSKCPRAFSRLKLLRRHQKTHPEATSQ

SEQ ID NO: 98794 - protein, 190 aa, Homo sapiens
  Payload ID: 19719
  Gene Name: zinc finger and SCAN domain containing 5A
  ENSP ID: ENSP00000464936
MAEAPSSVRDDLKDVSSQRASSVNQMRPGEGQAHRELQILPRVPALSRRQGEDFLLHKSIDVTGDPKSLRPKQTLEKDLKENREENPGLTSPEPQLPKSPTDLVRAKEGKDPPKIASVENVDADTPSACVVEREASTHSGNRGDALNLSSPKRSKPDASSISQEEPQGEATPVGNRESPGQAGMNSIHSP

SEQ ID NO: 98795 - protein, 350 aa, Homo sapiens
  Payload ID: 19719
  Gene Name: zinc finger and SCAN domain containing 5A
  ENSP ID: ENSP00000466445
MAEAPSSVRDDLKDVSSQRASSVNQMRPGEGQAHRELQILPRVPALSRRQGEDFLLHKSIDVTGDPKSLRPKQTLEKDLKENREENPGLTSPEPQLPKSPTDLVRAKEGKDPPKIASVENVDADTPSACVVEREASTHSGNRGDALNLSSPKRSKPDASSISQEEPQGEATPVGNRESPGQAGMNSIHSPGPASPVSHPDGQEAKALPPFACDVCEKRFTCNSKLVIHKRSHTGERLFQCNLCGKRFMQLISLQFHQRTHTGERPYTCDVCQKQFTQKSYLKCHKRSHTGEKPFECKDCKKVFTYRGSLKEHQRIHSGEKPYKCSKCPRAFSRLKLLRRHQKTHPEATSQ

SEQ ID NO: 98796 - protein, 38 aa, Homo sapiens
  Payload ID: 19719
  Gene Name: zinc finger and SCAN domain containing 5A
  ENSP ID: ENSP00000466830
MAANCTSSWSLGESCNRPGLELPRSMASSETQLGNHDV

SEQ ID NO: 98797 - protein, 495 aa, Homo sapiens
  Payload ID: 19719
  Gene Name: zinc finger and SCAN domain containing 5A
  ENSP ID: ENSP00000467238
MAANCTSSWSLGESCNRPGLELPRSMASSETQLGNHDVDPEISHVNFRMFSCPKESDPIQALRKLTELCHLWLRPDLHTKEQILDMLVMEQFMISMPQELQVLVMMNGVQSCKDLEDLLRNNRRPKKWSVVTFHGKEYIVQDSDIEMAEAPSSVRDDLKDVSSQRASSVNQMRPGEGQAHRELQILPRVPALSRRQGEDFLLHKSIDVTGDPKSLRPKQTLEKDLKENREENPGLTSPEPQLPKSPNLVRAKEGKDPPKIASVENVDADTPSACVVEREASTHSGNRGDALNLSSPKRSKPDASSISQEEPQGEATPVGNRESPGQAGMNSIHSPGPASPVSHPDGQEAKALPPFACDVCEKRFTCNSKLVIHKRSHTGERLFQCNLCGKRFMQLISLQFHQRTHTGERPYTCDVCQKQFTQKSYLKCHKRSHTGEKPFECKDCKKVFTYRGSLKEHQRIHSGEKPYKCSKCPRAFSRLKLLRRHQKTHPEATSQ

SEQ ID NO: 98798 - protein, 496 aa, Homo sapiens; identical to SEQ ID NO: 98793
  Payload ID: 19719
  Gene Name: zinc finger and SCAN domain containing 5A
  Uniprot ID: Q9BUG6
  ENSP ID: ENSP00000467631

SEQ ID NO: 98799 - protein, 84 aa, Homo sapiens
  Payload ID: 19719
  Gene Name: zinc finger and SCAN domain containing 5A
  ENSP ID: ENSP00000468008
MAANCTSSWSLGESCNRPGLELPRSMASSETQLGNHDVDPEISHVNFRMFSCPKESDPIQALRKLTELCHLWLRPDLHTKEQIL

SEQ ID NO: 98800 - protein, 42 aa, Homo sapiens
  Payload ID: 19719
  Gene Name: zinc finger and SCAN domain containing 5A
  ENSP ID: ENSP00000468675
MAANCTSSWSLGESCNRPGLELPRSMASSETQLGNHDVDPEI

SEQ ID NO: 98801 - protein, 105 aa, Homo sapiens
  Payload ID: 19719
  Gene Name: zinc finger and SCAN domain containing 5A
  ENSP ID: ENSP00000468797
MAANCTSSWSLGESCNRPGLELPRSMASSETQLGNHDVDPEISHVNFRMFSCPKESDPIQALRKLTELCHLWLRPDLHTKEQILDMLVMEQFMISMPQELQVLVM

SEQ ID NO: 98802 - protein, 495 aa, Homo sapiens
  Payload ID: 19720
  Gene Name: zinc finger and SCAN domain containing 5B
  Uniprot ID: A6NJL1
  ENSP ID: ENSP00000351883
MAANWTLSWGQGGPCNSPGSDTPRSVASPETQLGNHDRNPETWHMNFRMFSCPEESDPIQALRKLTELCHLWLRPDLHTKEQILDMLVMEQFMISMPQELQVLVKVNGVQSCKDLEDLLRNNRRPKKWSIVNLLGKEYLMLNSDVEMAEAPASVRDDPRDVSSQWASSVNQMHPGTGQARREQQILPRVAALSRRQGEDFLLHKSIDVTGDPNSPRPKQTLEKDLKENREENPGLSSPEPQLPKSPNLVRAKEGKEPQKRASVENVDADTPSACVVEREALTHSGNRGDALNLSSPKRSKPDASSISQEEPQGEATPVGNRESPGQAEINPVHSPGPAGPVSHPDGQEAKALPPFACDVCNKSFKYFSQLSIHRRSHTGDRPFQCDLCRKRFLQPSDLRVHQRVHTGERPYMCDVCQKRFAHESTLQGHKRIHTGERPFKCKYCSKVFSHKGNLNVHQRTHSGEKPYKCPTCQKAFRQLGTFKRHLKTHRETTSQ

SEQ ID NO: 98803 - protein, 169 aa, Homo sapiens
  Payload ID: 19720
  Gene Name: zinc finger and SCAN domain containing 5B
  ENSP ID: ENSP00000465118
MAANWTLSWGQGGPCNSPGSDTPRSVASPETQLGNHDRNPETWHMNFRMFSCPEESDPIQALRKLTELCHLWLRPDLHTKEQILDMLVMEQFMISMPQELQVLVKVNGVQSCKDLEDLLRNNRRPKKWSIVNLLGKEYLMLNSDVEMAEAPASVRDDPRDVSSQWASSV

SEQ ID NO: 98804 - protein, 495 aa, Homo sapiens; identical to SEQ ID NO: 98802
  Payload ID: 19720
  Gene Name: zinc finger and SCAN domain containing 5B
  Uniprot ID: A6NJL1
  ENSP ID: ENSP00000466072

SEQ ID NO: 98805 - protein, 137 aa, Homo sapiens
  Payload ID: 19720
  Gene Name: zinc finger and SCAN domain containing 5B
  ENSP ID: ENSP00000468660
MAANWTLSWGQGGPCNSPGSDTPRSVASPETQLGNHDRNPETWHMNFRMFSCPEESDPIQALRKLTELCHLWLRPDLHTKEQILDMLVMEQFMISMPQELQVLVKVNGVQSCKDLEDLLRNNRRPKKWSIVNLLGKE

SEQ ID NO: 98806 - protein, 496 aa, Homo sapiens
  Payload ID: 19721
  Gene Name: zinc finger and SCAN domain containing 5C, pseudogene
  Uniprot ID: A6NGD5
  ENSP ID: ENSP00000365443
MAANCTSSWSLGESCNSPGSEPPQSMPSPATQLGNHDSDPETCHVNFRMFSCPKESDPIQALRKLTELCHLWLRPDLHTKEQILDMLVMEQFMISMPQELQVLVMMNGVQSCKDLEDLLRNNRRPKKWSVVSFLGKEYLMQESDVEMAEAPASVRDDPRHVSSQRTSSVNQMCPEEGQASQELQTLPRVPALFRRQEEDFLLPETTVMKGDPKALRPKPTLEKDLEEDREENPGLTSPEPQLPNSPTGVVGAKEGKEPQKRASVENVDADTPSACVVEREASTHSGSRGDALNLRGLKRSKPDATSISQEEPQGEATPVGNRESPGQAEINPVHSPGPAGPVSHPSGQEVKELLPFACEVCGKRFKYRGKLAVHTRSHTGERLFQCNLCGKRFMQRIGLQFHQRTHTGERPYTCDICQKQFTQKSYLKCHKRSHTGEKPFECKDCKKVFTYKANLKEHQRIHSGEKPHKCSKCPRAFGRPATLRRHQKTHREATSQ

SEQ ID NO: 98807 - protein, 496 aa, Homo sapiens; identical to SEQ ID NO: 98806
  Payload ID: 19721
  Gene Name: zinc finger and SCAN domain containing 5C, pseudogene
  Uniprot ID: A6NGD5
  ENSP ID: ENSP00000435234

SEQ ID NO: 98808 - protein, 394 aa, Homo sapiens
  Payload ID: 19722
  Gene Name: zinc finger and SCAN domain containing 9
  Uniprot ID: O15535
  ENSP ID: ENSP00000252207
MNTNSKEVLSLGVQVPEAWEELLTMKVEAKSHLQWQESRLKRSNPLAREIFRRHFRQLCYQETPGPREALTRLQELCYQWLRPHVSTKEQILDLLVLEQFLSILPKELQGWVREHCPESGEEAVILLEDLERELDEPQHEMVAHRHRQEVLCKEMVPLAEQTPLTLQSQPKEPQLTCDSAQKCHSIGETDEVTKTEDRELVLRKDCPKIVEPHGKMFNEQTWEVSQQDPSHGEVGEHKDRIERQWGNLLGEGQHKCDECGKSFTQSSGLIRHQRIHTGERPYECNECGKAFSRSSGLFNHRGIHNIQKRYHCKECGKVFSQSAGLIQHQRIHKGEKPYQCSQCSKSYSRRSFLIEHQRSHTGERPHQCIECGKSFNRHCNLIRHQKIHTVAELV

SEQ ID NO: 98809 - protein, 445 aa, Homo sapiens
  Payload ID: 19722
  Gene Name: zinc finger and SCAN domain containing 9
  Uniprot ID: O15535
  ENSP ID: ENSP00000404074
MNTNSKEVLSLGVQVPEAWEELLTMKVEAKSHLQWQESRLKRSNPLAREIFRRHFRQLCYQETPGPREALTRLQELCYQWLRPHVSTKEQILDLLVLEQFLSILPKELQGWVREHCPESGEEAVILLEDLERELDEPQHEMVAHRHRQEVLCKEMVPLAEQTPLTLQSQPKEPQLTCDSAQKCHSIGETDLIRSLRRRAVLIPLGAHLFSTDTFLFSKPVVIPQLKGGGETWPNNRGVLRDEVTKTEDRELVLRKDCPKIVEPHGKMFNEQTWEVSQQDPSHGEVGEHKDRIERQWGNLLGEGQHKCDECGKSFTQSSGLIRHQRIHTGERPYECNECGKAFSRSSGLFNHRGIHNIQKRYHCKECGKVFSQSAGLIQHQRIHKGEKPYQCSQCSKSYSRRSFLIEHQRSHTGERPHQCIECGKSFNRHCNLIRHQKIHTVAELV

SEQ ID NO: 98810 - protein, 41 aa, Homo sapiens
  Payload ID: 19722
  Gene Name: zinc finger and SCAN domain containing 9
  ENSP ID: ENSP00000433307
MNTNSKEVLSLGVQVPEAWEELLTMKVEAKSHLQWQESRLK

SEQ ID NO: 98811 - protein, 394 aa, Homo sapiens; identical to SEQ ID NO: 98808
  Payload ID: 19722
  Gene Name: zinc finger and SCAN domain containing 9
  Uniprot ID: O15535
  ENSP ID: ENSP00000433402

SEQ ID NO: 98812 - protein, 261 aa, Homo sapiens
  Payload ID: 19722
  Gene Name: zinc finger and SCAN domain containing 9
  ENSP ID: ENSP00000433468
MNTNSKEVLSLGVQVPEAWEELLTMKVEAKSHLQWQESRLKRSNPLAREIFRRHFRQLCYQETPGPREALTRLQELCYQWLRPHVSTKEQILDLLVLEQFLSILPKELQGWVREHCPESGEEAVILLEDLERELDEPQHEMVAHRHRQEVLCKEMVPLAEQTPLTLQSQPKEPQLTCDSAQKCHSIGETGEGQHLFDVERIPPGQAKTNNKPRAGKTGDPKTPYQIAVMVSSSESLVCSSLTLLPACRLLPEYHPGSFLDF

SEQ ID NO: 98813 - protein, 369 aa, Homo sapiens
  Payload ID: 19722
  Gene Name: zinc finger and SCAN domain containing 9
  ENSP ID: ENSP00000436166
MNTNSKEVLSLGVQVPEAWEELLTMKVEAKSHLQWQESRLKRSNPLAREIFRRHFRQLCYQETPGPREALTRLQELCYQWLRPHVSTKEQILDLLVLEQFLSILPKELQGWVREHCPESGEEAVILLEDLERELDEPQHEMVAHRHRQEVLCKEMVPLAEQTPLTLQSQPKEPQLTCDSAQKCHSIGETDTFLFSKPVVIPQLKGGGETWPNNRGVLRDEVTKTEDRELVLRKDCPKIVEPHGKMFNEQTWEVSQQDPSHGEVGEHKDRIERQWGNLLGEGQHKCDECGKSFTQSSGLIRHQRIHTGERPYECNECGKAFSRSSGLFNHRGIHNIQKRYHCKECGKVFSQSAGLIQHQRIHKGEKPYQC

SEQ ID NO: 98814 - protein, 160 aa, Homo sapiens
  Payload ID: 19722
  Gene Name: zinc finger and SCAN domain containing 9
  ENSP ID: ENSP00000475719
MNTNSKEVLSLGVQVPEAWEELLTMKVEAKSHLQWQESRLKRSNPLAREIFRRHFRQLCYQETPGPREALTRLQELCYQWLRPHVSTKEQILDLLVLEQFLSILPKELQGWVREHCPESGEEAVILLEDLERELDEPQHESNLVFLSPDGGPQTQTRSPL

SEQ ID NO: 98815 - protein, 197 aa, Homo sapiens
  Payload ID: 19722
  Gene Name: zinc finger and SCAN domain containing 9
  ENSP ID: ENSP00000476254
MNTNSKEVLSLGVQVPEAWEELLTMKVEAKSHLQWQESRLKRSNPLAREIFRRHFRQLCYQETPGPREALTRLQELCYQWLRPHVSTKEQILDLLVLEQFLSILPKELQGWVREHCPESGEEAVILLEDLERELDEPQHEMVAHRHRQEVLCKEMVPLAEQTPLTLQSQPKEPQLTCDSAQKCHSIGETDEVTKTED

SEQ ID NO: 98816 - protein, 434 aa, Homo sapiens
  Payload ID: 19723
  Gene Name: zinc finger CCCH-type containing 10
  Uniprot ID: Q96K80
  ENSP ID: ENSP00000257940
MPDRDSYANGTGSSGGGPGGGGSEEASGAGVGSGGASSDAICRDFLRNVCKRGKRCRYRHPDMSEVSNLGVSKNEFIFCHDFQNKECSRPNCRFIHGSKEDEDGYKKTGELPPRLRQKVAAGLGLSPADLPNGKEEVPICRDFLKGDCQRGAKCKFRHLQRDFEFDARGGGGTGGGSTGSVLPGRRHDLYDIYDLPDRGFEDHEPGPKRRRGGCCPPDGPHFESYEYSLAPPRGVECRLLEEENAMLRKRVEELKKQVSNLLATNEVLLEQNAQFRNQAKVITLSSTAPATEQTLAPTVGTVATFNHGIAQTHTTLSSQALQPRPVSQQELVAPAGAPAAPPTNAAPPAAPPPPPPHLTPEITPLSAALAQTIAQGMAPPPVSMAPVAVSVAPVAPVAVSMAQPLAGITMSHTTTPMVTYPIASQSMRITAMPH

SEQ ID NO: 98817 - protein, 45 aa, Homo sapiens
  Payload ID: 19723
  Gene Name: zinc finger CCCH-type containing 10
  ENSP ID: ENSP00000448309
MPDRDSYANGTGSSGGGPGGGGSEEASGAGVGSGGASSDAICRDF

SEQ ID NO: 98818 - protein, 88 aa, Homo sapiens
  Payload ID: 19723
  Gene Name: zinc finger CCCH-type containing 10
  ENSP ID: ENSP00000448881
MPDRDSYANGTGSSGGGPGGGGSEEASGAGVGSGGASSDAICRDFLRNVCKRGKRCRYRHPDMSEVSNLGVSKNEFIFCHDFQNKECS

SEQ ID NO: 98819 - protein, 79 aa, Homo sapiens
  Payload ID: 19723
  Gene Name: zinc finger CCCH-type containing 10
  ENSP ID: ENSP00000450122
MPDRDSYANGTGSSGGGPGGGGSEEASGAGVGSGGASSDAICRDFLRNVCKRGKRCRYRHPDMSEVSNLGVSKNEFIFC

SEQ ID NO: 98820 - protein, 810 aa, Homo sapiens
  Payload ID: 19724
  Gene Name: zinc finger CCCH-type containing 11A
  Uniprot ID: O75152
  ENSP ID: ENSP00000333253
MPNQGEDCYFFFYSTCTKGDSCPFRHCEAAIGNETVCTLWQEGRCFRQVCRFRHMEIDKKRSEIPCYWENQPTGCQKLNCAFHHNRGRYVDGLFLPPSKTVLPTVPESPEEEVKASQLSVQQNKLSVQSNPSPQLRSVMKVESSENVPSPTHPPVVINAADDDEDDDDQFSEEGDETKTPTLQPTPEVHNGLRVTSVRKPAVNIKQGECLNFGIKTLEEIKSKKMKEKSKKQGEGSSGVSSLLLHPEPVPGPEKENVRTVVRTVTLSTKQGEEPLVRLSLTERLGKRKFSAGGDSDPPLKRSLAQRLGKKVEAPETNIDKTPKKAQVSKSLKERLGMSADPDNEDATDKVNKVGEIHVKTLEEILLERASQKRGELQTKLKTEGPSKTDDSTSGARSSSTIRIKTFSEVLAEKKHRQQEAERQKSKKDTTCIKLKIDSEIKKTVVLPPIVASRGQSEEPAGKTKSMQEVHIKTLEEIKLEKALRVQQSSESSTSSPSQHEATPGARRLLRITKRTGMKEEKNLQEGNEVDSQSSIRTEAKEASGETTGVDITKIQVKRCETMREKHMQKQQEREKSVLTPLRGDVASCNTQVAEKPVLTAVPGITRHLTKRLPTKSSQKVEVETSGIGDSLLNVKCAAQTLEKRGKAKPKVNVKPSVVKVVSSPKLAPKRKAVEMHAAVIAAVKPLSSSSVLQEPPAKKAAVAVVPLVSEDKSVTVPEAENPRDSLVLPPTQSSSDSSPPEVSGPSSSQMSMKTRRLSSASTGKPPLSVEDDFEKLIWEISGGKLEAEIDLDPGKDEDDLLLELSEMIDS

SEQ ID NO: 98821 - protein, 810 aa, Homo sapiens; identical to SEQ ID NO: 98820
  Payload ID: 19724
  Gene Name: zinc finger CCCH-type containing 11A
  Uniprot ID: O75152
  ENSP ID: ENSP00000356179

SEQ ID NO: 98822 - protein, 810 aa, Homo sapiens; identical to SEQ ID NO: 98820
  Payload ID: 19724
  Gene Name: zinc finger CCCH-type containing 11A
  Uniprot ID: O75152
  ENSP ID: ENSP00000356181

SEQ ID NO: 98823 - protein, 810 aa, Homo sapiens; identical to SEQ ID NO: 98820
  Payload ID: 19724
  Gene Name: zinc finger CCCH-type containing 11A
  Uniprot ID: O75152
  ENSP ID: ENSP00000356183

SEQ ID NO: 98824 - protein, 50 aa, Homo sapiens
  Payload ID: 19724
  Gene Name: zinc finger CCCH-type containing 11A
  ENSP ID: ENSP00000406531
MPNQGEDCYFFFYSTCTKGDSCPFRHCEAAIGNETVCTLWQEGRCFRQVC

SEQ ID NO: 98825 - protein, 515 aa, Homo sapiens
  Payload ID: 19724
  Gene Name: zinc finger CCCH-type containing 11A
  ENSP ID: ENSP00000415072
MPNQGEDCYFFFYSTCTKGDSCPFRHCEAAIGNETVCTLWQEGRCFRQVCRFRHMEIDKKRSEIPCYWENQPTGCQKLNCAFHHNRGRYVDGLFLPPSKTVLPTVPESPEEEVKASQLSVQQNKLSVQSNPSPQLRSVMKVESSENVPSPTHPPVVINAADDDEDDDDQFSEEGDETKTPTLQPTPEVHNGLRVTSVRKPAVNIKQGECLNFGIKTLEEIKSKKMKEKSKKQGEGSSGVSSLLLHPEPVPGPEKENVRTVVRTVTLSTKQGEEPLVRLSLTERLGKRKFSAGGDSDPPLKRSLAQRLGKKVEAPETNIDKTPKKAQVSKSLKERLGMSADPDNEDATDKVNKVGEIHVKTLEEILLERASQKRGELQTKLKTEGPSKTDDSTSGARSSSTIRIKTFSEVLAEKKHRQQEAERQKSKKDTTCIKLKIDSEIKKTVVLPPIVASRGQSEEPAGKTKSMQEVHIKTLEEIKLEKALRVQQSSESSTSSPSQHEATPGARRLLRITKRT

SEQ ID NO: 98826 - protein, 652 aa, Homo sapiens
  Payload ID: 19724
  Gene Name: zinc finger CCCH-type containing 11A
  ENSP ID: ENSP00000432602
MPNQGEDCYFFFYSTCTKGDSCPFRHCEAAIGNETVCTLWQEGRCFRQVCRFRHMEIDKKRSEIPCYWENQPTGCQKLNCAFHHNRGRYVDGLFLPPSKTVLPTVPESPEEEVKASQLSVQQNKLSVQSNPSPQLRSVMKVESSENVPSPTHPPVVINAADDDEDDDDQFSEEGDETKTPTLQPTPEVHNGLRVTSVRKPAVNIKQGECLNFGIKTLEEIKSKKMKEKSKKQGEGSSGVSSLLLHPEPVPGPEKENVRTVVRTVTLSTKQGEEPLVRLSLTERLGKRKFSAGGDSDPPLKRSLAQRLGKKVEAPETNIDKTPKKAQVSKSLKERLGMSADPDNEDATDKVNKVGEIHVKTLEEILLERASQKRGELQTKLKTEGPSKTDDSTSGARSSSTIRIKTFSEVLAEKKHRQQEAERQKSKKDTTCIKLKIDSEIKKTVVLPPIVASRGQSEEPAGKTKSMQEVHIKTLEEIKLEKALRVQQSSESSTSSPSQHEATPGARRLLRITKRTGMKEEKNLQEGNEVDSQSSIRTEAKEASGETTGVDITKIQVKRCETMREKHMQKQQEREKSVLTPLRGDVASCNTQVAEKPVLTAVPGITRHLTKRLPTKSSQKVEVETSGIGDSLLNVKCAAQTLEKRGKDIFCPL

SEQ ID NO: 98827 - protein, 810 aa, Homo sapiens; identical to SEQ ID NO: 98820
  Payload ID: 19724
  Gene Name: zinc finger CCCH-type containing 11A
  Uniprot ID: O75152
  ENSP ID: ENSP00000438527

SEQ ID NO: 98828 - protein, 599 aa, Homo sapiens
  Payload ID: 19725
  Gene Name: zinc finger CCCH-type containing 12A
  Uniprot ID: Q5D1E8
  ENSP ID: ENSP00000362179
MSGPCGEKPVLEASPTMSLWEFEDSHSRQGTPRPGQELAAEEASALELQMKVDFFRKLGYSSTEIHSVLQKLGVQADTNTVLGELVKHGTATERERQTSPDPCPQLPLVPRGGGTPKAPNLEPPLPEEEKEGSDLRPVVIDGSNVAMSHGNKEVFSCRGILLAVNWFLERGHTDITVFVPSWRKEQPRPDVPITDQHILRELEKKKILVFTPSRRVGGKRVVCYDDRFIVKLAYESDGIVVSNDTYRDLQGERQEWKRFIEERLLMYSFVNDKFMPPDDPLGRHGPSLDNFLRKKPLTLEHRKQPCPYGRKCTYGIKCRFFHPERPSCPQRSVADELRANALLSPPRAPSKDKNGRRPSPSSQSSSLLTESEQCSLDGKKLGAQASPGSRQEGLTQTYAPSGRSLAPSGGSGSSFGPTDWLPQTLDSLPYVSQDCLDSGIGSLESQMSELWGVRGGGPGEPGPPRAPYTGYSPYGSELPATAAFSAFGRAMGAGHFSVPADYPPAPPAFPPREYWSEPYPLPPPTSVLQEPPVQSPGAGRSPWGRAGSLAKEQASVYTKLCGVFPPHLVEAVMGRFPQLLDPQQLAAEILSYKSQHPSE

SEQ ID NO: 98829 - protein, 131 aa, Homo sapiens
  Payload ID: 19725
  Gene Name: zinc finger CCCH-type containing 12A
  ENSP ID: ENSP00000473447
DDRFIVKLAYESDGIVVSNDTYRDLQGERQEWKRFIEERLLMYSFVNDKLAIGPFSAIRSPCMAPTSREFFAPSAGLCPLMTHWAGTGPAWTTSCVRSHSLWSTGSSRVPMVWNPACPPRPSSLLPFLSPV

SEQ ID NO: 98830 - protein, 836 aa, Homo sapiens
  Payload ID: 19726
  Gene Name: zinc finger CCCH-type containing 12B
  Uniprot ID: Q5HYM0
  ENSP ID: ENSP00000340839
MTATAEVETPKMEKSASKEEKQQPKQDSTEQGNADSEEWMSSESDPEQISLKSSDNSKSCQPRDGQLKKKEMHSKPHRQLCRSPCLDRPSFSQSSILQDGKLDLEKEYQAKMEFALKLGYAEEQIQSVLNKLGPESLINDVLAELVRLGNKGDSEGQINLSLLVPRGPSSREIASPELSLEDEIDNSDNLRPVVIDGSNVAMSHGNKEEFSCRGIQLAVDWFLDKGHKDITVFVPAWRKEQSRPDAPITDQDILRKLEKEKILVFTPSRRVQGRRVVCYDDRFIVKLAFDSDGIIVSNDNYRDLQVEKPEWKKFIEERLLMYSFVNDKFMPPDDPLGRHGPSLENFLRKRPIVPEHKKQPCPYGKKCTYGHKCKYYHPERANQPQRSVADELRISAKLSTVKTMSEGTLAKCGTGMSSAKGEITSEVKRVAPKRQSDPSIRSVAMEPEEWLSIARKPEASSVPSLVTALSVPTIPPPKSHAVGALNTRSASSPVPGSSHFPHQKASLEHMASMQYPPILVTNSHGTPISYAEQYPKFESMGDHGYYSMLGDFSKLNINSMHNREYYMAEVDRGVYARNPNLCSDSRVSHTRNDNYSSYNNVYLAVADTHPEGNLKLHRSASQNRLQPFPHGYHEALTRVQSYGPEDSKQGPHKQSVPHLALHAQHPSTGTRSSCPADYPMPPNIHPGATPQPGRALVMTRMDSISDSRLYESNPVRQRRPPLCREQHASWDPLPCTTDSYGYHSYPLSNSLMQPCYEPVMVRSVPEKMEQLWRNPWVGMCNDSREHMIPEHQYQTYKNLCNIFPSNIVLAVMEKNPHTADAQQLAALIVAKLRAAR

SEQ ID NO: 98831 - protein, 883 aa, Homo sapiens
  Payload ID: 19727
  Gene Name: zinc finger CCCH-type containing 12C
  Uniprot ID: Q9C0D7
  ENSP ID: ENSP00000278590
MPGGGSQEYGVLCIQEYRKNSKVESSTRNNFMGLKDHLGHDLGHLYVESTDPQLSPAVPWSTVENPSMDTVNVGKDEKEASEENASSGDSEENTNSDHESEQLGSISVEPGLITKTHRQLCRSPCLEPHILKRNEILQDFKPEESQTTSKEAKKPPDVVREYQTKLEFALKLGYSEEQVQLVLNKLGTDALINDILGELVKLGNKSEADQTVSTINTITRETSSLESQRSESPMQEIVTDDGENLRPIVIDGSNVAMSHGNKEVFSCRGIKLAVDWFLERGHKDITVFVPAWRKEQSRPDALITDQEILRKLEKEKILVFTPSRRVQGRRVVCYDDRFIVKLAFESDGIIVSNDNYRDLANEKPEWKKFIDERLLMYSFVNDKFMPPDDPLGRHGPSLDNFLRKKPIVPEHKKQPCPYGKKCTYGHKCKYYHPERGSQPQRSVADELRAMSRNTAAKTANEGGLVKSNSVPCSTKADSTSDVKRGAPKRQSDPSIRTQVYQDLEEKLPTKNKLETRSVPSLVSIPATSTAKPQSTTSLSNGLPSGVHFPPQDQRPQGQYPSMMMATKNHGTPMPYEQYPKCDSPVDIGYYSMLNAYSNLSLSGPRSPERRFSLDTDYRISSVASDCSSEGSMSCGSSDSYVGYNDRSYVSSPDPQLEENLKCQHMHPHSRLNPQPFLQNFHDPLTRGQSYSHEEPKFHHKPPLPHLALHLPHSAVGARSSCPGDYPSPPSSAHSKAPHLGRSLVATRIDSISDSRLYDSSPSRQRKPYSRQEGLGSWERPGYGIDAYGYRQTYSLPDNSTQPCYEQFTFQSLPEQQEPAWRIPYCGMPQDPPRYQDNREKIYINLCNIFPPDLVRIVMKRNPHMTDAQQLAAAILVEKSQLGY

SEQ ID NO: 98832 - protein, 852 aa, Homo sapiens
  Payload ID: 19727
  Gene Name: zinc finger CCCH-type containing 12C
  ENSP ID: ENSP00000413094
MGLKDHLGHDLGHLYVESTDPQLSPAVPWSTVENPSMDTVNVGKDEKEASEENASSGDSEENTNSDHESEQLGSISVEPGLITKTHRQLCRSPCLEPHILKRNEILQDFKPEESQTTSKEAKKPPDVVREYQTKLEFALKLGYSEEQVQLVLNKLGTDALINDILGELVKLGNKSEADQTVSTINTITRETSSLESQRSESPMQEIVTDDGENLRPIVIDGSNVAMSHGNKEVFSCRGIKLAVDWFLERGHKDITVFVPAWRKEQSRPDALITDQEILRKLEKEKILVFTPSRRVQGRRVVCYDDRFIVKLAFESDGIIVSNDNYRDLANEKPEWKKFIDERLLMYSFVNDKFMPPDDPLGRHGPSLDNFLRKKPIVPEHKKQPCPYGKKCTYGHKCKYYHPERGSQPQRSVADELRAMSRNTAAKTANEGGLVKSNSVPCSTKADSTSDVKRGAPKRQSDPSIRTQVYQDLEEKLPTKNKLETRSVPSLVSIPATSTAKPQSTTSLSNGLPSGVHFPPQDQRPQGQYPSMMMATKNHGTPMPYEQYPKCDSPVDIGYYSMLNAYSNLSLSGPRSPERRFSLDTDYRISSVASDCSSEGSMSCGSSDSYVGYNDRSYVSSPDPQLEENLKCQHMHPHSRLNPQPFLQNFHDPLTRGQSYSHEEPKFHHKPPLPHLALHLPHSAVGARSSCPGDYPSPPSSAHSKAPHLGRSLVATRIDSISDSRLYDSSPSRQRKPYSRQEGLGSWERPGYGIDAYGYRQTYSLPDNSTQPCYEQFTFQSLPEQQEPAWRIPYCGMPQDPPRYQDNREKIYINLCNIFPPDLVRIVMKRNPHMTDAQQLAAAILVEKSQLGY

SEQ ID NO: 98833 - protein, 884 aa, Homo sapiens
  Payload ID: 19727
  Gene Name: zinc finger CCCH-type containing 12C
  Uniprot ID: Q9C0D7
  ENSP ID: ENSP00000431821
MSLYFPANEYGVLCIQEYRKNSKVESSTRNNFMGLKDHLGHDLGHLYVESTDPQLSPAVPWSTVENPSMDTVNVGKDEKEASEENASSGDSEENTNSDHESEQLGSISVEPGLITKTHRQLCRSPCLEPHILKRNEILQDFKPEESQTTSKEAKKPPDVVREYQTKLEFALKLGYSEEQVQLVLNKLGTDALINDILGELVKLGNKSEADQTVSTINTITRETSSLESQRSESPMQEIVTDDGENLRPIVIDGSNVAMSHGNKEVFSCRGIKLAVDWFLERGHKDITVFVPAWRKEQSRPDALITDQEILRKLEKEKILVFTPSRRVQGRRVVCYDDRFIVKLAFESDGIIVSNDNYRDLANEKPEWKKFIDERLLMYSFVNDKFMPPDDPLGRHGPSLDNFLRKKPIVPEHKKQPCPYGKKCTYGHKCKYYHPERGSQPQRSVADELRAMSRNTAAKTANEGGLVKSNSVPCSTKADSTSDVKRGAPKRQSDPSIRTQVYQDLEEKLPTKNKLETRSVPSLVSIPATSTAKPQSTTSLSNGLPSGVHFPPQDQRPQGQYPSMMMATKNHGTPMPYEQYPKCDSPVDIGYYSMLNAYSNLSLSGPRSPERRFSLDTDYRISSVASDCSSEGSMSCGSSDSYVGYNDRSYVSSPDPQLEENLKCQHMHPHSRLNPQPFLQNFHDPLTRGQSYSHEEPKFHHKPPLPHLALHLPHSAVGARSSCPGDYPSPPSSAHSKAPHLGRSLVATRIDSISDSRLYDSSPSRQRKPYSRQEGLGSWERPGYGIDAYGYRQTYSLPDNSTQPCYEQFTFQSLPEQQEPAWRIPYCGMPQDPPRYQDNREKIYINLCNIFPPDLVRIVMKRNPHMTDAQQLAAAILVEKSQLGY

SEQ ID NO: 98834 - protein, 527 aa, Homo sapiens
  Payload ID: 19728
  Gene Name: zinc finger CCCH-type containing 12D
  Uniprot ID: A2A288
  ENSP ID: ENSP00000386616
MEHPSKMEFFQKLGYDREDVLRVLGKLGEGALVNDVLQELIRTGSRPGALEHPAAPRLVPRGSCGVPDSAQRGPGTALEEDFRTLASSLRPIVIDGSNVAMSHGNKETFSCRGIKLAVDWFRDRGHTYIKVFVPSWRKDPPRADTPIREQHVLAELERQAVLVYTPSRKVHGKRLVCYDDRYIVKVAYEQDGVIVSNDNYRDLQSENPEWKWFIEQRLLMFSFVNDRFMPPDDPLGRHGPSLSNFLSRKPKPPEPSWQHCPYGKKCTYGIKCKFYHPERPHHAQLAVADELRAKTGARPGAGAEEQRPPRAPGGSAGARAAPREPFAHSLPPARGSPDLAALRGSFSRLAFSDDLGPLGPPLPVPACSLTPRLGGPDWVSAGGRVPGPLSLPSPESQFSPGDLPPPPGLQLQPRGEHRPRDLHGDLLSPRRPPDDPWARPPRSDRFPGRSVWAEPAWGDGATGGLSVYATEDDEGDARARARIALYSVFPRDQVDRVMAAFPELSDLARLILLVQRCQSAGAPLGKP

SEQ ID NO: 98835 - protein, 167 aa, Homo sapiens
  Payload ID: 19728
  Gene Name: zinc finger CCCH-type containing 12D
  ENSP ID: ENSP00000387062
MEHPSKMEFFQKLGYDREDVLRVLGKLGEGALVNDVLQELIRTGSRPGALEHPAAPRLVPRGSCGVPDSAQRGPGTALEEDFRTLASSLRPIVIDGSNVAMSHGNKETFSCRGIKLAVDWFRDRGHTYIKVFVPSWRKDPPRADTPIRGIGMGNEWRSILLGAAARE

SEQ ID NO: 98836 - protein, 106 aa, Homo sapiens
  Payload ID: 19728
  Gene Name: zinc finger CCCH-type containing 12D
  ENSP ID: ENSP00000395209
  MOD_RES (1)..(1): Any amino acid
XAVLVYTPSRKVHGKRLVCYDDRYIVKVAYEQDGVIVSNDNYRDLQSENPEWKWFIEQRLLMFSFVNDRFMPPDDPLGRHGPSLSNFLSRKPKPPEPSWQHCPYGG

SEQ ID NO: 98837 - protein, 1668 aa, Homo sapiens
  Payload ID: 19729
  Gene Name: zinc finger CCCH-type containing 13
  Uniprot ID: Q5T200
  ENSP ID: ENSP00000242848
MSKIRRKVTVENTKTISDSTSRRPSVFERLGPSTGSTAETQCRNWLKTGNCLYGNTCRFVHGPSPRGKGYSSNYRRSPERPTGDLRERMKNKRQDVDTEPQKRNTEESSSPVRKESSRGRHREKEDIKITKERTPESEEENVEWETNRDDSDNGDINYDYVHELSLEMKRQKIQRELMKLEQENMEKREEIIIKKEVSPEVVRSKLSPSPSLRKSSKSPKRKSSPKSSSASKKDRKTSAVSSPLLDQQRNSKTNQSKKKGPRTPSPPPPIPEDIALGKKYKEKYKVKDRIEEKTRDGKDRGRDFERQREKRDKPRSTSPAGQHHSPISSRHHSSSSQSGSSIQRHSPSPRRKRTPSPSYQRTLTPPLRRSASPYPSHSLSSPQRKQSPPRHRSPMREKGRHDHERTSQSHDRRHERREDTRGKRDREKDSREEREYEQDQSSSRDHRDDREPRDGRDRRDARDTRDRRELRDSRDMRDSREMRDYSRDTKESRDPRDSRSTRDAHDYRDREGRDTHRKEDTYPEESRSYGRNHLREESSRTEIRNESRNESRSEIRNDRMGRSRGRVPELPEKGSRGSRGSQIDSHSSNSNYHDSWETRSSYPERDRYPERDNRDQARDSSFERRHGERDRRDNRERDQRPSSPIRHQGRNDELERDERREERRVDRVDDRRDERARERDRERERDRERERERERERDREREKERELERERAREREREREKERDRERDRDRDHDRERERERERDREKEREREREERERERERERERERERERERERARERDKERERQRDWEDKDKGRDDRREKREEIREDRNPRDGHDERKSKKRYRNEGSPSPRQSPKRRREHSPDSDAYNSGDDKNEKHRLLSQVVRPQESRSLSPSHLTEDRQGRWKEEDRKPERKESSRRYEEQELKEKVSSVDKQREQTEILESSRMRAQDIIGHHQSEDRETSDRAHDENKKKAKIQKKPIKKKKEDDVGIERGNIETTSEDGQVFSPKKGQKKKSIEKKRKKSKGDSDISDEEAAQQSKKKRGPRTPPITTKEELVEMCNGKNGILEDSQKKEDTAFSDWSDEDVPDRTEVTEAEHTATATTPGSTPSPLSSLLPPPPPVATATATTVPATLAATTAAAATSFSTSAITISTSATPTNTTNNTFANEDSHRKCHRTRVEKVETPHVTIEDAQHRKPMDQKRSSSLGSNRSNRSHTSGRLRSPSNDSAHRSGDDQSGRKRVLHSGSRDREKTKSLEITGERKSRIDQLKRGEPSRSTSSDRQDSRSHSSRRSSPESDRQVHSRSGSFDSRDRLQERDRYEHDRERERERRDTRQREWDRDADKDWPRNRDRDRLRERERERERDKRRDLDRERERLISDSVERDRDRDRDRTFESSQIESVKRCEAKLEGEHERDLESTSRDSLALDKERMDKDLGSVQGFEETNKSERTESLEGDDESKLDDAHSLGSGAGEGYEPISDDELDEILAGDAEKREDQQDEEKMPDPLDVIDVDWSGLMPKHPKEPREPGAALLKFTPGAVMLRVGISKKLAGSELFAKVKETCQRLLEKPKDADNLFEHELGALNMAALLRKEERASLLSNLGPCCKALCFRRDSAIRKQLVKNEKGTIKQAYTSAPMVDNELLRLSLRLFKRKTTCHAPGHEKTEDNKLSQSSIQQELCVS

SEQ ID NO: 98838 - protein, 1564 aa, Homo sapiens
  Payload ID: 19729
  Gene Name: zinc finger CCCH-type containing 13
  Uniprot ID: Q5T200
  ENSP ID: ENSP00000282007
MSKIRRKVTVENTKTISDSTSRRPSVFERLGPSTGSTAETQCRNWLKTGNCLYGNTCRFVHGPSPRGKGYSSNYRRSPERPTGDLRERMKNKRQDVDTEPQKRNTEESSSPVRKESSRGRHREKEDIKITKERTPESEEENVEWETNRDDSDNGDINYDYVHELSLEMKRQKIQRELMKLEQENMEKREEIIIKKEVSPEVVRSKLSPSPSLRKSSKSPKRKSSPKSSSASKKDRKTSAVSSPLLDQQRNSKTNQSKKKGPRTPSPPPPIPEDIALGKKYKEKYKVKDRIEEKTRDGKDRGRDFERQREKRDKPRSTSPAGQHHSPISSRHHSSSSQSGSSIQRHSPSPRRKRTPSPSYQRTLTPPLRRSASPYPSHSLSSPQRKQSPPRHRSPMREKGRHDHERTSQSHDRRHERREDTRGKRDREKDSREEREYEQDQSSSRDHRDDREPRDGRDRRDARDTRDRRELRDSRDMRDSREMRDYSRDTKESRDPRDSRSTRDAHDYRDREGRDTHRKEDTYPEESRSYGRNHLREESSRTEIRNESRNESRSEIRNDRMGRSRGRVPELPEKGSRGSRGSQIDSHSSNSNYHDSWETRSSYPERDRYPERDNRDQARDSSFERRHGERDRRDNRERDQRPSSPIRHQGRNDELERDERREERRVDRVDDRRDERARERDRERERDRERERERERERDREREKERELERERAREREREREKERDRERDRDRDHDRERERERERDREKEREREREERERERERERERERERERERERARERDKERERQRDWEDKDKGRDDRREKREEIREDRNPRDGHDERKSKKRYRNEGSPSPRQSPKRRREHSPDSDAYNSGDDKNEKHRLLSQVVRPQESRSLSPSHLTEDRQGRWKEEDRKPERKESSRRYEEQELKEKVSSVDKQREQTEILESSRMRAQDIIGHHQSEDRETSDRAHDENKKKAKIQKKPIKKKKEDDVGIERGNIETTSEDGQVFSPKKGQKKKSIEKKRKKSKGDSDISDEEAAQQSKKKRGPRTPPITTKEELVEMCNGKNGILEDSQKKEDTAFSDWSDEDVPDRTEVTEAEHTATATTPGSTPSPLSSLLPPPPPVATATATTVPATLAATTAAAATSFSTSAITISTSATPTNTTNNTFANEDSHRKCHRTRVEKVETPHVTIEDAQHRKPMDQKRSSSLGSNRSNRSHTSGRLRSPSNDSAHRSGDDQSGRKRVLHSGSRDREKTKSLEITGERKSRIDQLKRGEPSRSTSSDRQDSRSHSSRRSSPESDRQVHSRSGSFDSRDRLQERDRYEHDRERERERRDTRQREWDRDADKDWPRNRDRDRLRERERERERDKRRDLDRERERLISDSVERDRDRDRDRTFESSQIESVKRCEAKLEGEHERDLESTSRDSLALDKERMDKDLGSVQGFEETNKSERTESLEAGDDESKLDDAHSLGSGAGEGYEPISDDELDEILAGDAEKREDQQDEEKMPDPLDVIDVDWSGLMPKHPKEPREPGAALLKFTPGAVMLRVGISKKLAGSELFAKVKETCQRLLEKPKGSFILL

SEQ ID NO: 98839 - protein, 115 aa, Homo sapiens
  Payload ID: 19729
  Gene Name: zinc finger CCCH-type containing 13
  ENSP ID: ENSP00000416238
MSKIRRKVTVENTKTISDSTSRRPSVFERLGPSTGSTAETQCRNWLKTGNCLYGNTCRFVHGPSPRGKGYSSNYRRSPERPTGDLRERMKNKRQDVDTEPQKRNTEESSSPVRVG

SEQ ID NO: 98840 - protein, 116 aa, Homo sapiens
  Payload ID: 19729
  Gene Name: zinc finger CCCH-type containing 13
  ENSP ID: ENSP00000480658
  MOD_RES (1)..(1): Any amino acid
XEEENVEWETNRDDSDNGDINYDYVHELSLEMKRQKIQRELMKLEQENMEKREEIIIKKEVSPEVVRSKLSPSPSLRKSSKSPKRKSSPKSSSASKKDRKTSAVSSPLLDQQRSVG

SEQ ID NO: 98841 - protein, 736 aa, Homo sapiens
  Payload ID: 19730
  Gene Name: zinc finger CCCH-type containing 14
  Uniprot ID: Q6PJT7
  ENSP ID: ENSP00000251038
MEIGTEISRKIRSAIKGKLQELGAYVDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGTQQRQLLSRLQIDPVMAETLQMSQDYYDMESMVHADTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNGSFSNAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 98842 - protein, 579 aa, Homo sapiens
  Payload ID: 19730
  Gene Name: zinc finger CCCH-type containing 14
  Uniprot ID: Q6PJT7
  ENSP ID: ENSP00000307025
MEIGTEISRKIRSAIKGKLQELGAYVDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQAEMSELSVAQKPEKLLERCKYWPACKNGDECAYHHPISPCKAFPNCKFAEKCLFVHPNCKYDAKCTKPDCPFTHVSRRIPVLSPKPVAPPAPPSSSQLCRYFPACKKMECPFYHPKHCRFNTQCTRPDCTFYHPTINVPPRHALKWIRPQTSE

SEQ ID NO: 98843 - protein, 306 aa, Homo sapiens
  Payload ID: 19730
  Gene Name: zinc finger CCCH-type containing 14
  Uniprot ID: Q6PJT7
  ENSP ID: ENSP00000327176
MRMSSKFPSPPLPIFLPPEPVDLGSITSSSCSLNELDNISHLLRKISADINEIKGMKAAILTVEANLFDLNVRVSKNEAKISSLEVKMNEYSTTYECNRQFEDQEEDTESQSRTTDVKIIGFLRNVEKGTQQRQLLSRLQIDPVMAETLQMSQAEMSELSVAQKPEKLLERCKYWPACKNGDECAYHHPISPCKAFPNCKFAEKCLFVHPNCKYDAKCTKPDCPFTHVSRRIPVLSPKPVAPPAPPSSSQLCRYFPACKKMECPFYHPKHCRFNTQCTRPDCTFYHPTINVPPRHALKWIRPQTSE

SEQ ID NO: 98844 - protein, 571 aa, Homo sapiens
  Payload ID: 19730
  Gene Name: zinc finger CCCH-type containing 14
  Uniprot ID: Q6PJT7
  ENSP ID: ENSP00000338002
MVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGTQQRQLLSRLQIDPVMAETLQMSQAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 98845 - protein, 711 aa, Homo sapiens
  Payload ID: 19730
  Gene Name: zinc finger CCCH-type containing 14
  Uniprot ID: Q6PJT7
  ENSP ID: ENSP00000377150
MEIGTEISRKIRSAIKGKLQELGAYVDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQDYYDMESMVHADTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNGSFSNAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 98846 - protein, 282 aa, Homo sapiens
  Payload ID: 19730
  Gene Name: zinc finger CCCH-type containing 14
  Uniprot ID: Q6PJT7
  ENSP ID: ENSP00000384682
MRMSSKFPSPPLPIFLPPEPVDLGSITSSSCSLNELDNISHLLRKISADINEIKGMKAAILTVEANLFDLNVRVSKNEAKISSLEVKMNEYSTTYECNRQFEDQEEDTESQSRTTDVKIIGFLRNVEKAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 98847 - protein, 94 aa, Homo sapiens
  Payload ID: 19730
  Gene Name: zinc finger CCCH-type containing 14
  ENSP ID: ENSP00000450451
MVMVANKKSQDQMTEDLSLFLGNNTIRFTVWLHGVLDKLRSVTTEPSSLKSSDTNIFDSNVPSNKSNFSRGDERRHEAAVPPLAIPSARPEKRD

SEQ ID NO: 98848 - protein, 605 aa, Homo sapiens
  Payload ID: 19730
  Gene Name: zinc finger CCCH-type containing 14
  ENSP ID: ENSP00000450474
MEIGTEISRKIRSAIKGKLQELGAYVDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGTQQRQLLSRLQIDPVMAETLQMSQAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 98849 - protein, 151 aa, Homo sapiens
  Payload ID: 19730
  Gene Name: zinc finger CCCH-type containing 14
  ENSP ID: ENSP00000450823
LLERCKYWPACKNGDECAYHHPISPCKAFPNCKFAEKCLFVHPNCKYDAKCTKPDCPFTHVSRRIPVLSPKPDWRSVLVFILLAVAPPAPPSSSQLCRYFPACKKMECPFYHPKHCRFNTQCTRPDCTFYHPTINVPPRHALKWIRPQTSE

SEQ ID NO: 98850 - protein, 64 aa, Homo sapiens
  Payload ID: 19730
  Gene Name: zinc finger CCCH-type containing 14
  ENSP ID: ENSP00000450917
MEIGTEISRKIRSAIKGKLQELGAYVDEELPDYIMVMVANKKSQDQMTEDLSLFLGNNTIRFTV

SEQ ID NO: 98851 - protein, 81 aa, Homo sapiens
  Payload ID: 19730
  Gene Name: zinc finger CCCH-type containing 14
  ENSP ID: ENSP00000451007
DYGSRTGSISSSVSVPAKPERRPSLPPSKQANKNLILKAISEAQESVTKTTNYSTETDTSSCSQNSNFSRRIASRSGPGTK

SEQ ID NO: 98852 - protein, 651 aa, Homo sapiens
  Payload ID: 19730
  Gene Name: zinc finger CCCH-type containing 14
  ENSP ID: ENSP00000451054
  MOD_RES (1)..(1): Any amino acid
XSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGTQQRQLLSRLQIDPVMAETLQMSQDYYDMESMVHADTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNGSFSNAEMSELSVAQKPEKLLERCKYWPACKNGDECAYHHPISPCKAFPNCKFAEKCLFVHPNCKYDAKCTKPDCPFTHVSRRIPVLSPKPVAPPAPPSSSQLCRYFPACKKMECPFYHPKHCRFNTQCTRPDCTFYHPTINVPPRHALKWIRPQTSE

SEQ ID NO: 98853 - protein, 209 aa, Homo sapiens
  Payload ID: 19730
  Gene Name: zinc finger CCCH-type containing 14
  ENSP ID: ENSP00000451389
MKRKKLKLSHLVQYEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRN

SEQ ID NO: 98854 - protein, 215 aa, Homo sapiens
  Payload ID: 19730
  Gene Name: zinc finger CCCH-type containing 14
  ENSP ID: ENSP00000451489
MVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDM

SEQ ID NO: 98855 - protein, 438 aa, Homo sapiens
  Payload ID: 19730
  Gene Name: zinc finger CCCH-type containing 14
  ENSP ID: ENSP00000451530
MRMSSKFPSPPLPIFLPPEPVDLGSITSSSCSLNELDNISHLLRKISADINEIKGMKAAILTVEANLFDLNVRVSKNEAKISSLEVKMNEYSTTYECNRQFEDQEEDTESQSRTTDVKIIGFLRNVEKGTQQRQLLSRLQIDPVMAETLQMSQDYYDMESMVHADTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNGSFSNAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 98856 - protein, 72 aa, Homo sapiens
  Payload ID: 19730
  Gene Name: zinc finger CCCH-type containing 14
  ENSP ID: ENSP00000451638
MVMVANKKSQDQMTEDLSLFLGNNTIRFTVWLHGVLDKLRSVTTEPSSLKSSDTNIFDSNVPSNKSNFSRGD

SEQ ID NO: 98857 - protein, 206 aa, Homo sapiens
  Payload ID: 19730
  Gene Name: zinc finger CCCH-type containing 14
  ENSP ID: ENSP00000451941
MRMSSKFPSPPLPIFLPPEPVDLGSITSSSCSLNELDNISHLLRKISADINEIKGMKAAILTVEANLFDLNVRVSKNEAKISSLEVKMNEYSTTYECNRQFEDQEEDTESQSRTTDVKIIGFLRNVEKDYYDMESMVHADTRSFILKKPKLSEEVVVAPNQESGMKTADSLRVLSGHLMQTRDLVQPDKPASPKFIVTLDGVPSPP

SEQ ID NO: 98858 - protein, 132 aa, Homo sapiens
  Payload ID: 19730
  Gene Name: zinc finger CCCH-type containing 14
  ENSP ID: ENSP00000452210
MVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPA

SEQ ID NO: 98859 - protein, 420 aa, Homo sapiens
  Payload ID: 19730
  Gene Name: zinc finger CCCH-type containing 14
  ENSP ID: ENSP00000452370
MSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQAEMSELSVAQKPEKLLERCKYWPACKNGDECAYHHPISPCKAFPNCKFAEKCLFVHPNCKYDAKCTKPDCPFTHVSRRIPVLSPKPAPPSSSQLCRYFPACKKMECPFYHPKHCRFNTQCTRPDCTFYHPTINVPPRHALKWIRPQTSE

SEQ ID NO: 98860 - protein, 730 aa, Homo sapiens
  Payload ID: 19730
  Gene Name: zinc finger CCCH-type containing 14
  Uniprot ID: Q6PJT7
  ENSP ID: ENSP00000452475
MEIGTEISRKIRSAIKGKLQELGAYVDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGTQQRQLLSRLQIDPVMAETLQMSQDYYDMESMVHADTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNAEMSELSVAQKPEKLLERCKYWPACKNGDECAYHHPISPCKAFPNCKFAEKCLFVHPNCKYDAKCTKPDCPFTHVSRRIPVLSPKPVAPPAPPSSSQLCRYFPACKKMECPFYHPKHCRFNTQCTRPDCTFYHPTINVPPRHALKWIRPQTSE

SEQ ID NO: 98861 - protein, 148 aa, Homo sapiens
  Payload ID: 19730
  Gene Name: zinc finger CCCH-type containing 14
  ENSP ID: ENSP00000477763
ISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGDLSFLSGCFQDLLFVFDVLQFHYDVSRRGFPFIFPVWYNVWKHPIYLK

SEQ ID NO: 98862 - protein, 426 aa, Homo sapiens
  Payload ID: 19731
  Gene Name: zinc finger CCCH-type containing 15
  Uniprot ID: Q8WU90
  ENSP ID: ENSP00000338788
MPPKKQAQAGGSKKAEQKKKEKIIEDKTFGLKNKKGAKQQKFIKAVTHQVKFGQQNPRQVAQSEAEKKLKKDDKKKELQELNELFKPVVAAQKISKGADPKSVVCAFFKQGQCTKGDKCKFSHDLTLERKCEKRSVYIDARDEELEKDTMDNWDEKKLEEVVNKKHGEAEKKKPKTQIVCKHFLEAIENNKYGWFWVCPGGGDICMYRHALPPGFVLKKDKKKEEKEDEISLEDLIERERSALGPNVTKITLESFLAWKKRKRQEKIDKLEQDMERRKADFKAGKALVISGREVFEFRPELVNDDDEEADDTRYTQGTGGDEVDDSVSVNDIDLSLYIPRDVDETGITVASLERFSTYTSDKDENKLSEASGGRAENGERSDLEEDNEREGTENGAIDAVPVDENLFTGEDLDELEEELNTLDLEE

SEQ ID NO: 98863 - protein, 74 aa, Homo sapiens
  Payload ID: 19731
  Gene Name: zinc finger CCCH-type containing 15
  ENSP ID: ENSP00000407192
MPPKKQAQAGGSKKAEQKKKEKIIEDKTFGLKNKKGAKQQKFIKAVTHQVKFGQQNPRQDLTYKCLDESSNHIR

SEQ ID NO: 98864 - protein, 105 aa, Homo sapiens
  Payload ID: 19731
  Gene Name: zinc finger CCCH-type containing 15
  ENSP ID: ENSP00000410981
MPPKKQAQAGGSKKAEQKKKEKIIEDKTFGLKNKKGAKQQKFIKAVTHQVKFGQQNPRQVAQSEAEKKLKKDDKKKELQELNELFKPVVAAQKISKGVQAFPGSY

SEQ ID NO: 98865 - protein, 71 aa, Homo sapiens
  Payload ID: 19731
  Gene Name: zinc finger CCCH-type containing 15
  ENSP ID: ENSP00000415788
VDDSVSVNDIDLSLYIPRDVDETGITVASLERFSTYTSDKDEGRHGHGKGFLGYGKPKCICSSEEEDLKTN

SEQ ID NO: 98866 - protein, 953 aa, Homo sapiens
  Payload ID: 19732
  Gene Name: zinc finger CCCH-type containing 18
  Uniprot ID: Q86VM9
  ENSP ID: ENSP00000301011
MDVAESPERDPHSPEDEEQPQGLSDDDILRDSGSDQDLDGAGVRASDLEDEESAARGPSQEEEDNHSDEEDRASEPKSQDQDSEVNELSRGPTSSPCEEEGDEGEEDRTSDLRDEASSVTRELDEHELDYDEEVPEEPAPAVQEDEAEKAGAEDDEEKGEGTPREEGKAGVQSVGEKESLEAAKEKKKEDDDGEIDDGEIDDDDLEEGEVKDPSDRKVRPRPTCRFFMKGNCTWGMNCRFIHPGVNDKGNYSLITKADPFPPNGAPPLGPHPLMPANPWGGPVVDEILPPPPPEPPTESAWERGLRHAKEVLKKATIRKEQEPDFEEKRFTVTIGEDEREFDKENEVFRDWNSRIPRDVRDTVLEPYADPYYDYEIERFWRGGQYENFRVQYTETEPYHNYRERERERERENRQRERERERERDRERERRQRERERERERERDKERQRRKEEWERERAKRDEKDRQHRDRDREKEREKEKGKPKPRSPQPPSRQAEPPKKEAATTGPQVKRADEWKDPWRRSKSPKKKLGVSVSPSRARRRRKTSASSASASNSSRSSSRSSSYSGSGSSRSRSRSSSYSSYSSRSSRHSSFSGSRSRSRSFSSSPSPSPTPSPHRPSIRTKGEPAPPPGKAGEKSVKKPAPPPAPPQATKTTAPVPEPTKPGDPREARRKERPARTPPRRRTLSGSGSGSGSSYSGSSSRSRSLSVSSVSSVSSATSSSSSAHSVDSEDMYADLASPVSSASSRSPAPAQTRKEKGKSKKEDGVKEEKRKRDSSTQPPKSAKPPAGGKSSQQPSTPQQAPPGQPQQGTFVAHKEIKLTLLNKAADKGSRKRYEPSDKDRQSPPPAKRPNTSPDRGSRDRKSGGRLGSPKPERQRGQNSKAPAAPADRKRQLSPQSKSSSKVTSVPGKASDPGAASTKSGKASTLSRREELLKQLKAVEDAIARKRAKIPGKA

SEQ ID NO: 98867 - protein, 977 aa, Homo sapiens
  Payload ID: 19732
  Gene Name: zinc finger CCCH-type containing 18
  ENSP ID: ENSP00000416951
MDVAESPERDPHSPEDEEQPQGLSDDDILRDSGSDQDLDGAGVRASDLEDEESAARGPSQEEEDNHSDEEDRASEPKSQDQDSEVNELSRGPTSSPCEEEGDEGEEDRTSDLRDEASSVTRELDEHELDYDEEVPEEPAPAVQEDEAEKAGAEDDEEKGEGTPREEGKAGVQSVGEKESLEAAKEKKKEDDDGEIDDGEIDDDDLEEGEVKDPSDRKVRPRPTCRFFMKDVVTPLSTLLPPISNSIPFRGQVKGNCTWGMNCRFIHPGVNDKGNYSLITKADPFPPNGAPPLGPHPLMPANPWGGPVVDEILPPPPPEPPTESAWERGLRHAKEVLKKATIRKEQEPDFEEKRFTVTIGEDEREFDKENEVFRDWNSRIPRDVRDTVLEPYADPYYDYEIERFWRGGQYENFRVQYTETEPYHNYRERERERERENRQRERERERERDRERERRQRERERERERERDKERQRRKEEWERERAKRDEKDRQHRDRDREKEREKEKGKPKPRSPQPPSRQAEPPKKEAATTGPQVKRADEWKDPWRRSKSPKKKLGVSVSPSRARRRRKTSASSASASNSSRSSSRSSSYSGSGSSRSRSRSSSYSSYSSRSSRHSSFSGSRSRSRSFSSSPSPSPTPSPHRPSIRTKGEPAPPPGKAGEKSVKKPAPPPAPPQATKTTAPVPEPTKPGDPREARRKERPARTPPRRRTLSGSGSGSGSSYSGSSSRSRSLSVSSVSSVSSATSSSSSAHSVDSEDMYADLASPVSSASSRSPAPAQTRKEKGKSKKEDGVKEEKRKRDSSTQPPKSAKPPAGGKSSQQPSTPQQAPPGQPQQGTFVAHKEIKLTLLNKAADKGSRKRYEPSDKDRQSPPPAKRPNTSPDRGSRDRKSGGRLGSPKPERQRGQNSKAPAAPADRKRQLSPQSKSSSKVTSVPGKASDPGAASTKSGKASTLSRREELLKQLKAVEDAIARKRAKIPGKA

SEQ ID NO: 98868 - protein, 238 aa, Homo sapiens
  Payload ID: 19732
  Gene Name: zinc finger CCCH-type containing 18
  ENSP ID: ENSP00000455083
  MOD_RES (1)..(1): Any amino acid
XGEVKDPSDRKVRPRPTCRFFMKGNCTWGMNCRFIHPGVNDKGNYSLITKADPFPPNGAPPLGPHPLMPANPWGGPVVDEILPPPPPEPPTESAWERGLRHAKEVLKKATIRKEQEPDFEEKRFTVTIGEDEREFDKENEVFRDWNSRIPRDVRDTVRQAEPPKKEAATTGPQVKRADEWKDPWRRSKSPKKKLGVSVSPSRARRRRKTSASSASASNSSRSSSRSSSYSGSGSSRSR

SEQ ID NO: 98869 - protein, 197 aa, Homo sapiens
  Payload ID: 19732
  Gene Name: zinc finger CCCH-type containing 18
  ENSP ID: ENSP00000455260
MDVAESPERDPHSPEDEEQPQGLSDDDILRDSGSDQDLDGAGVRASDLEDEESAARGPSQEEEDNHSDEEDRASEPKSQDQDSEDDDLEEGEVKDPSDRKVRPRPTCRFFMKGNCTWGMNCRFIHPGVNDKGNYSLITKADPFPPNGAPPLGPHPLMPANPWGGPVVDEILPPPPPEPPTESAWERGLRHAKEVLKK

SEQ ID NO: 98870 - protein, 196 aa, Homo sapiens
  Payload ID: 19732
  Gene Name: zinc finger CCCH-type containing 18
  ENSP ID: ENSP00000456241
KSKKEDGVKEEKRKRDSSTQPPKSAKPPAGGKSSQQPSTPQQAPPGQPQQGTFVAHKEIKLTLLNKAADKGSRKRYEPSDKDRQSPPPAKRPNTSPDRGSRDRKSGGRLGSPKPERQRGQNSKAPAAPADRKRQLSPQSKSSSKVTSVPGKASDPGAASTKSGKASTLSRREELLKQLKAVEDAIARKRAKIPGKA

SEQ ID NO: 98871 - protein, 75 aa, Homo sapiens
  Payload ID: 19732
  Gene Name: zinc finger CCCH-type containing 18
  ENSP ID: ENSP00000456334
PPPGKAGEKSVKKPAPPPAPPQATKTTAPVPEPTKPGDPREARRKERPARTPPRRRTLSGSGSGSGSSYSGSLLS

SEQ ID NO: 98872 - protein, 948 aa, Homo sapiens
  Payload ID: 19733
  Gene Name: zinc finger CCCH-type containing 3
  Uniprot ID: Q8IXZ2
  ENSP ID: ENSP00000262577
MEEKEILRRQIRLLQGLIDDYKTLHGNAPAPGTPAASGWQPPTYHSGRAFSARYPRPSRRGYSSHHGPSWRKKYSLVNRPPGPSDPPADHAVRPLHGARGGQPPVPQQHVLERQVQLSQGQNVVIKVKPPSKSGSASASGAQRGSLEEFEETPWSDQRPREGEGEPPRGQLQPSRPTRARGTCSVEDPLLVCQKEPGKPRMVKSVGSVGDSPREPRRTVSESVIAVKASFPSSALPPRTGVALGRKLGSHSVASCAPQLLGDRRVDAGHTDQPVPSGSVGGPARPASGPRQAREASLVVTCRTNKFRKNNYKWVAASSKSPRVARRALSPRVAAENVCKASAGMANKVEKPQLIADPEPKPRKPATSSKPGSAPSKYKWKASSPSASSSSSFRWQSEASSKDHASQLSPVLSRSPSGDRPAVGHSGLKPLSGETPLSAYKVKSRTKIIRRRSSTSLPGDKKSGTSPAATAKSHLSLRRRQALRGKSSPVLKKTPNKGLVQVTTHRLCRLPPSRAHLPTKEASSLHAVRTAPTSKVIKTRYRIVKKTPASPLSAPPFPLSLPSWRARRLSLSRSLVLNRLRPVASGGGKAQPGSPWWRSKGYRCIGGVLYKVSANKLSKTSGQPSDAGSRPLLRTGRLDPAGSCSRSLASRAVQRSLAIIRQARQRREKRKEYCMYYNRFGRCNRGERCPYIHDPEKVAVCTRFVRGTCKKTDGTCPFSHHVSKEKMPVCSYFLKGICSNSNCPYSHVYVSRKAEVCSDFLKGYCPLGAKCKKKHTLLCPDFARRGACPRGAQCQLLHRTQKRHSRRAATSPAPGPSDATARSRVSASHGPRKPSASQRPTRQTPSSAALTAAAVAAPPHCPGGSASPSSSKASSSSSSSSSPPASLDHEAPSLQEAALAAACSNRLCKLPSFISLQSSPSPGAQPRVRAPRAPLTKDSGKPLHIKPRL

SEQ ID NO: 98873 - protein, 79 aa, Homo sapiens
  Payload ID: 19733
  Gene Name: zinc finger CCCH-type containing 3
  ENSP ID: ENSP00000436834
RIVKKTPASPLSAPPFPLSLPSWRARRLSLSRYHCPCKGRMKFAEVTTPFQGAEPDLLCGLRRGCPRAWEWGDVCCESL

SEQ ID NO: 98874 - protein, 520 aa, Homo sapiens
  Payload ID: 19733
  Gene Name: zinc finger CCCH-type containing 3
  ENSP ID: ENSP00000488807
MEEKEILRRQIRLLQGLIDDYKTLHGNAPAPGTPAASGWQPPTYHSGRAFSARYPRPSRRGYSSHHGPSWRKKYSLVNRPPGPSDPPADHAVRPLHGARGGQPPVPQQHVLERQVQLSQGQNVVIKVKPPSKSGSASASGAQRGSLEEFEETPWSDQRPREGEGEPPRGQLQPSRPTRARGTCSVEDPLLVCQKEPGKPRMVKSVGSVGDSPREPRRTVSESVIAVKASFPSSALPPRTGVALGRKLGSHSVASCAPQLLGDRRVDAGHTDQPVPSGSVGGPARPASGPRQAREASLVVTCRTNKFRKNNYKWVAASSKSPRVARRALSPRVAAENVCKASAGMANKVEKPQLIADPEPKPRKPATSSKPGSAPSKYKWKASSPSASSSSSFRWQSEASSKDHASQLSPVLSRSPSGDRPAVGHSGLKPLSGETPLSAYKVKSRTKIIRRRSSTSLPGDKKSGTSPAATAKSHLSLRRRQALRGKSSPVLKKTPNKGLVQVTTHRLCRLPPSRAHLPTKE

SEQ ID NO: 98875 - protein, 1303 aa, Homo sapiens
  Payload ID: 19734
  Gene Name: zinc finger CCCH-type containing 4
  Uniprot ID: Q9UPT8
  ENSP ID: ENSP00000253048
MEAAPGTPPPPPSESPPPPSPPPPSTPSPPPCSPDARPATPHLLHHRLPLPDDREDGELEEGELEDDGAEETQDTSGGPERSRKEKGEKHHSDSDEEKSHRRLKRKRKKEREKEKRRSKKRRKSKHKRHASSSDDFSDFSDDSDFSPSEKGHRKYREYSPPYAPSHQQYPPSHATPLPKKAYSKMDSKSYGMYEDYENEQYGEYEGDEEEDMGKEDYDDFTKELNQYRRAKEGSSRGRGSRGRGRGYRGRGSRGGSRGRGMGRGSRGRGRGSMGGDHPEDEEDFYEEEMDYGESEEPMGDDDYDEYSKELNQYRRSKDSRGRGLSRGRGRGSRGRGKGMGRGRGRGGSRGGMNKGGMNDDEDFYDEDMGDGGGGSYRSRDHDKPHQQSDKKGKVICKYFVEGRCTWGDHCNFSHDIELPKKRELCKFYITGFCARAENCPYMHGDFPCKLYHTTGNCINGDDCMFSHDPLTEETRELLDKMLADDAEAGAEDEKEVEELKKQGINPLPKPPPGVGLLPTPPRPPGPQAPTSPNGRPMQGGPPPPPPPPPPPPGPPQMPMPVHEPLSPQQLQQQDMYNKKIPSLFEIVVRPTGQLAEKLGVRFPGPGGPPGPMGPGPNMGPPGPMGGPMHPDMHPDMHPDMHPDMHADMHADMPMGPGMNPGPPMGPGGPPMMPYGPGDSPHSGMMPPIPPAQNFYENFYQQQEGMEMEPGLLGDAEDYGHYEELPGEPGEHLFPEHPLEPDSFSEGGPPGRPKPGAGVPDFLPSAQRALYLRIQQKQQEEEERARRLAESSKQDRENEEGDTGNWYSSDEDEGGSSVTSILKTLRQQTSSRPPASVGELSSSGLGDPRLQKGHPTGSRLADPRLSRDPRLTRHVEASGGSGPGDSGPSDPRLARALPTSKPEGSLHSSPVGPSSSKGSGPPPTEEEEGERALREKAVNIPLDPLPGHPLRDPRSQLQQFSHIKKDVTLSKPSFARTVLWNPEDLIPLPIPKQDAVPPVPAALQSMPTLDPRLHRAATAGPPNARQRPGASTDSSTQGANLPDFELLSRILKTVNATGSSAAPGSSDKPSDPRVRKAPTDPRLQKPTDSTASSRAAKPGPAEAPSPTASPSGDASPPATAPYDPRVLAAGGLGQGGGGGQSSVLSGISLYDPRTPNAGGKATEPAADTGAQPKGAEGNGKSSASKAKEPPFVRKSALEQPETGKAGADGGTPTDRYNSYNRPRPKAAAAPAATTATPPPEGAPPQPGVHNLPVPTLFGTVKQTPKTGSGSPFAGNSPAREGEQDAASLKDVFKGFDPTASPFCQ

SEQ ID NO: 98876 - protein, 910 aa, Homo sapiens
  Payload ID: 19734
  Gene Name: zinc finger CCCH-type containing 4
  ENSP ID: ENSP00000469684
  MOD_RES (1)..(1): Any amino acid
XNQYRRSKDSRGRGLSRGRGRGSRGRGKGMGRGRGRGGSRGGMNKGGMNDDEDFYDEDMGDGGGGSYRSRDHDKPHQQSDKKGKVICKYFVEGRCTWGDHCNFSHDIELPKKRELCKFYITGFCARAENCPYMHGDFPCKLYHTTGNCINGDDCMFSHDPLTEETRELLDKMLADDAEAGAEDEKEVEELKKQGINPLPKPPPGVGLLPTPPRPPGPQAPTSPNGRPMQGGPPPPPPPPPPPPGPPQMPMPVHEPLSPQQLQQQDMYNKKIPSLFEIVVRPTGQLAEKLGVRFPGPGGPPGPMGPGPNMGPPGPMGGPMHPDMHPDMHPDMHPDMHADMHADMPMGPGMNPGPPMGPGGPPMMPYGPGDSPHSGMMPPIPPAQNFYENFYQQQEGMEMEPGLLGDAGDTGNWYSSDEDEGGSSVTSILKTLRQQTSSRPPASVGELSSSGLGDPRLQKGHPTGSRLADPRLSRDPRLTRHVEASGGSGPGDSGPSDPRLARALPTSKPEGSLHSSPVGPSSSKGSGPPPTEEEEGERALREKAVNIPLDPLPGHPLRDPRSQLQQFSHIKKDVTLSKPSFARTVLWNPEDLIPLPIPKQDAVPPVPAALQSMPTLDPRLHRAATAGPPNARQRPGASTDSSTQGANLPDFELLSRILKTVNATGSSAAPGSSDKPSDPRVRKAPTDPRLQKPTDSTASSRAAKPGPAEAPSPTASPSGDASPPATAPYDPRVLAAGGLGQGGGGGQSSVLSGISLYDPRTPNAGGKATEPAADTGAQPKGAEGNGKSSASKAKEPPFVRKSALEQPETGKAGADGGTPTDRYNSYNRPRPKAAAAPAATTATPPPEGAPPQPGVHNLPVPTLFGTVKQTPKTGSGSPFAGNSPAREGEQDAASLKDVFKGFDPTASPFCQ

SEQ ID NO: 98877 - protein, 1189 aa, Homo sapiens
  Payload ID: 19735
  Gene Name: zinc finger CCCH-type containing 6
  Uniprot ID: P61129
  ENSP ID: ENSP00000340298
MTDSEHAGHDREDGELEDGEIDDAGFEEIQEKEAKENEKQKSEKAYRKSRKKHKKEREKKKSKRRKREKHKHNSPSSDDSSDYSLDSDVEHTESSHKKRTGFYRDYDIPFTQRGHISGSYITSKKGQHNKKFKSKEYDEYSTYSDDNFGNYSDDNFGNYGQETEEDFANQLKQYRQAKETSNIALGSSFSKESGKKQRMKGVQQGIEQRVKSFNVGRGRGLPKKIKRKERGGRTNKGPNVFSVSDDFQEYNKPGKKWKVMTQEFINQHTVEHKGKQICKYFLEGRCIKGDQCKFDHDAELEKRKEICKFYLQGYCTKGENCIYMHNEFPCKFYHSGAKCYQGDNCKFSHDDLTKETKKLLDKVLNTDEELINEDERELEELRKRGITPLPKPPPGVGLLPTPPEHFPFSDPEDDFQTDFSDDFRKIPSLFEIVVKPTVDLAHKIGRKPPAFYTSASPPGPQFQGSSPHPQHIYSSGSSPGPGPNMSQGHSSPVMHPGSPGHHPCAGPPGLPVPQSPPLPPGPPEIVGPQNQAGVLVQPDTSLTPPSMGGAYHSPGFPGHVMKVPRENHCSPGSSYQQSPGEMQLNTNYESLQNPAEFYDNYYAQHSIHNFQPPNNSGDGMWHGEFAQQQPPVVQDSPNHGSGSDGSSTRTGHGPLPVPGLLPAVQRALFVRLTQRYQEDEEQTSTQPHRAPSKEEDDTVNWYSSSEEEEGSSVKSILKTLQKQTETLRNQQQPSTELSTPTDPRLAKEKSKGNQVVDPRLRTIPRQDIRKPSESAPLDLRLAWDPRKLRGNGSGHIGSSVGGAKFDLHHANAGTNVKHKRGDDDDEDTERELREKAFLIPLDASPGIMLQDPRSQLRQFSHIKMDITLTKPNFAKHIVWAPEDLLPVPLPKPDPVSSINLPLPPLIADQRLNRLWNTKSDLHQNTVSIDPKLAAKAKINTTNREGYLEQFGDSHGSGAKLGDPRLQKNFDPRLHRLPNTESHQVVMKDSHASKGAPHLPRSNPGSSQPSGAGTSNSGSGALPPYAPKLSSSAGLPLGTSTSVLSGISLYDPRDHGSSSTSELATASSGENSKNQKKSGGLKSSDKTEPSPGEAILPQKPSPNVGVTLEGPADPQADVPRSSGKVQVPAVHSLPVQALTGLIRPQYSDPRQARQPGQGSPTPDNDPGRETDDKSLKEVFKTFDPTASPFC

SEQ ID NO: 98878 - protein, 1189 aa, Homo sapiens; identical to SEQ ID NO: 98877
  Payload ID: 19735
  Gene Name: zinc finger CCCH-type containing 6
  Uniprot ID: P61129
  ENSP ID: ENSP00000386764

SEQ ID NO: 98879 - protein, 971 aa, Homo sapiens
  Payload ID: 19736
  Gene Name: zinc finger CCCH-type containing 7A
  Uniprot ID: Q8IWR0
  ENSP ID: ENSP00000347999
MSNVSEERRKRQQNIKEGLQFIQSPLSYPGTQEQYAVYLRALVRNLFNEGNDVYREHDWNNSISQYTEALNIADYAKSEEILIPKEIIEKLYINRIACYSNMGFHDKVLEDCNIVLSLNASNCKALYRKSKALSDLGRYKKAYDAVAKCSLAVPQDEHVIKLTQELAQKLGFKIRKAYVRAELSLKSVPGDGATKALNHSVEDIEPDLLTPRQEAVPVVSLPAPSFSHEVGSELASVPVMPLTSILPLQVEESALPSAVLANGGKMPFTMPEAFLDDGDMVLGDELDDLLDSAPETNETVMPSALVRGPLQTASVSPSMPFSASLLGTLPIGARYAPPPSFSEFYPPLTSSLEDFCSSLNSFSMSESKRDLSTSTSREGTPLNNSNSSLLLMNGPGSLFASENFLGISSQPRNDFGNFFGSAVTKPSSSVTPRHPLEGTHELRQACQICFVKSGPKLMDFTYHANIDHKCKKDILIGRIKNVEDKSWKKIRPRPTKTNYEGPYYICKDVAAEEECRYSGHCTFAYCQEEIDVWTLERKGAFSREAFFGGNGKINLTVFKLLQEHLGEFIFLCEKCFDHKPRMISKRNKDNSTACSHPVTKHEFEDNKCLVHILRETTVKYSKIRSFHGQCQLDLCRHEVRYGCLREDECFYAHSLVELKVWIMQNETGISHDAIAQESKRYWQNLEANVPGAQVLGNQIMPGFLNMKIKFVCAQCLRNGQVIEPDKNRKYCSAKARHSWTKDRRAMRVMSIERKKWMNIRPLPTKKQMPLQFDLCNHIASGKKCQYVGNCSFAHSPEEREVWTYMKENGIQDMEQFYELWLKSQKNEKSEDIASQSNKENGKQIHMPTDYAEVTVDFHCWMCGKNCNSEKQWQGHISSEKHKEKVFHTEDDQYCWQHRFPTGYFSICDRYMNGTCPEGNSCKFAHGNAELHEWEERRDALKMKLNKARKDHLIGPNDNDFGKYSFLFKDLN

SEQ ID NO: 98880 - protein, 971 aa, Homo sapiens; identical to SEQ ID NO: 98879
  Payload ID: 19736
  Gene Name: zinc finger CCCH-type containing 7A
  Uniprot ID: Q8IWR0
  ENSP ID: ENSP00000379773

SEQ ID NO: 98881 - protein, 77 aa, Homo sapiens
  Payload ID: 19736
  Gene Name: zinc finger CCCH-type containing 7A
  ENSP ID: ENSP00000459206
MSNVSEERRKRQQNIKEGLQFIQSPLSYPGTQEQYAVYLRALVRNLFNEGNDVYREHDWNNSISQYTEALNIADYAK

SEQ ID NO: 98882 - protein, 92 aa, Homo sapiens
  Payload ID: 19736
  Gene Name: zinc finger CCCH-type containing 7A
  ENSP ID: ENSP00000459458
GDELDDLLDSAPETNETVMPSALVRGPLQTASVSPSMPFSASLLGTLPIGARYAPPPSFSEFYPPLTSSLEDFCSSLNSFSMSESKRDEWTR

SEQ ID NO: 98883 - protein, 167 aa, Homo sapiens
  Payload ID: 19736
  Gene Name: zinc finger CCCH-type containing 7A
  Uniprot ID: Q8IWR0
  ENSP ID: ENSP00000459477
MKENGIQDMEQFYELWLKSQKNEKSEDIASQSNKENGKQIHMPTDYAEVTVDFHCWMCGKNCNSEKQWQGHISSEKHKEKVFHTEDDQYCWQHRFPTGYFSICDRYMNGTCPEGNSCKFAHGNAELHEWEERRDALKMKLNKARKDHLIGPNDNDFGKYSFLFKDLN

SEQ ID NO: 98884 - protein, 733 aa, Homo sapiens
  Payload ID: 19736
  Gene Name: zinc finger CCCH-type containing 7A
  ENSP ID: ENSP00000459747
MSNVSEERRKRQQNIKEGLQFIQSPLSYPGTQEQYAVYLRALVRNLFNEGNDVYREHDWNNSISQYTEALNIADYAKSEEILIPKEIIEKLYINRIACYSNMGFHDKVLEDCNIVLSLNASNCKALYRKSKALSDLGRYKKAYDAVAKCSLAVPQDEHVIKLTQELAQKLGFKIRKAYVRAELSLKSVPGDGATKALNHSVEDIEPDLLTPRQEAVPVVSLPAPSFSHEVGSELASVPVMPLTSILPLQVEESALPSAVLANGGKMPFTMPEAFLDDGDMVLGDELDDLLDSAPETNETVMMNGPGSLFASENFLGISSQPRNDFGNFFGSAVTKPSSSVTPRHPLEGTHELRQACQICFVKSGPKLMDFTYHANIDHKCKKDILIGRIKNVEDKSWKKIRPRPTKTNYEGPYYICKDVAAEEECRYSGHCTFAYCQEEIDVWTLERKGAFSREAFFGGNGKINLTVFKLLQEHLGEFIFLCEKCFDHKPRMISKRNKDNSTACSHPVTKHEFEDNKCLVHILRETTVKYSKIRSFHGQCQLDLCRHEVRYGCLREDECFYAHSLVELKVWIMQNETGISHDAIAQESKRYWQNLEANVPGAQVLGNQIMPGFLNMKIKFVCAQCLRNGQVIEPDKNRKYCSAKARHSWTKDRRAMRVMSIERKKWMNIRPLPTKKQMPLQFDLCNHIASGKKCQYVGNCSFAHSPEEREVWTYMKENGIQDMEQFYELWLKS

SEQ ID NO: 98885 - protein, 225 aa, Homo sapiens
  Payload ID: 19736
  Gene Name: zinc finger CCCH-type containing 7A
  ENSP ID: ENSP00000459811
  MOD_RES (1)..(1): Any amino acid
XNGKINLTVFKLLQEHLGEFIFLCEKCFDHKPRMISKRNKDNSTACSHPVTKHEFEDNKCLVHILRETTVKYSKIRSFHGQCQLDLCRHEVRYGCLREDECFYAHSLVELKVWIMQNETGISHDAIAQESKRYWQNLEANVPGAQVLGNQIMPGFLNMKIKFVCAQCLRNGQVIEPDKNRKYCSAKARHSWTKDRRAMRVMSIEPVQPYCFWEKMSICWKLFLCS

SEQ ID NO: 98886 - protein, 328 aa, Homo sapiens
  Payload ID: 19736
  Gene Name: zinc finger CCCH-type containing 7A
  ENSP ID: ENSP00000460122
IKLTQELAQKLGFKIRKAYVRAEALNHSVEDIEPDLLTPRQEAVPVVSLPAPSFSHEVGSELASVPVMPLTSILPLQVEESALPSAVLANGGKMPFTMPEAFLDDGDMVLGDELDDLLDSAPETNETVMPSALVRGPLQTASVSPSMPFSASLLGTLPIGARYAPPPSFSEFYPPLTSSLEDFCSSLNSFSMSESKRDLSTSTSREGTPLNNSNSSLLLMNGPGSLFASENFLGISSQPRNDFGNFFGSAVTKPSSSVTPRHPLEGTHELRQACQICFVKSGPKLMDFTYHANIDHKCKKDILIGRIKNVEDKSWKKIRPRPTKTNYE

SEQ ID NO: 98887 - protein, 152 aa, Homo sapiens
  Payload ID: 19736
  Gene Name: zinc finger CCCH-type containing 7A
  ENSP ID: ENSP00000460253
MSNVSEERRKRQQNIKEGLQFIQSPLSYPGTQEQYAVYLRALVRNLFNEGNDVYREHDWNNSISQYTEALNIADYAKSEEILIPKEIIEKLYINRIACYSNMGFHDKVLEDCNIVLSLNASNCKALYRKSKALSDLGRYKKAYDAVAKCSLA

SEQ ID NO: 98888 - protein, 70 aa, Homo sapiens
  Payload ID: 19736
  Gene Name: zinc finger CCCH-type containing 7A
  ENSP ID: ENSP00000460422
MSNVSEERRKRQQNIKEGLQFIQSPLSYPGTQEQYAVYLRALVRNLFNEGNDVYREHDWNNSISQYTEAL

SEQ ID NO: 98889 - protein, 60 aa, Homo sapiens
  Payload ID: 19736
  Gene Name: zinc finger CCCH-type containing 7A
  ENSP ID: ENSP00000460679
MSNVSEERRKRQQNIKEGLQFIQSPLSYPGTQEQYAVYLRALVRNLFNEGNDVYREHDWN

SEQ ID NO: 98890 - protein, 977 aa, Homo sapiens
  Payload ID: 19737
  Gene Name: zinc finger CCCH-type containing 7B
  Uniprot ID: Q9UGR2
  ENSP ID: ENSP00000345793
MERQKRKADIEKGLQFIQSTLPLKQEEYEAFLLKLVQNLFAEGNDLFREKDYKQALVQYMEGLNVADYAASDQVALPRELLCKLHVNRAACYFTMGLYEKALEDSEKALGLDSESIRALFRKARALNELGRHKEAYECSSRCSLALPHDESVTQLGQELAQKLGLRVRKAYKRPQELETFSLLSNGTAAGVADQGTSNGLGSIDDIETDCYVDPRGSPALLPSTPTMPLFPHVLDLLAPLDSSRTLPSTDSLDDFSDGDVFGPELDTLLDSLSLVQGGLSGSGVPSELPQLIPVFPGGTPLLPPVVGGSIPVSSPLPPASFGLVMDPSKKLAASVLDALDPPGPTLDPLDLLPYSETRLDALDSFGSTRGSLDKPDSFMEETNSQDHRPPSGAQKPAPSPEPCMPNTALLIKNPLAATHEFKQACQLCYPKTGPRAGDYTYREGLEHKCKRDILLGRLRSSEDQTWKRIRPRPTKTSFVGSYYLCKDMINKQDCKYGDNCTFAYHQEEIDVWTEERKGTLNRDLLFDPLGGVKRGSLTIAKLLKEHQGIFTFLCEICFDSKPRIISKGTKDSPSVCSNLAAKHSFYNNKCLVHIVRSTSLKYSKIRQFQEHFQFDVCRHEVRYGCLREDSCHFAHSFIELKVWLLQQYSGMTHEDIVQESKKYWQQMEAHAGKASSSMGAPRTHGPSTFDLQMKFVCGQCWRNGQVVEPDKDLKYCSAKARHCWTKERRVLLVMSKAKRKWVSVRPLPSIRNFPQQYDLCIHAQNGRKCQYVGNCSFAHSPEERDMWTFMKENKILDMQQTYDMWLKKHNPGKPGEGTPISSREGEKQIQMPTDYADIMMGYHCWLCGKNSNSKKQWQQHIQSEKHKEKVFTSDSDASGWAFRFPMGEFRLCDRLQKGKACPDGDKCRCAHGQEELNEWLDRREVLKQKLAKARKDMLLCPRDDDFGKYNFLLQEDGDLAGATPEAPAAAATATTGE

SEQ ID NO: 98891 - protein, 291 aa, Homo sapiens [sequence omitted]

SEQ ID NO: 98892 - protein, 291 aa, Homo sapiens [sequence omitted]

SEQ ID NO: 98893 - protein, 297 aa, Homo sapiens
  Payload ID: 19738
  Gene Name: zinc finger CCCH-type containing 8
  ENSP ID: ENSP00000483976
MDFENLFSKPPNPALGKTATDSDERIDDEIDTEVEETQEEKIKLECEQIPKKFRHSAISPKSSLHRKSRSKDYDVYSDNDICSQESEDNFAKELQQYIQAREMANAAQPEESTKKEGVKDTPQAAKQKNKNLKAGHKNGKQKKMKRKWPGPGNKGSNALLRNSGSQEEDGKPKEKQQHLSQAFINQHTVERKGKQICKYFLERKCIKGDQCKFDHDAEIEKKKEMCKFYVQGYCTRGENCLYLHNEYPCKFYHTGTKCYQGEYCKFSHAPLTPETQELLAKVLDTEKKSCNKIDIKR

SEQ ID NO: 98894 - protein, 902 aa, Homo sapiens
  Payload ID: 19739
  Gene Name: zinc finger CCCH-type, antiviral 1
  Uniprot ID: Q7Z2W4
  ENSP ID: ENSP00000242351
MADPEVCCFITKILCAHGGRMALDALLQEIALSEPQLCEVLQVAGPDRFVVLETGGEAGITRSVVATTRARVCRRKYCQRPCDNLHLCKLNLLGRCNYSQSERNLCKYSHEVLSEENFKVLKNHELSGLNKEELAVLLLQSDPFFMPEICKSYKGEGRQQICNQQPPCSRLHICDHFTRGNCRFPNCLRSHNLMDRKVLAIMREHGLNPDVVQNIQDICNSKHMQKNPPGPRAPSSHRRNMAYRARSKSRDRFFQGSQEFLASASASAERSCTPSPDQISHRASLEDAPVDDLTRKFTYLGSQDRARPPSGSSKATDLGGTSQAGTSQRFLENGSQEDLLHGNPGSTYLASNSTSAPNWKSLTSWTNDQGARRKTVFSPTLPAARSSLGSLQTPEAVTTRKGTGLLSSDYRIINGKSGTQDIQPGPLFNNNADGVATDITSTRSLNYKSTSSGHREISSPRIQDAGPASRDVQATGRIADDADPRVALVNDSLSDVTSTTSSRVDDHDSEEICLDHLCKGCPLNGSCSKVHFHLPYRWQMLIGKTWTDFEHMETIEKGYCNPGIHLCSVGSYTINFRVMSCDSFPIRRLSTPSSVTKPANSVFTTKWIWYWKNESGTWIQYGEEKDKRKNSNVDSSYLESLYQSCPRGVVPFQAGSRNYELSFQGMIQTNIASKTQKDVIRRPTFVPQWYVQQMKRGPDHQPAKTSSVSLTATFRPQEDFCFLSSKKYKLSEIHHLHPEYVRVSEHFKASMKNFKIEKIKKIENSELLDKFTWKKSQMKEEGKLLFYATSRAYVESICSNNFDSFLHETHENKYGKGIYFAKDAIYSHKNCPYDAKNVVMFVAQVLVGKFTEGNITYTSPPPQFDSCVDTRSNPSVFVIFQKDQVYPQYVIEYTEDKACVIS

SEQ ID NO: 98895 - protein, 1024 aa, Homo sapiens
  Payload ID: 19739
  Gene Name: zinc finger CCCH-type, antiviral 1
  ENSP ID: ENSP00000418385
MADPEVCCFITKILCAHGGRMALDALLQEIALSEPQLCEVLQVAGPDRFVVLETGGEAGITRSVVATTRARVCRRKYCQRPCDNLHLCKLNLLGRCNYSQSERNLCKYSHEVLSEENFKVLKNHELSGLNKEELAVLLLQSDPFFMPEICKSYKGEGRQQICNQQPPCSRLHICDHFTRGNCRFPNCLRSHNLMDRKVLAIMREHGLNPDVVQNIQDICNSKHMQKNPPGPRAPSSHRRNMAYRARSKSRDRFFQGSQEFLASASASAERSCTPSPDQISHRASLEDAPVDDLTRKFTYLGSQDRARPPSGSSKATDLGGTSQAGTSQRFLENGSQEDLLHGNPGSTYLASNSTSAPNWKSLTSWTNDQGARRKTVFSPTLPAARSSLGSLQTPEAVTTRKGTGLLSSDYRIINGKSGTQDIQPGPLFNNNADGVATDITSTRSLNYKSTSSGHREISSPRIQDAGPASRDVQATGRIADDADPRVALVNGKYKGKTLWASTFVHDIPNGSSQVVDKTTDVEKTGATGFGLTMAVKAEKDMLRTGSQSLRNLVPTTPGESTAPAQVSTLPQSPAALSSSNRAAVWGAQGQNCTQVPVSSASELTRKTTGSAQYSLSDVTSTTSSRVDDHDSEEICLDHLCKGCPLNGSCSKVHFHLPYRWQMLIGKTWTDFEHMETIEKGYCNPGIHLCSVGSYTINFRVMSCDSFPIRRLSTPSSVTKPANSVFTTKWIWYWKNESGTWIQYGEEKDKRKNSNVDSSYLESLYQSCPRGVVPFQAGSRNYELSFQGMIQTNIASKTQKDVIRRPTFVPQWYVQQMKRGPDHQPAKTSSVSLTATFRPQEDFCFLSSKKYKLSEIHHLHPEYVRVSEHFKASMKNFKIEKIKKIENSELLDKFTWKKSQMKEEGKLLFYATSRAYVESICSNNFDSFLHETHENKYGKGIYFAKDAIYSHKNCPYDAKNVVMFVAQVLVGKFTEGNITYTSPPPQFDSCVDTRSNPSVFVIFQKDQVYPQYVIEYTEDKACVIS

SEQ ID NO: 98896 - protein, 699 aa, Homo sapiens
  Payload ID: 19739
  Gene Name: zinc finger CCCH-type, antiviral 1
  Uniprot ID: Q7Z2W4
  ENSP ID: ENSP00000419855
MADPEVCCFITKILCAHGGRMALDALLQEIALSEPQLCEVLQVAGPDRFVVLETGGEAGITRSVVATTRARVCRRKYCQRPCDNLHLCKLNLLGRCNYSQSERNLCKYSHEVLSEENFKVLKNHELSGLNKEELAVLLLQSDPFFMPEICKSYKGEGRQQICNQQPPCSRLHICDHFTRGNCRFPNCLRSHNLMDRKVLAIMREHGLNPDVVQNIQDICNSKHMQKNPPGPRAPSSHRRNMAYRARSKSRDRFFQGSQEFLASASASAERSCTPSPDQISHRASLEDAPVDDLTRKFTYLGSQDRARPPSGSSKATDLGGTSQAGTSQRFLENGSQEDLLHGNPGSTYLASNSTSAPNWKSLTSWTNDQGARRKTVFSPTLPAARSSLGSLQTPEAVTTRKGTGLLSSDYRIINGKSGTQDIQPGPLFNNNADGVATDITSTRSLNYKSTSSGHREISSPRIQDAGPASRDVQATGRIADDADPRVALVNDSLSDVTSTTSSRVDDHDSEEICLDHLCKGCPLNGSCSKVHFHLPYRWQMLIGKTWTDFEHMETIEKGYCNPGIHLCSVGSYTINFRVMSCDSFPIRRLSTPSSVTKPANSVFTTKWIWYWKNESGTWIQYGEEKDKRKNSNVDSSYLESLYQSCPRGVVPFQAGSRNYELSFQGMIQTNIASKTQKDVIRRPTFVPQWYVQQMKRGPE

SEQ ID NO: 98897 - protein, 264 aa, Homo sapiens
  Payload ID: 19739
  Gene Name: zinc finger CCCH-type, antiviral 1
  ENSP ID: ENSP00000420107
  MOD_RES (1)..(1): Any amino acid
XESTAPAQVSTLPQSPAALSSSNRAAVWGAQGQNCTQVPVSSASELTRKTTGSAQYSLSDVTSTTSSRVDDHDSEEICLDHLCKGCPLNGSCSKVHFHLPYRWQMLIGKTWTDFEHMETIEKGYCNPGIHLCSVGSYTINFRVMSCDSFPIRRLSTPSSVTKPANSVFTTKWIWYWKNESGTWIQYGEEKDKRKNSNVDSSYLESLYQSCPRGVVPFQAGSRNYELSFQGMIQTNIASKTQKDVIRRPTFVPQWYVQQMKRGPE

SEQ ID NO: 98898 - protein, 300 aa, Homo sapiens
  Payload ID: 19740
  Gene Name: zinc finger CCCH-type, antiviral 1-like
  Uniprot ID: Q96H79
  ENSP ID: ENSP00000275766
MAEPTVCSFLTKVLCAHGGRMFLKDLRGHVELSEARLRDVLQRAGPERFLLQEVETQEGLGDAEAEAAAGAVGGGGTSAWRVVAVSSVRLCARYQRGECQACDQLHFCRRHMLGKCPNRDCWSTCTLSHDIHTPVNMQVLKSHGLFGLNENQLRILLLQNDPCLLPEVCLLYNKGEALYGYCNLKDKCNKFHVCKSFVKGECKLQTCKRSHQLIHAASLKLLQDQGLNIPSVVNFQIISTYKHMKLHKMLENTDNSSPSTEHSQGLEKQGVHAAGAAEAGPLASVPAQSAKKPCPVSCEK

SEQ ID NO: 98899 - protein, 217 aa, Homo sapiens
  Payload ID: 19741
  Gene Name: zinc finger CCHC-type and RNA binding motif 1
  Uniprot ID: Q8TBF4
  ENSP ID: ENSP00000266529
MSGGLAPSKSTVYVSNLPFSLTNNDLYRIFSKYGKVVKVTIMKDKDTRKSKGVAFILFLDKDSAQNCTRAINNKQLFGRVIKASIAIDNGRAAEFIRRRNYFDKSKCYECGESGHLSYACPKNMLGEREPPKKKEKKKKKKAPEPEEEIEEVEESEDEGEDPALDSLSQAIAFQQAKIEEEQKKWKPSSGVPSTSDDSRRPRIKKSTYFSDEEELSD

SEQ ID NO: 98900 - protein, 176 aa, Homo sapiens
  Payload ID: 19741
  Gene Name: zinc finger CCHC-type and RNA binding motif 1
  ENSP ID: ENSP00000446732
MKDKDTRKSKGVAFILFLDKDSAQNCTRAINNKQLFGRVIKASIAIDNGRAAEFIRRRNYFDKSKCYECGESGHLSYACPKNMLGEREPPKKKEKKKKKKAPEPEEEIEEVEESEDEGEDPALDSLSQAIAFQQAKIEEEQKKWKPSSGVPSTSDDSRRPRIKKSTYFSDEEELSD

SEQ ID NO: 98901 - protein, 133 aa, Homo sapiens
  Payload ID: 19741
  Gene Name: zinc finger CCHC-type and RNA binding motif 1
  ENSP ID: ENSP00000448780
MKDKDTRKSKGVAFILFLDKDSAQNCTRAINNKQLFGRVIKASIAIDNGRAAEFIRRRNYFDKSKCYECGESGHLSYACPKNMLGEREPPKKKEKKKKKKAPEPEEEIEEVEESEDEGEDPALDSLSQAIAFQ

SEQ ID NO: 98902 - protein, 1124 aa, Homo sapiens
  Payload ID: 19742
  Gene Name: zinc finger E-box binding homeobox 1
  Uniprot ID: P37275
  ENSP ID: ENSP00000319248
MADGPRCKRRKQANPRRNNVTNYNTVVETNSDSDDEDKLHIVEEESVTDAADCEGVPEDDLPTDQTVLPGRSSEREGNAKNCWEDDRKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 98903 - protein, 1125 aa, Homo sapiens
  Payload ID: 19742
  Gene Name: zinc finger E-box binding homeobox 1
  Uniprot ID: P37275
  ENSP ID: ENSP00000354487
MADGPRCKRRKQANPRRNNVTNYNTVVETNSDSDDEDKLHIVEEESVTDAADCEGVPEDDLPTDQTVLPGRSSEREGNAKNCWEDDTGKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 98904 - protein, 1108 aa, Homo sapiens
  Payload ID: 19742
  Gene Name: zinc finger E-box binding homeobox 1
  Uniprot ID: P37275
  ENSP ID: ENSP00000391612
MKVTNYNTVVETNSDSDDEDKLHIVEEESVTDAADCEGVPEDDLPTDQTVLPGRSSEREGNAKNCWEDDTGKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 98905 - protein, 53 aa, Homo sapiens
  Payload ID: 19742
  Gene Name: zinc finger E-box binding homeobox 1
  ENSP ID: ENSP00000405958
MADGPRCKRRKQANPRRNNVFSLNSQLAIGRKLPSEDMIIQMSFCDLATVCLT

SEQ ID NO: 98906 - protein, 289 aa, Homo sapiens
  Payload ID: 19742
  Gene Name: zinc finger E-box binding homeobox 1
  ENSP ID: ENSP00000415961
MADGPRCKRRKQANPRRNNVTNYNTVVETNSDSDDEDKLHIVEEESVTDAADCEGVPEDDLPTDQTVLPGRSSEREGNAKNCWEDDTGKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHIS

SEQ ID NO: 98907 - protein, 1057 aa, Homo sapiens
  Payload ID: 19742
  Gene Name: zinc finger E-box binding homeobox 1
  Uniprot ID: P37275
  ENSP ID: ENSP00000444891
MADGPRCKRRKQANPRRNNGKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 98908 - protein, 1104 aa, Homo sapiens
  Payload ID: 19742
  Gene Name: zinc finger E-box binding homeobox 1
  Uniprot ID: P37275
  ENSP ID: ENSP00000452787
MADGPRCKRRKQANPRRNNVTNYNTVVETNSDSDDEDKLHIVEEESVTDAADCEGVPEDDLPTDQTVLPGRSSEREGNAKNCWEDDIKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 98909 - protein, 274 aa, Homo sapiens
  Payload ID: 19742
  Gene Name: zinc finger E-box binding homeobox 1
  ENSP ID: ENSP00000453559
MTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNL

SEQ ID NO: 98910 - protein, 277 aa, Homo sapiens
  Payload ID: 19742
  Gene Name: zinc finger E-box binding homeobox 1
  ENSP ID: ENSP00000453674
MKVTNYNTVVETNSDSDDEDKLHIVEEESVTDAADCEGVPEDDLPTDQTVLPGRSSEREGNAKNCWEDDTGKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCI

SEQ ID NO: 98911 - protein, 288 aa, Homo sapiens
  Payload ID: 19742
  Gene Name: zinc finger E-box binding homeobox 1
  ENSP ID: ENSP00000453970
MADGPRCKRRKQANPRRNNVTNYNTVVETNSDSDDEDKLHIVEEESVTDAADCEGVPEDDLPTDQTVLPGRSSEREGNAKNCWEDDRTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVAS

SEQ ID NO: 98912 - protein, 1213 aa, Homo sapiens
  Payload ID: 19743
  Gene Name: zinc finger E-box binding homeobox 2
  ENSP ID: ENSP00000302501
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKAVLQPHENIVPNKAGVFVDNKALLLSSVLSEKGMTSPINPYKDHMSVLKAYYAMNMEPNSDELLKISIAVGLPQEFVKEWFEQRKVYQYSNSRSPSLERSSKPLAPNSNPPTKDSLLPRSPVKPMDSITSPSIAELHNSVTNCDPPLRLTKPSHFTNIKPVEKLDHSRSNTPSPLNLSSTSSKNSHSSSYTPNSFSSEELQAEPLDLSLPKQMKEPKSIIATKNKTKASSISLDHNSVSSSSENSDEPLNLTFIKKEFSNSNNLDNKSTNPVFSMNPFSAKPLYTALPPQSAFPPATFMPPVQTSIPGLRPYPGLDQMSFLPHMAYTYPTGAATFADMQQRRKYQRKQGFQGELLDGAQDYMSGLDDMTDSDSCLSRKKIKKTESGMYACDLCDKTFQKSSSLLRHKYEHTGKRPHQCQICKKAFKHKHHLIEHSRLHSGEKPYQCDKCGKRFSHSGSYSQHMNHRYSYCKREAEEREAAEREAREKGHLEPTELLMNRAYLQSITPQGYSDSEERESMPRDGESEKEHEKEGEDGYGKLGRQDGDEEFEEEEEESENKSMDTDPETIRDEEETGDHSMDDSSEDGKMETKSDHEEDNMEDGM

SEQ ID NO: 98913 - protein, 467 aa, Homo sapiens
  Payload ID: 19743
  Gene Name: zinc finger E-box binding homeobox 2
  ENSP ID: ENSP00000376601
MCVSEIEPACCRSRAPSPCELPSDPLLSMKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHL

SEQ ID NO: 98914 - protein, 1214 aa, Homo sapiens
  Payload ID: 19743
  Gene Name: zinc finger E-box binding homeobox 2
  Uniprot ID: O60315
  ENSP ID: ENSP00000386854
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKAVLQPHENIVPNKAGVFVDNKALLLSSVLSEKGMTSPINPYKDHMSVLKAYYAMNMEPNSDELLKISIAVGLPQEFVKEWFEQRKVYQYSNSRSPSLERSSKPLAPNSNPPTKDSLLPRSPVKPMDSITSPSIAELHNSVTNCDPPLRLTKPSHFTNIKPVEKLDHSRSNTPSPLNLSSTSSKNSHSSSYTPNSFSSEELQAEPLDLSLPKQMKEPKSIIATKNKTKASSISLDHNSVSSSSENSDEPLNLTFIKKEFSNSNNLDNKSTNPVFSMNPFSAKPLYTALPPQSAFPPATFMPPVQTSIPGLRPYPGLDQMSFLPHMAYTYPTGAATFADMQQRRKYQRKQGFQGELLDGAQDYMSGLDDMTDSDSCLSRKKIKKTESGMYACDLCDKTFQKSSSLLRHKYEHTGKRPHQCQICKKAFKHKHHLIEHSRLHSGEKPYQCDKCGKRFSHSGSYSQHMNHRYSYCKREAEEREAAEREAREKGHLEPTELLMNRAYLQSITPQGYSDSEERESMPRDGESEKEHEKEGEDGYGKLGRQDGDEEFEEEEEESENKSMDTDPETIRDEEETGDHSMDDSSEDGKMETKSDHEEDNMEDGM

SEQ ID NO: 98915 - protein, 120 aa, Homo sapiens
  Payload ID: 19743
  Gene Name: zinc finger E-box binding homeobox 2
  ENSP ID: ENSP00000387256
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPVKNANCTSDF

SEQ ID NO: 98916 - protein, 220 aa, Homo sapiens
  Payload ID: 19743
  Gene Name: zinc finger E-box binding homeobox 2
  ENSP ID: ENSP00000394777
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGT

SEQ ID NO: 98917 - protein, 731 aa, Homo sapiens
  Payload ID: 19743
  Gene Name: zinc finger E-box binding homeobox 2
  ENSP ID: ENSP00000395496
MTHFEDIEPACCRSRAPSPCELPSDPLLSMKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKAVLQPHENIVPNKAGVFVDNKALLLSSVLSEKGMTSPINPYKDHMSVLKAYYAMNMEPNSDELLKISIAVGLPQEFVKEWFEQRKVYQYSN

SEQ ID NO: 98918 - protein, 63 aa, Homo sapiens
  Payload ID: 19743
  Gene Name: zinc finger E-box binding homeobox 2
  ENSP ID: ENSP00000399451
MKQPIMADGPRCKRRKQANPRRKNVVNYDNVVDTGSETDEEDKLHIAEDDGIANPLDQETSPA

SEQ ID NO: 98919 - protein, 91 aa, Homo sapiens
  Payload ID: 19743
  Gene Name: zinc finger E-box binding homeobox 2
  ENSP ID: ENSP00000400993
MKQPIMADGPRCKRRKQANPRRKNVVNYDNVVDTGSETDEEDKLHIAEDDGIANPLDQETSPASVPNHESSPHVSQALLPREEEEDEIREG

SEQ ID NO: 98920 - protein, 1190 aa, Homo sapiens
  Payload ID: 19743
  Gene Name: zinc finger E-box binding homeobox 2
  Uniprot ID: O60315
  ENSP ID: ENSP00000443792
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKAVLQPHENIVPNKAGVFVDNKALLLSSVLSEKGMTSPINPYKDHMSVLKAYYAMNMEPNSDELLKISIAVGLPQEFVKEWFEQRKVYQYSNSRSPSLERSSKPLAPNSNPPTKDSLLPRSPVKPMDSITSPSIAELHNSVTNCDPPLRLTKPSHFTNIKPVEKLDHSRSNTPSPLNLSSTSSKNSHSSSYTPNSFSSEELQAEPLDLSLPKQMKEPKSIIATKNKTKASSISLDHNSVSSSSENSDEPLNLTFIKKEFSNSNNLDNKSTNPVFSMNPFSAKPLYTALPPQSAFPPATFMPPVQTSIPGLRPYPGLDQMSFLPHMAYTYPTGAATFADMQQRRKYQRKQGFQGELLDGAQDYMSGLDDMTDSDSCLSRKKIKKTESGMYACDLCDKTFQKSSSLLRHKYEHTGKRPHQCQICKKAFKHKHHLIEHSRLHSGEKPYQCDKCGKRFSHSGSYSQHMNHRYSYCKREAEEREAAEREAREKGHLEPTELLMNRAYLQSITPQGYSDSEERESMPRDGESEKEHEKEGEDGYGKLGRQDGDEEFEEEEEESENKSMDTDPETIRDEEETGDHSMDDSSEDGKMETKSDHEEDNMEDGM

SEQ ID NO: 98921 - protein, 1214 aa, Homo sapiens; identical to SEQ ID NO: 98914
  Payload ID: 19743
  Gene Name: zinc finger E-box binding homeobox 2
  Uniprot ID: O60315
  ENSP ID: ENSP00000454157

SEQ ID NO: 98922 - protein, 184 aa, Homo sapiens
  Payload ID: 19743
  Gene Name: zinc finger E-box binding homeobox 2
  ENSP ID: ENSP00000475267
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPVKNANCTSDFEEYFAKRKLEERDGHAVSIEEYLQRSDTAIIYPEAPEELSRLGTPEANGQEENDLPPGTPDAFA

SEQ ID NO: 98923 - protein, 87 aa, Homo sapiens
  Payload ID: 19743
  Gene Name: zinc finger E-box binding homeobox 2
  ENSP ID: ENSP00000475329
MTHFEDIEPACCRSRAPSPCELPSDPLLSMKQPIMADGPRCKRRKQANPRRKNALESEMSTRSGRCPAAACHRCGPFVTCKVCCFCP

SEQ ID NO: 98924 - protein, 58 aa, Homo sapiens
  Payload ID: 19743
  Gene Name: zinc finger E-box binding homeobox 2
  ENSP ID: ENSP00000475400
MKQPIMADGPRCKRRKQANPRRKNALESEMSTRSGRCPAAACHRCGPFVTCKVCCFCP

SEQ ID NO: 98925 - protein, 58 aa, Homo sapiens; identical to SEQ ID NO: 98924
  Payload ID: 19743
  Gene Name: zinc finger E-box binding homeobox 2
  ENSP ID: ENSP00000475502

SEQ ID NO: 98926 - protein, 423 aa, Homo sapiens
  Payload ID: 19743
  Gene Name: zinc finger E-box binding homeobox 2
  ENSP ID: ENSP00000475553
MADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKNSRRQWLMPVIPALWEANEGGSGQEFETSLANMVKHHLS

SEQ ID NO: 98927 - protein, 58 aa, Homo sapiens; identical to SEQ ID NO: 98924
  Payload ID: 19743
  Gene Name: zinc finger E-box binding homeobox 2
  ENSP ID: ENSP00000486240

SEQ ID NO: 98928 - protein, 41 aa, Homo sapiens
  Payload ID: 19743
  Gene Name: zinc finger E-box binding homeobox 2
  ENSP ID: ENSP00000486341
MKQPIMADGPRCKRRKQANPRRKNAKTNHLNREINSTSVQH

SEQ ID NO: 98929 - protein, 39 aa, Homo sapiens
  Payload ID: 19743
  Gene Name: zinc finger E-box binding homeobox 2
  ENSP ID: ENSP00000486346
MKQPIMADGPRCKRRKQANPRRKNVVNYDNVVDTGSETD

SEQ ID NO: 98930 - protein, 1214 aa, Homo sapiens; identical to SEQ ID NO: 98914
  Payload ID: 19743
  Gene Name: zinc finger E-box binding homeobox 2
  Uniprot ID: O60315
  ENSP ID: ENSP00000487174

SEQ ID NO: 98931 - protein, 41 aa, Homo sapiens
  Payload ID: 19743
  Gene Name: zinc finger E-box binding homeobox 2
  ENSP ID: ENSP00000487261
MKQPIMADGPRCKRRKQANPRRKNGSSRLSEKAWTTCLSQH

SEQ ID NO: 98932 - protein, 141 aa, Homo sapiens
  Payload ID: 19743
  Gene Name: zinc finger E-box binding homeobox 2
  ENSP ID: ENSP00000487476
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCT

SEQ ID NO: 98933 - protein, 281 aa, Homo sapiens
  Payload ID: 19744
  Gene Name: zinc finger family member 783
  Uniprot ID: Q6ZMS7
  ENSP ID: ENSP00000367291
MAEAAPARDPETDKHTEDQSPSTPLPQPAAEKNSYLYSTEITLWTVVAAIQALEKKVDSCLTRLLTLEGRTGTAEKKLADCEKTAVEFGNQLEGKWAVLGTLLQEYGLLQRRLENVENLLRNRNFWILRLPPGSKGEAPKVPVTFDDVAVYFSELEWGKLEDWQKELYKHVMRGNYETLVSLDYAISKPDILTRIERGEEPCLDRWGQEKGNEVEVGRPRMMGTGLPPYPEHLTSPLSPAQEELKEGQAPKQQQDSEARVAPAGPEAGLALRTDLQGEAQI

SEQ ID NO: 98934 - protein, 546 aa, Homo sapiens
  Payload ID: 19744
  Gene Name: zinc finger family member 783
  Uniprot ID: Q6ZMS7
  ENSP ID: ENSP00000410890
MAEAAPARDPETDKHTEDQSPSTPLPQPAAEKNSYLYSTEITLWTVVAAIQALEKKVDSCLTRLLTLEGRTGTAEKKLADCEKTAVEFGNQLEGKWAVLGTLLQEYGLLQRRLENVENLLRNRNFWILRLPPGSKGEAPKVPVTFDDVAVYFSELEWGKLEDWQKELYKHVMRGNYETLVSLDYAISKPDILTRIERGEEPCLDRWGQEKGNEVEVGRPRMMGTGLPPYPEHLTSPLSPAQEELKEGQAPKQQQDSEARVAPAGPEAGGGVAIKTEAQSEDEMTPERLFLGVSRGQTECRIPRGPRNRPGGPSRHQAQGMPRVRAGEPRPPGASGETPRVLSRRRQRAFPCPDCGQSFRLKINLTIHQRTHVEEGRQEAPGRSPTSCGDSQAMLEPGEVVVPGPVIRWLPEEPEGRRSVAGGRALVGRRPAASKMYHCSECLRFFQQRKSLLLHQRLHTGNGQGWPACPYCGKAFRRPSDLFRHQRIHTGERPYQCPQCGRTFNRNHHLAVHMQTHARGQVGPHFPAAPARHGSLPLPWPSRKEEG

SEQ ID NO: 98935 - protein, 281 aa, Homo sapiens; identical to SEQ ID NO: 98933
  Payload ID: 19744
  Gene Name: zinc finger family member 783
  Uniprot ID: Q6ZMS7
  ENSP ID: ENSP00000418666

SEQ ID NO: 98936 - protein, 248 aa, Homo sapiens
  Payload ID: 19744
  Gene Name: zinc finger family member 783
  ENSP ID: ENSP00000419521
MEPQAAWLQSLEGCMWTAKKKLADCEKVAVEFGNQLETPESQSRKHVEIISSALCLQAGRRPGHHQARSGTSGERRQAGNCSLPSAERGQSPGTGESLRVWAWASPPASGPWLMVEPAWCVAARSGWCLQSGCVRRASCMTETQASWNVPRRSVLDQARGRGKWEEPAGPTGDHCGTPVLRQHGAGRCRGSLMHETQIPLRREKTNTDTVHGGKGHFHVCSQRALSESDPKDGQYSKKKHICLRCANS

SEQ ID NO: 98937 - protein, 259 aa, Homo sapiens
  Payload ID: 19745
  Gene Name: zinc finger family member 788
  ENSP ID: ENSP00000380866
RSHTREKRYKCKQCGKPFIYFNAFQRHQRSHTGENPYECKQCGKACISSTAFQCRELSHTGAKRYKCKQCGKGFNLPSSIRYHEMTHTGEKPYECKQCGRAFRSASHLRTHERTHIGEKPYECKQCGKVYRYWSGLRIHGLTHIGKKPYECKECGKAFDNPTSFQKHEGSHRKGKSYECKECGKVFSFSRSFRRHGRMHTGEKPYECKNCGKAFTSAKSLQNHGRTHTGEKPCECKQCGKAFICSSSCQRHEETHSVNM

SEQ ID NO: 98938 - protein, 62 aa, Homo sapiens
  Payload ID: 19745
  Gene Name: zinc finger family member 788
  ENSP ID: ENSP00000391703
MDSVAFEDVAVNFTPDEWALLDPSQKNLYREVMQETLRNLASIEVLWKRDSLKVKVISMEKF

SEQ ID NO: 98939 - protein, 82 aa, Homo sapiens
  Payload ID: 19745
  Gene Name: zinc finger family member 788
  ENSP ID: ENSP00000473243
MRNMIPQDNENPPQQGEANQNDSVAFEDVAVNFTPDEWALLDPSQKNLYREVMQETLRNLASIEVLWKRDSLKVKVISMEKF

SEQ ID NO: 98940 - protein, 361 aa, Homo sapiens
  Payload ID: 19746
  Gene Name: zinc finger homeobox 2
  ENSP ID: ENSP00000409464
MATLNSASTTGTTPSPGHNAPSLPSDTFSSSTPSDPVTKDPPAASSTSENMRSSEPGGQLLESGCGLVPPKEIGEPQEGPDCGHFPPNDPGVEKDKEQEEEEEGLPPMDLSNHLFFTAGGEAYLVAKLSLPGGSELLLPKGFPWGEAGIKEEPSLPFLAYPPPSHLTALHIQHGFDPIQGFSSSDQILSHDTSAPSPAACEERHGAFWSYQLAPNPPGDPKDGPMGNSGGNHVAVFWLCLLCRLGFSKPQAFMDHTQSHGVKLTPAQYQGLSGSPAVLQEGDEGCKALISFLEPKLPARPSSDIPLDNSSTVNMEANVAQTEDGPPEAEVQALILLDEEVMALSPPSPPTATWDPSPTQAK

SEQ ID NO: 98941 - protein, 2572 aa, Homo sapiens
  Payload ID: 19746
  Gene Name: zinc finger homeobox 2
  Uniprot ID: Q9C0A1
  ENSP ID: ENSP00000413418
MATLNSASTTGTTPSPGHNAPSLPSDTFSSSTPSDPVTKDPPAASSTSENMRSSEPGGQLLESGCGLVPPKEIGEPQEGPDCGHFPPNDPGVEKDKEQEEEEEGLPPMDLSNHLFFTAGGEAYLVAKLSLPGGSELLLPKGFPWGEAGIKEEPSLPFLAYPPPSHLTALHIQHGFDPIQGFSSSDQILSHDTSAPSPAACEERHGAFWSYQLAPNPPGDPKDGPMGNSGGNHVAVFWLCLLCRLGFSKPQAFMDHTQSHGVKLTPAQYQGLSGSPAVLQEGDEGCKALISFLEPKLPARPSSDIPLDNSSTVNMEANVAQTEDGPPEAEVQALILLDEEVMALSPPSPPTATWDPSPTQAKESPVAAGEAGPDWFPEGQEEDGGLCPPLNQSSPTSKEGGTLPAPVGSPEDPSDPPQPYRLADDYTPAPAAFQGLSLSSHMSLLHSRNSCKTLKCPKCNWHYKYQQTLDVHMREKHPESNSHCSYCSAGGAHPRLARGESYNCGYKPYRCDVCNYSTTTKGNLSIHMQSDKHLANLQGFQAGPGGQGSPPEASLPPSAGDKEPKTKSSWQCKVCSYETNISRNLRIHMTSEKHMQNVLMLHQGLPLGLPPGLMGPGPPPPPGATPTSPPELFQYFGPQALGQPQTPLAGPGLRPDKPLEAQLLLNGFHHVGAPARKFPTSAPGSLSPDAHLPPSQLLGSSSDSLPTSPPPDDSLSLKVFRCLVCQAFSTDSLELLLYHCSIGRSLPEAEWKEVAGDTHRCKLCCYGTQLKANFQLHLKTDKHAQKYQLAAHLREGGGAMGTPSPASLGDGAPYGSVSPLHLRCNICDFESNSKEKMQLHARGAAHEENSQIYKFLLDMEGAEAGAELGLYHCLLCAWETPSRLAVLQHLRTPAHRDAQAQRRLQLLQNGPTTEEGLAALQSILSFSHGQLRTPGKAPVTPLAEPPTPEKDAQNKTEQLASEETENKTGPSRDSANQTTVYCCPYCSFLSPESSQVRAHTLSQHAVQPKYRCPLCQEQLVGRPALHFHLSHLHNVVPECVEKLLLVATTVEMTFTTKVLSAPTLSPLDNGQEPPTHGPEPTPSRDQAAEGPNLTPEASPDPLPEPPLASVEVPDKPSGSPGQPPSPAPSPVPEPDAQAEDVAPPPTMAEEEEGTTGELRSAEPAPADSRHPLTYRKTTNFALDKFLDPARPYKCTVCKESFTQKNILLVHYNSVSHLHKMKKAAIDPSAPARGEAGAPPTTTAATDKPFKCTVCRVSYNQSSTLEIHMRSVLHQTRSRGTKTDSKIEGPERSQEEPKEGETEGEVGTEKKGPDTSGFISGLPFLSPPPPPLDLHRFPAPLFTPPVLPPFPLVPESLLKLQQQQLLLPFYLHDLKVGPKLTLAGPAPVLSLPAATPPPPPQPPKAELAEREWERPPMAKEGNEAGPSSPPDPLPNEAARTAAKALLENFGFELVIQYNEGKQAVPPPPTPPPPEALGGGDKLACGACGKLFSNMLILKTHEEHVHRRFLPFEALSRYAAQFRKSYDSLYPPLAEPPKPPDGSLDSPVPHLGPPFLVPEPEAGGTRAPEERSRAGGHWPIEEEESSRGNLPPLVPAGRRFSRTKFTEFQTQALQSFFETSAYPKDGEVERLASLLGLASRVVVVWFQNARQKARKNACEGGSMPTGGGTGGASGCRRCHATFSCVFELVRHLKKCYDDQTLEEEEEEAERGEEEEEVEEEEVEEEQGLEPPAGPEGPLPEPPDGEELSQAEATKAGGKEPEEKATPSPSPAHTCDQCAISFSSQDLLTSHRRLHFLPSLQPSAPPQLLDLPLLVFGERNPLVAATSPMPGPPLKRKHEDGSLSPTGSEAGGGGEGEPPRDKRLRTTILPEQLEILYRWYMQDSNPTRKMLDCISEEVGLKKRVVQVWFQNTRARERKGQFRSTPGGVPSPAVKPPATATPASLPKFNLLLGKVDDGTGREAPKREAPAFPYPTATLASGPQPFLPPGKEATTPTPEPPLPLLPPPPPSEEEGPEEPPKASPESEACSLSAGDLSDSSASSLAEPESPGAGGTSGGPGGGTGVPDGMGQRRYRTQMSSLQLKIMKACYEAYRTPTMQECEVLGEEIGLPKRVIQVWFQNARAKEKKAKLQGTAAGSTGGSSEGLLAAQRTDCPYCDVKYDFYVSCRGHLFSRQHLAKLKEAVRAQLKSESKCYDLAPAPEAPPALKAPPATTPASMPLGAAPTLPRLAPVLLSGPALAQPPLGNLAPFNSGPAASSGLLGLATSVLPTTTVVQTAGPGRPLPQRPMPDQTNTSTAGTTDPVPGPPTEPLGDKVSSERKPVAGPTSSSNDALKNLKALKTTVPALLGGQFLPFPLPPAGGTAPPAVFGPQLQGAYFQQLYGMKKGLFPMNPMIPQTLIGLLPNALLQPPPQPPEPTATAPPKPPELPAPGEGEAGEVDELLTGSTGISTVDVTHRYLCRQCKMAFDGEAPATAHQRSFCFFGRGSGGSMPPPLRVPICTYHCLACEVLLSGREALASHLRSSAHRRKAAPPQGGPPISITNAATAASAAVAFAKEEARLPHTDSNPKTTTTSTLLAL

SEQ ID NO: 98942 - protein, 246 aa, Homo sapiens
  Payload ID: 19746
  Gene Name: zinc finger homeobox 2
  ENSP ID: ENSP00000451342
MATLNSASTTGTTPSPGHNAPSLPSDTFSSSTPSDPVTKDPPAASSTSENMRSSEPGGQLLESGCGLVPPKEIGEPQEGPDCGHFPPNDPGVEKDKEQEEEEEGLPPMDLSNHLFFTAGGEAYLVAKLSLPGGSELLLPKGFPWGEAGIKEEPSLPFLAYPPPSHLTALHIQHGFDPIQGFSSSDQILSHDTSAPSPAACEERHGAFWSYQLAPNPPGDPKDGPMGNSGGNHVAVFWLCLLCRLGF

SEQ ID NO: 98943 - protein, 408 aa, Homo sapiens
  Payload ID: 19746
  Gene Name: zinc finger homeobox 2
  ENSP ID: ENSP00000478696
MATLNSASTTGTTPSPGHNAPSLPSDTFSSSTPSDPVTKDPPAASSTSENMRSSEPGGQLLESGCGLVPPKEIGEPQEGPDCGHFPPNDPGVEKDKEQEEEEEGLPPMDLSNHLFFTAGGEAYLVAKLSLPGGSELLLPKGFPWGEAGIKEEPSLPFLAYPPPSHLTALHIQHGFDPIQGFSSSDQILSHDTSAPSPAACEERHGAFWSYQLAPNPPGDPKDGPMGNSGGNHVAVFWLCLLCRLGFSKPQAFMDHTQSHGVKLTPAQYQGLSGSPAVLQEGDEGCKALISFLEPKLPARPSSDIPLDNSSTVNMEANVAQTEDGPPEAEVQALILLDEEVMALSPPSPPTATWGYTTACCVRGRHPPAWLCCNTCAHLPTAMPRPRGVCSCYRMAQPLRKDSQLFRAS

SEQ ID NO: 98944 - protein, 3703 aa, Homo sapiens
  Payload ID: 19747
  Gene Name: zinc finger homeobox 3
  Uniprot ID: Q15911
  ENSP ID: ENSP00000268489
MEGCDSPVVSGKDNGCGIPQHQQWTELNSTHLPDKPSSMEQSTGESHGPLDSLRAPFNERLAESTASAGPPSEPASKEVTCNECSASFASLQTYMEHHCPSARPPPPLREESASDTGEEGDEESDVENLAGEIVYQPDGSAYIVESLSQLTQGGGACGSGSGSGPLPSLFLNSLPGAGGKQGDPSCAAPVYPQIINTFHIASSFGKWFEGPDQAFPNTSALAGLSPVLHSFRVFDVRHKSNKDYLNSDGSAKSSCVSKDVPNNVDLSKFDGFVLYGKRKPILMCFLCKLSFGYVRSFVTHAVHDHRMTLSEDERKILSNKNISAIIQGIGKDKEPLVSFLEPKNKNFQHPLVSTANLIGPGHSFYGKFSGIRMEGEEALPAGSAAGPEQPQAGLLTPSTLLNLGGLTSSVLKTPITSVPLGPLASSPTKSSEGKDSGAAEGEKQEVGDGDCFSEKVEPAEEEAEEEEEEEEAEEEEEEEEEEEEEEEDEGCKGLFPSELDEELEDRPHEEPGAAAGSSSKKDLALSNQSISNSPLMPNVLQTLSRGTASTSSNSASSFVVFDGANRRNRLSFNSEGVRANVAEGGRRLDFADESANKDNATAPEPNESTEGDDGGFVPHHQHAGSLCELGVGECPSGSGVECPKCDTVLGSSRSLGGHMTMMHSRNSCKTLKCPKCNWHYKYQQTLEAHMKEKHPEPGGSCVYCKSGQPHPRLARGESYTCGYKPFRCEVCNYSTTTKGNLSIHMQSDKHLNNMQNLQNGGGEQVFSHTAGAAAAAVAAAAAAANISSSCGAPSPTKPKTKPTWRCEVCDYETNVARNLRIHMTSEKHMHNMMLLQQNMTQIQHNRHLGLGSLPSPAEAELYQYYLAQNMNLPNLKMDSAASDAQFMMSGFQLDPAGPMAAMTPALVGGEIPLDMRLGGGQLVSEELMNLGESFIQTNDPSLKLFQCAVCNKFTTDNLDMLGLHMNVERSLSEDEWKAVMGDSYQCKLCRYNTQLKANFQLHCKTDKHVQKYQLVAHIKEGGKANEWRLKCVAIGNPVHLKCNACDYYTNSLEKLRLHTVNSRHEASLKLYKHLQQHESGVEGESCYYHCVLCNYSTKAKLNLIQHVRSMKHQRSESLRKLQRLQKGLPEEDEDLGQIFTIRRCPSTDPEEAIEDVEGPSETAADPEELAKDQEGGASSSQAEKELTDSPATSKRISFPGSSESPLSSKRPKTAEEIKPEQMYQCPYCKYSNADVNRLRVHAMTQHSVQPMLRCPLCQDMLNNKIHLQLHLTHLHSVAPDCVEKLIMTVTTPEMVMPSSMFLPAAVPDRDGNSNLEEAGKQPETSEDLGKNILPSASTEQSGDLKPSPADPGSVREDSGFICWKKGCNQVFKTSAALQTHFNEVHAKRPQLPVSDRHVYKYRCNQCSLAFKTIEKLQLHSQYHVIRAATMCCLCQRSFRTFQALKKHLETSHLELSEADIQQLYGGLLANGDLLAMGDPTLAEDHTIIVEEDKEEESDLEDKQSPTGSDSGSVQEDSGSEPKRALPFRKGPNFTMEKFLDPSRPYKCTVCKESFTQKNILLVHYNSVSHLHKLKRALQESATGQPEPTSSPDNKPFKCNTCNVAYSQSSTLEIHMRSVLHQTKARAAKLEAASGSSNGTGNSSSISLSSSTPSPVSTSGSNTFTTSNPSSAGIAPSSNLLSQVPTESVGMPPLGNPIGANIASPSEPKEANRKKLADMIASRQQQQQQQQQQQQQQQQQQQAQTLAQAQAQVQAHLQQELQQQAALIQSQLFNPTLLPHFPMTTETLLQLQQQQHLLFPFYIPSAEFQLNPEVSLPVTSGALTLTGTGPGLLEDLKAQVQVPQQSHQQILPQQQQNQLSIAQSHSALLQPSQHPEKKNKLVIKEKEKESQRERDSAEGGEGNTGPKETLPDALKAKEKKELAPGGGSEPSMLPPRIASDARGNATKALLENFGFELVIQYNENKQKVQKKNGKTDQGENLEKLECDSCGKLFSNILILKSHQEHVHQNYFPFKQLERFAKQYRDHYDKLYPLRPQTPEPPPPPPPPPPPPLPAAPPQPASTPAIPASAPPITSPTIAPAQPSVPLTQLSMPMELPIFSPLMMQTMPLQTLPAQLPPQLGPVEPLPADLAQLYQHQLNPTLLQQQNKRPRTRITDDQLRVLRQYFDINNSPSEEQIKEMADKSGLPQKVIKHWFRNTLFKERQRNKDSPYNFSNPPITSLEELKIDSRPPSPEPPKQEYWGSKRSSRTRFTDYQLRVLQDFFDANAYPKDDEFEQLSNLLNLPTRVIVVWFQNARQKARKNYENQGEGKDGERRELTNDRYIRTSNLNYQCKKCSLVFQRIFDLIKHQKKLCYKDEDEEGQDDSQNEDSMDAMEILTPTSSSCSTPMPSQAYSAPAPSANNTASSAFLQLTAEAEELATFNSKTEAGDEKPKLAEAPSAQPNQTQEKQGQPKPELQQQEQPEQKTNTPQQKLPQLVSLPSLPQPPPQAPPPQCPLPQSSPSPSQLSHLPLKPLHTSTPQQLANLPPQLIPYQCDQCKLAFPSFEHWQEHQQLHFLSAQNQFIHPQFLDRSLDMPFMLFDPSNPLLASQLLSGAIPQIPASSATSPSTPTSTMNTLKRKLEEKASASPGENDSGTGGEEPQRDKRLRTTITPEQLEILYQKYLLDSNPTRKMLDHIAHEVGLKKRVVQVWFQNTRARERKGQFRAVGPAQAHRRCPFCRALFKAKTALEAHIRSRHWHEAKRAGYNLTLSAMLLDCDGGLQMKGDIFDGTSFSHLPPSSSDGQGVPLSPVSKTMELSPRTLLSPSSIKVEGIEDFESPSMSSVNLNFDQTKLDNDDCSSVNTAITDTTTGDEGNADNDSATGIATETKSSSAPNEGLTKAAMMAMSEYEDRLSSGLVSPAPSFYSKEYDNEGTVDYSETSSLADPCSPSPGASGSAGKSGDSGDRPGQKRFRTQMTNLQLKVLKSCFNDYRTPTMLECEVLGNDIGLPKRVVQVWFQNARAKEKKSKLSMAKHFGINQTSYEGPKTECTLCGIKYSARLSVRDHIFSQQHISKVKDTIGSQLDKEKEYFDPATVRQLMAQQELDRIKKANEVLGLAAQQQGMFDNTPLQALNLPTAYPALQGIPPVLLPGLNSPSLPGFTPSNTALTSPKPNLMGLPSTTVPSPGLPTSGLPNKPSSASLSSPTPAQATMAMGPQQPPQQQQQQQQPQVQQPPPPPAAQPPPTPQLPLQQQQQRKDKDSEKVKEKEKAHKGKGEPLPVPKKEKGEAPTATAATISAPLPTMEYAVDPAQLQALQAALTSDPTALLTSQFLPYFVPGFSPYYAPQIPGALQSGYLQPMYGMEGLFPYSPALSQALMGLSPGSLLQQYQQYQQSLQEAIQQQQQRQLQQQQQQKVQQQQPKASQTPVPPGAPSPDKDPAKESPKPEEQKNTPREVSPLLPKLPEEPEAESKSADSLYDPFIVPKVQYKLVCRKCQAGFSDEEAARSHLKSLCFFGQSVVNLQEMVLHVPTGGGGGGSGGGGGGGGGGGGGGSYHCLACESALCGEEALSQHLESALHKHRTITRAARNAKEHPSLLPHSACFPDPSTASTSQSAAHSNDSPPPPSAAAPSSASPHASRKSWPQVVSRASAAKPPSFPPLSSSSTVTSSSCSTSGVQPSMPTDDYSEESDTDLSQKSDGPASPVEGPKDPSCPKDSGLTSVGTDTFRL

SEQ ID NO: 98945 - protein, 2789 aa, Homo sapiens
  Payload ID: 19747
  Gene Name: zinc finger homeobox 3
  Uniprot ID: Q15911
  ENSP ID: ENSP00000438926
MRLGGGQLVSEELMNLGESFIQTNDPSLKLFQCAVCNKFTTDNLDMLGLHMNVERSLSEDEWKAVMGDSYQCKLCRYNTQLKANFQLHCKTDKHVQKYQLVAHIKEGGKANEWRLKCVAIGNPVHLKCNACDYYTNSLEKLRLHTVNSRHEASLKLYKHLQQHESGVEGESCYYHCVLCNYSTKAKLNLIQHVRSMKHQRSESLRKLQRLQKGLPEEDEDLGQIFTIRRCPSTDPEEAIEDVEGPSETAADPEELAKDQEGGASSSQAEKELTDSPATSKRISFPGSSESPLSSKRPKTAEEIKPEQMYQCPYCKYSNADVNRLRVHAMTQHSVQPMLRCPLCQDMLNNKIHLQLHLTHLHSVAPDCVEKLIMTVTTPEMVMPSSMFLPAAVPDRDGNSNLEEAGKQPETSEDLGKNILPSASTEQSGDLKPSPADPGSVREDSGFICWKKGCNQVFKTSAALQTHFNEVHAKRPQLPVSDRHVYKYRCNQCSLAFKTIEKLQLHSQYHVIRAATMCCLCQRSFRTFQALKKHLETSHLELSEADIQQLYGGLLANGDLLAMGDPTLAEDHTIIVEEDKEEESDLEDKQSPTGSDSGSVQEDSGSEPKRALPFRKGPNFTMEKFLDPSRPYKCTVCKESFTQKNILLVHYNSVSHLHKLKRALQESATGQPEPTSSPDNKPFKCNTCNVAYSQSSTLEIHMRSVLHQTKARAAKLEAASGSSNGTGNSSSISLSSSTPSPVSTSGSNTFTTSNPSSAGIAPSSNLLSQVPTESVGMPPLGNPIGANIASPSEPKEANRKKLADMIASRQQQQQQQQQQQQQQQQQQQAQTLAQAQAQVQAHLQQELQQQAALIQSQLFNPTLLPHFPMTTETLLQLQQQQHLLFPFYIPSAEFQLNPEVSLPVTSGALTLTGTGPGLLEDLKAQVQVPQQSHQQILPQQQQNQLSIAQSHSALLQPSQHPEKKNKLVIKEKEKESQRERDSAEGGEGNTGPKETLPDALKAKEKKELAPGGGSEPSMLPPRIASDARGNATKALLENFGFELVIQYNENKQKVQKKNGKTDQGENLEKLECDSCGKLFSNILILKSHQEHVHQNYFPFKQLERFAKQYRDHYDKLYPLRPQTPEPPPPPPPPPPPPLPAAPPQPASTPAIPASAPPITSPTIAPAQPSVPLTQLSMPMELPIFSPLMMQTMPLQTLPAQLPPQLGPVEPLPADLAQLYQHQLNPTLLQQQNKRPRTRITDDQLRVLRQYFDINNSPSEEQIKEMADKSGLPQKVIKHWFRNTLFKERQRNKDSPYNFSNPPITSLEELKIDSRPPSPEPPKQEYWGSKRSSRTRFTDYQLRVLQDFFDANAYPKDDEFEQLSNLLNLPTRVIVVWFQNARQKARKNYENQGEGKDGERRELTNDRYIRTSNLNYQCKKCSLVFQRIFDLIKHQKKLCYKDEDEEGQDDSQNEDSMDAMEILTPTSSSCSTPMPSQAYSAPAPSANNTASSAFLQLTAEAEELATFNSKTEAGDEKPKLAEAPSAQPNQTQEKQGQPKPELQQQEQPEQKTNTPQQKLPQLVSLPSLPQPPPQAPPPQCPLPQSSPSPSQLSHLPLKPLHTSTPQQLANLPPQLIPYQCDQCKLAFPSFEHWQEHQQLHFLSAQNQFIHPQFLDRSLDMPFMLFDPSNPLLASQLLSGAIPQIPASSATSPSTPTSTMNTLKRKLEEKASASPGENDSGTGGEEPQRDKRLRTTITPEQLEILYQKYLLDSNPTRKMLDHIAHEVGLKKRVVQVWFQNTRARERKGQFRAVGPAQAHRRCPFCRALFKAKTALEAHIRSRHWHEAKRAGYNLTLSAMLLDCDGGLQMKGDIFDGTSFSHLPPSSSDGQGVPLSPVSKTMELSPRTLLSPSSIKVEGIEDFESPSMSSVNLNFDQTKLDNDDCSSVNTAITDTTTGDEGNADNDSATGIATETKSSSAPNEGLTKAAMMAMSEYEDRLSSGLVSPAPSFYSKEYDNEGTVDYSETSSLADPCSPSPGASGSAGKSGDSGDRPGQKRFRTQMTNLQLKVLKSCFNDYRTPTMLECEVLGNDIGLPKRVVQVWFQNARAKEKKSKLSMAKHFGINQTSYEGPKTECTLCGIKYSARLSVRDHIFSQQHISKVKDTIGSQLDKEKEYFDPATVRQLMAQQELDRIKKANEVLGLAAQQQGMFDNTPLQALNLPTAYPALQGIPPVLLPGLNSPSLPGFTPSNTALTSPKPNLMGLPSTTVPSPGLPTSGLPNKPSSASLSSPTPAQATMAMGPQQPPQQQQQQQQPQVQQPPPPPAAQPPPTPQLPLQQQQQRKDKDSEKVKEKEKAHKGKGEPLPVPKKEKGEAPTATAATISAPLPTMEYAVDPAQLQALQAALTSDPTALLTSQFLPYFVPGFSPYYAPQIPGALQSGYLQPMYGMEGLFPYSPALSQALMGLSPGSLLQQYQQYQQSLQEAIQQQQQRQLQQQQQQKVQQQQPKASQTPVPPGAPSPDKDPAKESPKPEEQKNTPREVSPLLPKLPEEPEAESKSADSLYDPFIVPKVQYKLVCRKCQAGFSDEEAARSHLKSLCFFGQSVVNLQEMVLHVPTGGGGGGSGGGGGGGGGGGGGGSYHCLACESALCGEEALSQHLESALHKHRTITRAARNAKEHPSLLPHSACFPDPSTASTSQSAAHSNDSPPPPSAAAPSSASPHASRKSWPQVVSRASAAKPPSFPPLSSSSTVTSSSCSTSGVQPSMPTDDYSEESDTDLSQKSDGPASPVEGPKDPSCPKDSGLTSVGTDTFRL

SEQ ID NO: 98946 - protein, 140 aa, Homo sapiens
  Payload ID: 19748
  Gene Name: zinc finger homeobox 4
  ENSP ID: ENSP00000427739
METCDSPPISRQENGQSTSKLCGTTQLDNEVPEKVAGMEPDRENSSTDDNLKTDERKSEALLGFSVENAAATQVTSAKEIPCNECATSFPSLQKYMEHHCPNARLPVLKDDNESEISELEDSDVENLTGEIVYQPDGSAY

SEQ ID NO: 98947 - protein, 155 aa, Homo sapiens
  Payload ID: 19748
  Gene Name: zinc finger homeobox 4
  ENSP ID: ENSP00000427775
METCDSPPISRQENGQSTSKLCGTTQLDNEVPEKVAGMEPDRENSSTDDNLKTDERKSEALLGFSVENAAATQVTSAKEIPCNECATSFPSLQKYMEHHCPNARLPVLKDDNESEISELEDSDVENLTGEIVYQPDGSAYIIEDSKESGQNAQTG

SEQ ID NO: 98948 - protein, 155 aa, Homo sapiens; identical to SEQ ID NO: 98947
  Payload ID: 19748
  Gene Name: zinc finger homeobox 4
  ENSP ID: ENSP00000428525

SEQ ID NO: 98949 - protein, 101 aa, Homo sapiens
  Payload ID: 19748
  Gene Name: zinc finger homeobox 4
  ENSP ID: ENSP00000429495
METCDSPPISRQENGQSTSKLCGTTQLDNEVPEKVAGMEPDRENSSTDDNLKTDERKSEALLGFSVENAAATQVTSAKEIPCNECATSFPSLQKYMEHHCP

SEQ ID NO: 98950 - protein, 86 aa, Homo sapiens
  Payload ID: 19748
  Gene Name: zinc finger homeobox 4
  ENSP ID: ENSP00000430375
  MOD_RES (1)..(1): Any amino acid
XKLNLVQHVRSVKHQQTEGLRKLQLHQQGLAPEEDNLSEIFFVKDCPPNELASSCQIFWSACNFLCTEPNRLISSRRNCLIGSQDL

SEQ ID NO: 98951 - protein, 3616 aa, Homo sapiens
  Payload ID: 19748
  Gene Name: zinc finger homeobox 4
  Uniprot ID: Q86UP3
  ENSP ID: ENSP00000430497
METCDSPPISRQENGQSTSKLCGTTQLDNEVPEKVAGMEPDRENSSTDDNLKTDERKSEALLGFSVENAAATQVTSAKEIPCNECATSFPSLQKYMEHHCPNARLPVLKDDNESEISELEDSDVENLTGEIVYQPDGSAYIIEDSKESGQNAQTGANSKLFSTAMFLDSLASAGEKSDQSASAPMSFYPQIINTFHIASSLGKPFTADQAFPNTSALAGVGPVLHSFRVYDLRHKREKDYLTSDGSAKNSCVSKDVPNNVDLSKFDGCVSDGKRKPVLMCFLCKLSFGYIRSFVTHAVHDHRMTLNDEEQKLLSNKCVSAIIQGIGKDKEPLISFLEPKKSTSVYPHFSTTNLIGPDPTFRGLWSAFHVENGDSLPAGFAFLKGSASTSSSAEQPLGITQMPKAEVNLGGLSSLVVNTPITSVSLSHSSSESSKMSESKDQENNCERPKESNVLHPNGECPVKSEPTEPGDEDEEDAYSNELDDEEVLGELTDSIGNKDFPLLNQSISPLSSSVLKFIEKGTSSSSATVSDDTEKKKQTAAVRASGSVASNYGISGKDFADASASKDSATAAHPSEIARGDEDSSATPHQHGFTPSTPGTPGPGGDGSPGSGIECPKCDTVLGSSRSLGGHMTMMHSRNSCKTLKCPKCNWHYKYQQTLEAHMKEKHPEPGGSCVYCKTGQPHPRLARGESYTCGYKPFRCEVCNYSTTTKGNLSIHMQSDKHLNNVQNLQNGNGEQVFGHSAPAPNTSLSGCGTPSPSKPKQKPTWRCEVCDYETNVARNLRIHMTSEKHMHNMMLLQQNMKQIQHNLHLGLAPAEAELYQYYLAQNIGLTGMKLENPADPQLMINPFQLDPATAAALAPGLVNNELPPEIRLASGQLMGDDLSLLTAGELSPYISDPALKLFQCAVCNKFTSDSLEALSVHVSSERSLPEEEWRAVIGDIYQCKLCNYNTQLKANFQLHCKTDKHMQKYQLVAHIKEGGKSNEWRLKCIAIGNPVHLKCNACDYYTNSVDKLRLHTTNHRHEAALKLYKHLQKQEGAVNPESCYYYCAVCDYTTKVKLNLVQHVRSVKHQQTEGLRKLQLHQQGLAPEEDNLSEIFFVKDCPPNELETASLGARTCDDDLTEQQLRSTSEEQSEEAEGAIKPTAVAEDDEKDTSERDNSEGKNSNKDSGIITPEKELKVSVAGGTQPLLLAKEEDVATKRSKPTEDNKFCHEQFYQCPYCNYNSRDQSRIQMHVLSQHSVQPVICCPLCQDVLSNKMHLQLHLTHLHSVSPDCVEKLLMTVPVPDVMMPNSMLLPAAASEKSERDTPAAVTAEGSGKYSGESPMDDKSMAGLEDSKANVEVKNEEQKPTKEPLEVSEWNKNSSKDVKIPDTLQDQLNEQQKRQPLSVSDRHVYKYRCNHCSLAFKTMQKLQIHSQYHAIRAATMCNLCQRSFRTFQALKKHLEAGHPELSEAELQQLYASLPVNGELWAESETMSQDDHGLEQEMEREYEVDHEGKASPVGSDSSSIPDDMGSEPKRTLPFRKGPNFTMEKFLDPSRPYKCTVCKESFTQKNILLVHYNSVSHLHKLKKVLQEASSPVPQETNSNTDNKPYKCSICNVAYSQSSTLEIHMRSVLHQTKARAAKLEPSGHVAGGHSIAANVNSPGQGMLDSMSLAAVNSKDTHLDAKELNKKQTPDLISAQPAHHPPQSPAQIQMQLQHELQQQAAFFQPQFLNPAFLPHFPMTPEALLQFQQPQFLFPFYIPGTEFSLGPDLGLPGSATFGMPGMTGMAGSLLEDLKQQIQTQHHVGQTQLQILQQQAQQYQATQPQLQPQKQQQQPPPPQQQQQQQASKLLKQEQSNIVSADCQIMKDVPSYKEAEDISEKPEKPKQEFISEGEGLKEGKDTKKQKSLEPSIPPPRIASGARGNAAKALLENFGFELVIQYNENRQKVQKKGKSGEGENTDKLECGTCGKLFSNVLILKSHQEHVHGQFFPYAALEKFARQYREAYDKLYPISPSSPETPPPPPPPPPLPPAPPQPSSMGPVKIPNTVSTPLQAPPPTPPPPPPPPPPPPPPPPPPPPSAPPQVQLPVSLDLPLFPSIMMQPVQHPALPPQLALQLPQMDALSADLTQLCQQQLGLDPNFLRHSQFKRPRTRITDDQLKILRAYFDINNSPSEEQIQEMAEKSGLSQKVIKHWFRNTLFKERQRNKDSPYNFSNPPITVLEDIRIDPQPTSLEHYKSDASFSKRSSRTRFTDYQLRVLQDFFDTNAYPKDDEIEQLSTVLNLPTRVIVVWFQNARQKARKSYENQAETKDNEKRELTNERYIRTSNMQYQCKKCNVVFPRIFDLITHQKKQCYKDEDDDAQDESQTEDSMDATDQVVYKHCTVSGQTDAAKNAAAPAASSGSGTSTPLIPSPKPEPEKTSPKPEYPAEKPKQSDPSPPSQGTKPALPLASTSSDPPQASTAQPQPQPQPPKQPQLIGRPPSASQTPVPSSPLQISMTSLQNSLPPQLLQYQCDQCTVAFPTLELWQEHQHMHFLAAQNQFLHSPFLERPMDMPYMIFDPNNPLMTGQLLGSSLTQMPPQASSSHTTAPTTVAASLKRKLDDKEDNNCSEKEGGNSGEDQHRDKRLRTTITPEQLEILYEKYLLDSNPTRKMLDHIAREVGLKKRVVQVWFQNTRARERKGQFRAVGPAQSHKRCPFCRALFKAKSALESHIRSRHWNEGKQAGYSLPPSPLISTEDGGESPQKYIYFDYPSLPLTKIDLSSENELASTVSTPVSKTAELSPKNLLSPSSFKAECSEDVENLNAPPAEAGYDQNKTDFDETSSINTAISDATTGDEGNTEMESTTGSSGDVKPALSPKEPKTLDTLPKPATTPTTEVCDDKFLFSLTSPSIHFNDKDGDHDQSFYITDDPDDNADRSETSSIADPSSPNPFGSSNPFKSKSNDRPGHKRFRTQMSNLQLKVLKACFSDYRTPTMQECEMLGNEIGLPKRVVQVWFQNARAKEKKFKINIGKPFMINQGGTEGTKPECTLCGVKYSARLSIRDHIFSKQHISKVRETVGSQLDREKDYLAPTTVRQLMAQQELDRIKKASDVLGLTVQQPGMMDSSSLHGISLPTAYPGLPGLPPVLLPGMNGPSSLPGFPQNSNTLTPPGAGMLGFPTSATSSPALSLSSAPTKPLLQTPPPPPPPPPPPPSSSLSGQQTEQQNKESEKKQTKPNKVKKIKEEELEATKPEKHPKKEEKISSALSVLGKVVGETHVDPIQLQALQNAIAGDPASFIGGQFLPYFIPGFASYFTPQLPGTVQGGYFPPVCGMESLFPYGPTMPQTLAGLSPGALLQQYQQYQQNLQESLQKQQKQQQEQQQKPVQAKTSKVESDQPQNSNDASETKEDKSTATESTKEEPQLESKSADFSDTYVVPFVKYEFICRKCQMMFTDEDAAVNHQKSFCYFGQPLIDPQETVLRVPVSKYQCLACDVAISGNEALSQHLQSSLHKEKTIKQAMRNAKEHVRLLPHSVCSPNPNTTSTSQSAASSNNTYPHLSCFSMKSWPNILFQASARRAASPPSSPPSLSLPSTVTSSLCSTSGVQTSLPTESCSDESDSELSQKLEDLDNSLEVKAKPASGLDGNFNSIRMDMFSV

SEQ ID NO: 98952 - protein, 3590 aa, Homo sapiens
  Payload ID: 19748
  Gene Name: zinc finger homeobox 4
  ENSP ID: ENSP00000430848
METCDSPPISRQENGQSTSKLCGTTQLDNEVPEKVAGMEPDRENSSTDDNLKTDERKSEALLGFSVENAAATQVTSAKEIPCNECATSFPSLQKYMEHHCPNARLPVLKDDNESEISELEDSDVENLTGEIVYQPDGSAYIIEDSKESGQNAQTGANSKLFSTAMFLDSLASAGEKSDQSASAPMSFYPQIINTFHIASSLGKPFTADQAFPNTSALAGVGPVLHSFRVYDLRHKREKDYLTSDGSAKNSCVSKDVPNNVDLSKFDGCVSDGKRKPVLMCFLCKLSFGYIRSFVTHAVHDHRMTLNDEEQKLLSNKCVSAIIQGIGKDKEPLISFLEPKKSTSVYPHFSTTNLIGPDPTFRGLWSAFHVENGDSLPAGFAFLKGSASTSSSAEQPLGITQMPKAEVNLGGLSSLVVNTPITSVSLSHSSSESSKMSESKDQENNCERPKESNVLHPNGECPVKSEPTEPGDEDEEDAYSNELDDEEVLGELTDSIGNKDFPLLNQSISPLSSSVLKFIEKGTSSSSATVSDDTEKKKQTAAVRASGSVASNYGISGKDFADASASKDSATAAHPSEIARGDEDSSATPHQHGFTPSTPGTPGPGGDGSPGSGIECPKCDTVLGSSRSLGGHMTMMHSRNSCKTLKCPKCNWHYKYQQTLEAHMKEKHPEPGGSCVYCKTGQPHPRLARGESYTCGYKPFRCEVCNYSTTTKGNLSIHMQSDKHLNNVQNLQNGNGEQVFGHSAPAPNTSLSGCGTPSPSKPKQKPTWRCEVCDYETNVARNLRIHMTSEKHMHNMMLLQQNMKQIQHNLHLGLAPAEAELYQYYLAQNIGLTGMKLENPADPQLMINPFQLDPATAAALAPGLGELSPYISDPALKLFQCAVCNKFTSDSLEALSVHVSSERSLPEEEWRAVIGDIYQCKLCNYNTQLKANFQLHCKTDKHMQKYQLVAHIKEGGKSNEWRLKCIAIGNPVHLKCNACDYYTNSVDKLRLHTTNHRHEAALKLYKHLQKQEGAVNPESCYYYCAVCDYTTKVKLNLVQHVRSVKHQQTEGLRKLQLHQQGLAPEEDNLSEIFFVKDCPPNELETASLGARTCDDDLTEQQLRSTSEEQSEEAEGAIKPTAVAEDDEKDTSERDNSEGKNSNKDSGIITPEKELKVSVAGGTQPLLLAKEEDVATKRSKPTEDNKFCHEQFYQCPYCNYNSRDQSRIQMHVLSQHSVQPVICCPLCQDVLSNKMHLQLHLTHLHSVSPDCVEKLLMTVPVPDVMMPNSMLLPAAASEKSERDTPAAVTAEGSGKYSGESPMDDKSMAGLEDSKANVEVKNEEQKPTKEPLEVSEWNKNSSKDVKIPDTLQDQLNEQQKRQPLSVSDRHVYKYRCNHCSLAFKTMQKLQIHSQYHAIRAATMCNLCQRSFRTFQALKKHLEAGHPELSEAELQQLYASLPVNGELWAESETMSQDDHGLEQEMEREYEVDHEGKASPVGSDSSSIPDDMGSEPKRTLPFRKGPNFTMEKFLDPSRPYKCTVCKESFTQKNILLVHYNSVSHLHKLKKVLQEASSPVPQETNSNTDNKPYKCSICNVAYSQSSTLEIHMRSVLHQTKARAAKLEPSGHVAGGHSIAANVNSPGQGMLDSMSLAAVNSKDTHLDAKELNKKQTPDLISAQPAHHPPQSPAQIQMQLQHELQQQAAFFQPQFLNPAFLPHFPMTPEALLQFQQPQFLFPFYIPGTEFSLGPDLGLPGSATFGMPGMTGMAGSLLEDLKQQIQTQHHVGQTQLQILQQQAQQYQATQPQLQPQKQQQQPPPPQQQQQQQASKLLKQEQSNIVSADCQIMKDVPSYKEAEDISEKPEKPKQEFISEGEGLKEGKDTKKQKSLEPSIPPPRIASGARGNAAKALLENFGFELVIQYNENRQKVQKKGKSGEGENTDKLECGTCGKLFSNVLILKSHQEHVHGQFFPYAALEKFARQYREAYDKLYPISPSSPETPPPPPPPPPLPPAPPQPSSMGPVKIPNTVSTPLQAPPPTPPPPPPPPPPPPPPPPPPPPSAPPQVQLPVSLDLPLFPSIMMQPVQHPALPPQLALQLPQMDALSADLTQLCQQQLGLDPNFLRHSQFKRPRTRITDDQLKILRAYFDINNSPSEEQIQEMAEKSGLSQKVIKHWFRNTLFKERQRNKDSPYNFSNPPITVLEDIRIDPQPTSLEHYKSDASFSKRSSRTRFTDYQLRVLQDFFDTNAYPKDDEIEQLSTVLNLPTRVIVVWFQNARQKARKSYENQAETKDNEKRELTNERYIRTSNMQYQCKKCNVVFPRIFDLITHQKKQCYKDEDDDAQDESQTEDSMDATDQVVYKHCTVSGQTDAAKNAAAPAASSGSGTSTPLIPSPKPEPEKTSPKPEYPAEKPKQSDPSPPSQGTKPALPLASTSSDPPQASTAQPQPQPQPPKQPQLIGRPPSASQTPVPSSPLQISMTSLQNSLPPQLLQYQCDQCTVAFPTLELWQEHQHMHFLAAQNQFLHSPFLERPMDMPYMIFDPNNPLMTGQLLGSSLTQMPPQASSSHTTAPTTVAASLKRKLDDKEDNNCSEKEGGNSGEDQHRDKRLRTTITPEQLEILYEKYLLDSNPTRKMLDHIAREVGLKKRVVQVWFQNTRARERKGQFRAVGPAQSHKRCPFCRALFKAKSALESHIRSRHWNEGKQAGYSLPPSPLISTEDGGESPQKYIYFDYPSLPLTKIDLSSENELASTVSTPVSKTAELSPKNLLSPSSFKAECSEDVENLNAPPAEAGYDQNKTDFDETSSINTAISDATTGDEGNTEMESTTGSSGDVKPALSPKEPKTLDTLPKPATTPTTEVCDDKFLFSLTSPSIHFNDKDGDHDQSFYITDDPDDNADRSETSSIADPSSPNPFGSSNPFKSKSNDRPGHKRFRTQMSNLQLKVLKACFSDYRTPTMQECEMLGNEIGLPKRVVQVWFQNARAKEKKFKINIGKPFMINQGGTEGTKPECTLCGVKYSARLSIRDHIFSKQHISKVRETVGSQLDREKDYLAPTTVRQLMAQQELDRIKKASDVLGLTVQQPGMMDSSSLHGISLPTAYPGLPGLPPVLLPGMNGPSSLPGFPQNSNTLTPPGAGMLGFPTSATSSPALSLSSAPTKPLLQTPPPPPPPPPPPPSSSLSGQQTEQQNKESEKKQTKPNKVKKIKEEELEATKPEKHPKKEEKISSALSVLGKVVGETHVDPIQLQALQNAIAGDPASFIGGQFLPYFIPGFASYFTPQLPGTVQGGYFPPVCGMESLFPYGPTMPQTLAGLSPGALLQQYQQYQQNLQESLQKQQKQQQEQQQKPVQAKTSKVESDQPQNSNDASETKEDKSTATESTKEEPQLESKSADFSDTYVVPFVKYEFICRKCQMMFTDEDAAVNHQKSFCYFGQPLIDPQETVLRVPVSKYQCLACDVAISGNEALSQHLQSSLHKEKTIKQAMRNAKEHVRLLPHSVCSPNPNTTSTSQSAASSNNTYPHLSCFSMKSWPNILFQASARRAASPPSSPPSLSLPSTVTSSLCSTSGVQTSLPTESCSDESDSELSQKLEDLDNSLEVKAKPASGLDGNFNSIRMDMFSV

SEQ ID NO: 98953 - protein, 82 aa, Homo sapiens
  Payload ID: 19748
  Gene Name: zinc finger homeobox 4
  ENSP ID: ENSP00000431101
  MOD_RES (1)..(1): Any amino acid
XKVKLNLVQHVRSVKHQQTEGLRKLQLHQQGLAPEEDNLSEIFFVKDCPPNELETASLGARTCDDDLTEQQLRSTSAYLSTY

SEQ ID NO: 98954 - protein, 573 aa, Homo sapiens
  Payload ID: 19749
  Gene Name: zinc finger protein 10
  Uniprot ID: P21506
  ENSP ID: ENSP00000248211
MDAKSLTAWSRTLVTFKDVFVDFTREEWKLLDTAQQIVYRNVMLENYKNLVSLGYQLTKPDVILRLEKGEEPWLVEREIHQETHPDSETAFEIKSSVSSRSIFKDKQSCDIKMEGMARNDLWYLSLEEVWKCRDQLDKYQENPERHLRQVAFTQKKVLTQERVSESGKYGGNCLLPAQLVLREYFHKRDSHTKSLKHDLVLNGHQDSCASNSNECGQTFCQNIHLIQFARTHTGDKSYKCPDNDNSLTHGSSLGISKGIHREKPYECKECGKFFSWRSNLTRHQLIHTGEKPYECKECGKSFSRSSHLIGHQKTHTGEEPYECKECGKSFSWFSHLVTHQRTHTGDKLYTCNQCGKSFVHSSRLIRHQRTHTGEKPYECPECGKSFRQSTHLILHQRTHVRVRPYECNECGKSYSQRSHLVVHHRIHTGLKPFECKDCGKCFSRSSHLYSHQRTHTGEKPYECHDCGKSFSQSSALIVHQRIHTGEKPYECCQCGKAFIRKNDLIKHQRIHVGEETYKCNQCGIIFSQNSPFIVHQIAHTGEQFLTCNQCGTALVNTSNLIGYQTNHIRENAY

SEQ ID NO: 98955 - protein, 439 aa, Homo sapiens
  Payload ID: 19749
  Gene Name: zinc finger protein 10
  ENSP ID: ENSP00000384893
MDAKSLTAWSRTLVTFKDVFVDFTREEWKLLDTAQQIVYRNVMLENYKNLVSLGYQLTKPDVILRLEKGEEPWLVEREIHQETHPDSETAFEIKSSVSSRSIFKDKQSCDIKMEGMARNDLWYLSLEEVWKCRDQLDKYQENPERHLRHQLIHTGEKPYECKECGKSFSRSSHLIGHQKTHTGEEPYECKECGKSFSWFSHLVTHQRTHTGDKLYTCNQCGKSFVHSSRLIRHQRTHTGEKPYECPECGKSFRQSTHLILHQRTHVRVRPYECNECGKSYSQRSHLVVHHRIHTGLKPFECKDCGKCFSRSSHLYSHQRTHTGEKPYECHDCGKSFSQSSALIVHQRIHTGEKPYECCQCGKAFIRKNDLIKHQRIHVGEETYKCNQCGIIFSQNSPFIVHQIAHTGEQFLTCNQCGTALVNTSNLIGYQTNHIRENAY

SEQ ID NO: 98956 - protein, 573 aa, Homo sapiens; identical to SEQ ID NO: 98954
  Payload ID: 19749
  Gene Name: zinc finger protein 10
  Uniprot ID: P21506
  ENSP ID: ENSP00000393814

SEQ ID NO: 98957 - protein, 47 aa, Homo sapiens
  Payload ID: 19749
  Gene Name: zinc finger protein 10
  ENSP ID: ENSP00000438232
MDAKSLTAWSRTLVTFKDVFVDFTREEWKLLDTAQQIVYRNVMLENY

SEQ ID NO: 98958 - protein, 72 aa, Homo sapiens
  Payload ID: 19749
  Gene Name: zinc finger protein 10
  ENSP ID: ENSP00000441339
MDAKSLTAWSRTLVTFKDVFVDFTREEWKLLDTAQQIVYRNVMLENYKNLVSLGYQLTKPDVILRLEKGEEP

SEQ ID NO: 98959 - protein, 43 aa, Homo sapiens
  Payload ID: 19749
  Gene Name: zinc finger protein 10
  ENSP ID: ENSP00000445997
MDAKSLTAWSRTLVTFKDVFVDFTREEWKLLDTAQQIVYRNVM

SEQ ID NO: 98960 - protein, 542 aa, Homo sapiens
  Payload ID: 19750
  Gene Name: zinc finger protein 100
  Uniprot ID: Q8IYN0
  ENSP ID: ENSP00000351042
MDDPRYGMCPLKGASGCPGAERSLLVQSYFEKGPLTFRDVAIEFSLEEWQCLDSAQQGLYRKVMLENYRNLVFLAGIALTKPDLITCLEQGKEPWNIKRHEMVAKPPVICSHFPQDLWAEQDIKDSFQEAILKKYGKYGHDNLQLQKGCKSVDECKVHKEHDNKLNQCLITTQSNIFQCDPSAKVFHTFSNSNRHKIRHTRKKPFKCKKCEKSFCMLLHLTQHKRFHITENSYQCKDCGKAFNWFSTLTTHRRIHTGEKPYKCEECGKAFNRSSHLTTHKIIHTGEKPYRCEECGKAFNRSSHLTTHKRIHTGVKPYKCTECGKAFNRSSHLTTHRIIHTGEKPYKCEECGKAFNQSSTLTTHKITHAGEKPYKCEECGKAFYRFSYLTKHKTSHTGEKFYKCEECGKGFNWSSALTKHKRIHTGEKPYKCEECGKAFNESSNLTTHKMIHTGEKPYKCDECGKAFNRSSQLTAHKMIHTGEKPYKCEECGKAFNRSSTLTKHKITHTGEKSYKWEECGKDFNQSLSLIKQNNSYWRETLQM

SEQ ID NO: 98961 - protein, 478 aa, Homo sapiens
  Payload ID: 19750
  Gene Name: zinc finger protein 100
  ENSP ID: ENSP00000445201
MLENYRNLVFLGIALTKPDLITCLEQGKEPWNIKRHEMVAKPPVICSHFPQDLWAEQDIKDSFQEAILKKYGKYGHDNLQLQKGCKSVDECKVHKEHDNKLNQCLITTQSNIFQCDPSAKVFHTFSNSNRHKIRHTRKKPFKCKKCEKSFCMLLHLTQHKRFHITENSYQCKDCGKAFNWFSTLTTHRRIHTGEKPYKCEECGKAFNRSSHLTTHKIIHTGEKPYRCEECGKAFNRSSHLTTHKRIHTGVKPYKCTECGKAFNRSSHLTTHRIIHTGEKPYKCEECGKAFNQSSTLTTHKITHAGEKPYKCEECGKAFYRFSYLTKHKTSHTGEKFYKCEECGKGFNWSSALTKHKRIHTGEKPYKCEECGKAFNESSNLTTHKMIHTGEKPYKCDECGKAFNRSSQLTAHKMIHTGEKPYKCEECGKAFNRSSTLTKHKITHTGEKSYKWEECGKDFNQSLSLIKQNNSYWRETLQM

SEQ ID NO: 98962 - protein, 156 aa, Homo sapiens
  Payload ID: 19750
  Gene Name: zinc finger protein 100
  ENSP ID: ENSP00000471057
MDDPRYGMCPLKGASGCPGAERSLLVQSYFEKGPLTFRDVAIEFSLEEWQCLDSAQQGLYRKVMLENYRNLVFLAGIALTKPDLITCLEQGKEPWNIKRHEMVAKPPDGVSLCHQVGVQWRDLGSLQPPPPGFKQSSCLSLLSSCDYRHMPPRQAN

SEQ ID NO: 98963 - protein, 63 aa, Homo sapiens
  Payload ID: 19750
  Gene Name: zinc finger protein 100
  ENSP ID: ENSP00000471371
MLENYRNLVFLGIALTKPDLITCLEQGKEPWNIKRHEMVAKPPVICSHFPQDLWAEQDIKDSF

SEQ ID NO: 98964 - protein, 566 aa, Homo sapiens
  Payload ID: 19750
  Gene Name: zinc finger protein 100
  ENSP ID: ENSP00000476534
MVDPRYGMCPLKGASGCPGAERSLLVQSYFEKGPLTFRDVAIEFSLEEWQCLDSAQQGLYRKVMLENYRNLVFLGIALTKPDLITCLEQGKEPWNIKRHEMVAKPPVICSHFPQDLWAEQDIKDSFQEAILKKYGKYGHDNLQLQKGCKSVDECKVHKEHDNKLNQCLITTQSNIFQCDPSAKVFHTFSNSNRHKIRHTRKKPFKCKKCEKSFCMLLHLTQHKRFHITENSYQCKDCGKAFNWFSTLTTHRRIHTGEKPYKCEECGKAFNRSSHLTTHKIIHTGEKPYRCEECGKAFNRSSHLTTHKRIHTGVKPYKCTECGKAFNRSSHLTTHRIIHTGEKPYKCEECGKAFNQSSTLTTHKITHAGEKPYKCEECGKAFYRFSYLTKHKTSHTGEKFYKCEECGKGFNWSSALTKHKRIHTGEKPYKCEECGKAFNESSNLTTHKMIHTGEKPYKCDECGKAFNRSSQLTAHKMIHTGEKPYKCEECGKAFNRSSTLTKHKITHTGEKSYKWEECGKDFNQSLSLIKITHTGEKPYKCEKCGKAFYQSSTLTKHKNSYWRELLL

SEQ ID NO: 98965 - protein, 542 aa, Homo sapiens; identical to SEQ ID NO: 98960
  Payload ID: 19750
  Gene Name: zinc finger protein 100
  Uniprot ID: Q8IYN0
  ENSP ID: ENSP00000483779

SEQ ID NO: 98966 - protein, 478 aa, Homo sapiens; identical to SEQ ID NO: 98961
  Payload ID: 19750
  Gene Name: zinc finger protein 100
  ENSP ID: ENSP00000485113

SEQ ID NO: 98967 - protein, 156 aa, Homo sapiens; identical to SEQ ID NO: 98962
  Payload ID: 19750
  Gene Name: zinc finger protein 100
  ENSP ID: ENSP00000485132

SEQ ID NO: 98968 - protein, 63 aa, Homo sapiens; identical to SEQ ID NO: 98963
  Payload ID: 19750
  Gene Name: zinc finger protein 100
  ENSP ID: ENSP00000485182

SEQ ID NO: 98969 - protein, 436 aa, Homo sapiens
  Payload ID: 19751
  Gene Name: zinc finger protein 101
  Uniprot ID: Q8IZC7
  ENSP ID: ENSP00000319716
MDSVAFEDVAVNFTQEEWALLSPSQKNLYRDVTLETFRNLASVGIQWKDQDIENLYQNLGIKLRSLVERLCGRKEGNEHRETFSQIPDCHLNKKSQTGVKPCKCSVCGKVFLRHSFLDRHMRAHAGHKRSECGGEWRETPRKQKQHGKASISPSSGARRTVTPTRKRPYECKVCGKAFNSPNLFQIHQRTHTGKRSYKCREIVRAFTVSSFFRKHGKMHTGEKRYECKYCGKPIDYPSLFQIHVRTHTGEKPYKCKQCGKAFISAGYLRTHEIRSHALEKSHQCQECGKKLSCSSSLHRHERTHSGGKLYECQKCAKVFRCPTSLQAHERAHTGERPYECNKCGKTFNYPSCFRRHKKTHSGEKPYECTRCGKAFGWCSSLRRHEMTHTGEKPFDCKQCGKVFTFSNYLRLHERTHLAGRSQCFGRRQGDHLSPGV

SEQ ID NO: 98970 - protein, 316 aa, Homo sapiens
  Payload ID: 19751
  Gene Name: zinc finger protein 101
  Uniprot ID: Q8IZC7
  ENSP ID: ENSP00000400952
MRAHAGHKRSECGGEWRETPRKQKQHGKASISPSSGARRTVTPTRKRPYECKVCGKAFNSPNLFQIHQRTHTGKRSYKCREIVRAFTVSSFFRKHGKMHTGEKRYECKYCGKPIDYPSLFQIHVRTHTGEKPYKCKQCGKAFISAGYLRTHEIRSHALEKSHQCQECGKKLSCSSSLHRHERTHSGGKLYECQKCAKVFRCPTSLQAHERAHTGERPYECNKCGKTFNYPSCFRRHKKTHSGEKPYECTRCGKAFGWCSSLRRHEMTHTGEKPFDCKQCGKVFTFSNYLRLHERTHLAGRSQCFGRRQGDHLSPGV

SEQ ID NO: 98971 - protein, 61 aa, Homo sapiens
  Payload ID: 19751
  Gene Name: zinc finger protein 101
  ENSP ID: ENSP00000466697
MDSVAFEDVAVNFTQEEWALLSPSQKNLYRDVTLETFRNLASESNGKTRTLRICTKTWGLS

SEQ ID NO: 98972 - protein, 147 aa, Homo sapiens
  Payload ID: 19751
  Gene Name: zinc finger protein 101
  ENSP ID: ENSP00000466744
  MOD_RES (1)..(1): Any amino acid
XLSCSSSLHRHERTHSGGKLYECQKCAKVFRCPTSLQAHERAHTGERPYECNKCGKTFNYPSCFRRHKKTHSGEKPYECTRCGKAFGWCSSLRRHEMTHTGEKPFDCKQCGKVFTFSNYLRLHERTHLAGRSQCFGRRQGDHLSPGV

SEQ ID NO: 98973 - protein, 58 aa, Homo sapiens
  Payload ID: 19751
  Gene Name: zinc finger protein 101
  ENSP ID: ENSP00000467112
MRAHAGHKRSECGGEWRETPRKQKQHGKASISPSSGARRTVTPTRKRPYECKVCGKAF

SEQ ID NO: 98974 - protein, 436 aa, Homo sapiens; identical to SEQ ID NO: 98969
  Payload ID: 19751
  Gene Name: zinc finger protein 101
  Uniprot ID: Q8IZC7
  ENSP ID: ENSP00000468049

SEQ ID NO: 98975 - protein, 1883 aa, Homo sapiens
  Payload ID: 19752
  Gene Name: zinc finger protein 106
  Uniprot ID: Q9H2Y7
  ENSP ID: ENSP00000263805
MPVGRIECPSSPSFPRDISHECRVCGVTEVGLSAYAKHISGQLHKDNVDAQEREDDGKGEEEEEDYFDKELIQLIKQRKEQSRQDEPSNSNQEINSDDRRPQWRREDRIPYQDRESYSQPAWHHRGPPQRDWKWEKDGFNNTRKNSFPHSLRNGGGPRGRSGWHKGVAGGSSTWFHNHSNSGGGWLSNSGAVDWNHNGTGRNSSWLSEGTGGFSSWHMNNSNGNWKSSVRSTNNWNYSGPGDKFQPGRNRNSNCQMEDMTMLWNKKSNKSNKYSHDRYNWQRQENDKLGTVATYRGPSEGFTSDKFPSEGLLDFNFEQLESQTTKQADTATSKVSGKNGSAAREKPRRWTPYPSQKTLDLQSGLKDITGNKSEMIEKPLFDFSLITTGIQEPQTDETRNSPTQKTQKEIHTGSLNHKASSDSAASFEVVRQCPTAEKPEQEHTPNKMPSLKSPLLPCPATKSLSQKQDPKNISKNTKTNFFSPGEHSNPSNKPTVEDNHGPYISKLRSSCPHVLKGNKSTFGSQKQSGDNLNDTLRKAKEVLQCHESLQNPLLSTSKSTRNYAKASRNVEESEKGSLKIEFQVHALEDESDGETSDTEKHGTKIGTLGSATTELLSGSTRTADEKEEDDRILKTSRELSTSPCNPIVRQKESELQMTSAASPHPGLLLDLKTSLEDAQVDDSIKSHVSYETEGFESASLDAELQKSDISQPSGPLLPELSKLGFPASLQRDLTRHISLKSKTGVHLPEPNLNSARRIRNISGHRKSETEKESGLKPTLRQILNASRRNVNWEQVIQQVTKKKQELGKGLPRFGIEMVPLVQNEQEALDLDGEPDLSSLEGFQWEGVSISSSPGLARKRSLSESSVIMDRAPSVYSFFSEEGTGKENEPQQMVSPSNSLRAGQSQKATMHLKQEVTPRAASLRTGERAENVATQRRHSAQLSSDHIIPLMHLAKDLNSQERSIPPSENQNSQESNGEGNCLSSSASSALAISSLADAATDSSCTSGAEQNDGQSIRKKRRATGDGSSPELPSLERKNKRRKIKGKKERSQVDQLLNISLREEELSKSLQCMDNNLLQARAALQTAYVEVQRLLMLKQQITMEMSALRTHRIQILQGLQETYEPSEHPDQVPCSLTRERRNSRSQTSIDAALLPTPFFPLFLEPPSSHVSPSPTGASLQITTSPTFQTHGSVPAPDSSVQIKQEPMSPEQDENVNAVPPSSACNVSKELLEANREISDSCPVYPVITARLSLPESTESFHEPSQELKFSVEQRNTRNRENSPSSQSAGLSSINKEGEEPTKGNSGSEACTSSFLRLSFASETPLEKEPHSPADQPEQQAESTLTSAETRGSKKKKKLRKKKSLRAAHVPENSDTEQDVLTVKPVRKVKAGKLIKGGKVTTSTWEDSRTGREQESVRDEPDSDSSLEVLEIPNPQLEVVAIDSSESGEEKPDSPSKKDIWNSTEQNPLETSRSGCDEVSSTSEIGTRYKDGIPVSVAETQTVISSIKGSKNSSEISSEPGDDDEPTEGSFEGHQAAVNAIQIFGNLLYTCSADKTVRVYNLVSRKCIGVFEGHTSKVNCLLVTQTSGKNAALYTGSSDHTIRCYNVKSRECVEQLQLEDRVLCLHSRWRILYAGLANGTVVTFNIKNNKRLEIFECHGPRAVSCLATAQEGARKLLVVGSYDCTISVRDARNGLLLRTLEGHSKTILCMKVVNDLVFSGSSDQSVHAHNIHTGELVRIYKGHNHAVTVVNILGKVMVTACLDKFVRVYELQSHDRLQVYGGHKDMIMCMTIHKSMIYTGCYDGSIQAVRLNLMQNYRCWWHGCSLIFGVVDHLKQHLLTDHTNPNFQTLKCRWKNCDAFFTARKGSKQDAAGHIERHAEDDSKIDS

SEQ ID NO: 98976 - protein, 201 aa, Homo sapiens
  Payload ID: 19752
  Gene Name: zinc finger protein 106
  ENSP ID: ENSP00000454882
MVRERKCILCHIVYSSKKEMDEHMRSMLHHRELENLKGRDISHECRVCGVTEVGLSAYAKHISGQLHKDNVDAQEREDDGKGEEEEEDYFDKELIQLIKQRKEQSRQDEPSNSNQEINSDDRRPQWRREDRIPYQDRESYSQPAWHHRGPPQRDWKWEKDGFNNTRKNSFPHSLRNGGGPRGRSGWHKGVAGGSSTWFHNH

SEQ ID NO: 98977 - protein, 816 aa, Homo sapiens
  Payload ID: 19752
  Gene Name: zinc finger protein 106
  ENSP ID: ENSP00000455049
MNNSNGNWKSSVRSTNNWNYSGPGDKFQPGRNRNSNCQMEDMTMLWNKKSNKSNKYSHDRYNWQRQENDKLGTVATYRGPSEGFTSDKFPSEGLLDFNFEQLESQTTKQADTATSKVSGKNGSAAREKPRRWTPYPSQKTLDLQSGLKDITGNKSEMIEKPLFDFSLITTGIQEPQTDETRNSPTQKTQKEIHTGSLNHKASSDSAASFEVVRQCPTAEKPEQEHTPNKMPSLKSPLLPCPATKSLSQKQDPKNISKNTKTNFFSPGEHSNPSNKPTVEDNHGPYISKLRSSCPHVLKGNKSTFGSQKQSGDNLNDTLRKAKEVLQCHESLQNPLLSTSKSTRNYAKASRNVEESEKGSLKIEFQVHALEDESDGETSDTEKHGTKIGTLGSATTELLSGSTRTADEKEEDDRILKTSRELSTSPCNPIVRQKESELQMTSAASPHPGLLLDLKTSLEDAQVDDSIKSHVSYETEGFESASLDAELQKSDISQPSGPLLPELSKLGFPASLQRDLTRHISLKSKTGVHLPEPNLNSARRIRNISGHRKSETEKESGLKPTLRQILNASRRNVNWEQVIQQVTKKKQELGKGLPRFGIEMVPLVQNEQEALDLDGEPDLSSLEGFQWEGVSISSSPGLARKRSLSESSVIMDRAPSVYSFFSEEGTGKENEPQQMVSPSNSLRAGQSQKATMHLKQEVTPRAASLRTGERAENVATQRRHSAQLSSDHIIPLMHLAKDLNSQERSIPPSENQNSQESNGEGNCLSSSASSALAISSLADAATDSSCTSGAEQNDGQSIRKKRRATGDGSSPELPSLE

SEQ ID NO: 98978 - protein, 1111 aa, Homo sapiens
  Payload ID: 19752
  Gene Name: zinc finger protein 106
  Uniprot ID: Q9H2Y7
  ENSP ID: ENSP00000455674
MVRERKCILCHIVYSSKKEMDEHMRSMLHHRELENLKGRFGIEMVPLVQNEQEALDLDGEPDLSSLEGFQWEGVSISSSPGLARKRSLSESSVIMDRAPSVYSFFSEEGTGKENEPQQMVSPSNSLRAGQSQKATMHLKQEVTPRAASLRTGERAENVATQRRHSAQLSSDHIIPLMHLAKDLNSQERSIPPSENQNSQESNGEGNCLSSSASSALAISSLADAATDSSCTSGAEQNDGQSIRKKRRATGDGSSPELPSLERKNKRRKIKGKKERSQVDQLLNISLREEELSKSLQCMDNNLLQARAALQTAYVEVQRLLMLKQQITMEMSALRTHRIQILQGLQETYEPSEHPDQVPCSLTRERRNSRSQTSIDAALLPTPFFPLFLEPPSSHVSPSPTGASLQITTSPTFQTHGSVPAPDSSVQIKQEPMSPEQDENVNAVPPSSACNVSKELLEANREISDSCPVYPVITARLSLPESTESFHEPSQELKFSVEQRNTRNRENSPSSQSAGLSSINKEGEEPTKGNSGSEACTSSFLRLSFASETPLEKEPHSPADQPEQQAESTLTSAETRGSKKKKKLRKKKSLRAAHVPENSDTEQDVLTVKPVRKVKAGKLIKGGKVTTSTWEDSRTGREQESVRDEPDSDSSLEVLEIPNPQLEVVAIDSSESGEEKPDSPSKKDIWNSTEQNPLETSRSGCDEVSSTSEIGTRYKDGIPVSVAETQTVISSIKGSKNSSEISSEPGDDDEPTEGSFEGHQAAVNAIQIFGNLLYTCSADKTVRVYNLVSRKCIGVFEGHTSKVNCLLVTQTSGKNAALYTGSSDHTIRCYNVKSRECVEQLQLEDRVLCLHSRWRILYAGLANGTVVTFNIKNNKRLEIFECHGPRAVSCLATAQEGARKLLVVGSYDCTISVRDARNGLLLRTLEGHSKTILCMKVVNDLVFSGSSDQSVHAHNIHTGELVRIYKGHNHAVTVVNILGKVMVTACLDKFVRVYELQSHDRLQVYGGHKDMIMCMTIHKSMIYTGCYDGSIQAVRLNLMQNYRCWWHGCSLIFGVVDHLKQHLLTDHTNPNFQTLKCRWKNCDAFFTARKGSKQDAAGHIERHAEDDSKIDS

SEQ ID NO: 98979 - protein, 217 aa, Homo sapiens
  Payload ID: 19752
  Gene Name: zinc finger protein 106
  ENSP ID: ENSP00000456191
EDRVLCLHSRWRILYAGLANGTVVTFNIKNNKRLEIFECHGPRAVSCLATAQEGARKLLVVGSYDCTISVRDARNGLLLRTLEGHSKTILCMKVVNDLVFSGSSDQSVHAHNIHTGELVRIYKGHNHAVTVVNILGKVMVTACLDKFVRVYELQSHDRLQVYGGHKDMIMCMTIHKSMIYTGCYDGSIQAVRLNLMQNYRCWERLQWFLLDPKNVKN

SEQ ID NO: 98980 - protein, 850 aa, Homo sapiens
  Payload ID: 19752
  Gene Name: zinc finger protein 106
  ENSP ID: ENSP00000456604
  MOD_RES (1)..(1): Any amino acid
XLMHLAKDLNSQERSIPPSENQNSQESNGEGNCLSSSASSALAISSLADAATDSSCTSGAEQNDGQSIRKKRRATGDGSSPELPSLERKNKRRKIKGKKERSQVDQLLNISLREEELSKSLQCMDNNLLQARAALQTAYVEVQRLLMLKQQITMEMSALRTHRIQILQGLQETYEPSEHPDQVPCSLTRERRNSRSQTSIDAALLPTPFFPLFLEPPSSHVSPSPTGASLQITTSPTFQTHGSVPAPDSSVQIKQEPMSPEQDENVNAVPPSSACNVSKELLEANKTPLEKEPHSPADQPEQQAESTLTSAETRGSKKKKKLRKKKSLRAAHVPENSDTEQDVLTVKPVRKVKAGKLIKGGKVTTSTWEDSRTGREQESVRDEPDSDSSLEVLEIPNPQLEVVAIDSSESGEEKPDSPSKKDIWNSTEQNPLETSRSGCDEVSSTSEIGTRYKDGIPVSVAETQTVISSIKGSKNSSEISSEPGDDDEPTEGSFEGHQAAVNAIQIFGNLLYTCSADKTVRVYNLVSRKCIGVFEGHTSKVNCLLVTQTSGKNAALYTGSSDHTIRCYNVKSRECVEQLQLEDRVLCLHSRWRILYAGLANGTVVTFNIKNNKRLEIFECHGPRAVSCLATAQEGARKLLVVGSYDCTISVRDARNGLLLRTLEGHSKTILCMKVVNDLVFSGSSDQSVHAHNIHTGELVRIYKGHNHAVTVVNILGKVMVTACLDKFVRVYELQSHDRLQVYGGHKDMIMCMTIHKSMIYTGCYDGSIQAVRLNLMQNYRCWWHGCSLIFGVVDHLKQHLLTDHTNPNFQTLKCRWKNCDAFFTARKGSKQDAAGHIERHAEDDSKIDS

SEQ ID NO: 98981 - protein, 431 aa, Homo sapiens
  Payload ID: 19752
  Gene Name: zinc finger protein 106
  ENSP ID: ENSP00000456845
MVRERKCILCHIVYSSKKEMDEHMRSMLHHRELENLKGRDISHECRVCGVTEVGLSAYAKHISGQLHKDNVDAQEREDDGKGEEEEEDYFDKELIQLIKQRKEQSRQDEPSNSNQEINSDDRRPQWRREDRIPYQDRESYSQPAWHHRGPPQRDWKWEKDGFNNTRKNSFPHSLRNGGGPRGRSGWHKGVAGGSSTWFHNHSNSGGGWLSNSGAVDWNHNGTGRNSSWLSEGTGGFSSWHMNNSNGNWKSSVRSTNNWNYSGPGDKFQPGRNRNSNCQMEDMTMLWNKKSNKSNKYSHDRYNWQRQENDKLGTVATYRGPSEGFTSDKFPSEGLLDFNFEQLESQTTKQADTATSKVSGKNGSAAREKPRRWTPYPSQKTLDLQSGLKDITGNKSEMIEKPLFDFSLITTGIQEPQTDETRNSPTQKTQKE

SEQ ID NO: 98982 - protein, 1068 aa, Homo sapiens
  Payload ID: 19752
  Gene Name: zinc finger protein 106
  ENSP ID: ENSP00000457637
MVPLVQNEQEALDLDGEPDLSSLEGFQWEGVSISSSPGLARKRSLSESSVIMDRAPSVYSFFSEEGTGKENEPQQMVSPSNSLRAGQSQKATMHLKQEVTPRAASLRTGERAENVATQRRHSAQLSSDHIIPLMHLAKDLNSQERSIPPSENQNSQESNGEGNCLSSSASSALAISSLADAATDSSCTSGAEQNDGQSIRKKRRATGDGSSPELPSLERKNKRRKIKGKKERSQVDQLLNISLREEELSKSLQCMDNNLLQARAALQTAYVEVQRLLMLKQQITMEMSALRTHRIQILQGLQETYEPSEHPDQVPCSLTRERRNSRSQTSIDAALLPTPFFPLFLEPPSSHVSPSPTGASLQITTSPTFQTHGSVPAPDSSVQIKQEPMSPEQDENVNAVPPSSACNVSKELLEANREISDSCPVYPVITARLSLPESTESFHEPSQELKFSVEQRNTRNRENSPSSQSAGLSSINKEGEEPTKGNSGSEACTSSFLRLSFASETPLEKEPHSPADQPEQQAESTLTSAETRGSKKKKKLRKKKSLRAAHVPENSDTEQDVLTVKPVRKVKAGKLIKGGKVTTSTWEDSRTGREQESVRDEPDSDSSLEVLEIPNPQLEVVAIDSSESGEEKPDSPSKKDIWNSTEQNPLETSRSGCDEVSSTSEIGTRYKDGIPVSVAETQTVISSIKGSKNSSEISSEPGDDDEPTEGSFEGHQAAVNAIQIFGNLLYTCSADKTVRVYNLVSRKCIGVFEGHTSKVNCLLVTQTSGKNAALYTGSSDHTIRCYNVKSRECVEQLQLEDRVLCLHSRWRILYAGLANGTVVTFNIKNNKRLEIFECHGPRAVSCLATAQEGARKLLVVGSYDCTISVRDARNGLLLRTLEGHSKTILCMKVVNDLVFSGSSDQSVHAHNIHTGELVRIYKGHNHAVTVVNILGKVMVTACLDKFVRVYELQSHDRLQVYGGHKDMIMCMTIHKSMIYTGCYDGSIQAVRLNLMQNYRCWWHGCSLIFGVVDHLKQHLLTDHTNPNFQTLKCRWKNCDAFFTARKGSKQDAAGHIERHAEDDSKIDS

SEQ ID NO: 98983 - protein, 191 aa, Homo sapiens
  Payload ID: 19752
  Gene Name: zinc finger protein 106
  ENSP ID: ENSP00000475881
GKKERSQVDQLLNISLREEELSKSLQCMDNNLLQARAALQTAYVEVQRLLMLKQQITMEMSALRTHRIQILQGLQETYEPSEHPDQVPCSLTRERRNSRSQTSIDAALLPTPFFPLFLEPPSSHVSPSPTGASLQITTSPTFQTHGSVPAPDSSVQIKQEPMSPEQDENVNAVPPSSACNVSKELLEANSM

SEQ ID NO: 98984 - protein, 783 aa, Homo sapiens
  Payload ID: 19753
  Gene Name: zinc finger protein 107
  Uniprot ID: Q9UII5
  ENSP ID: ENSP00000343443
MVAKPPVMSFHFAQDLWPEQNIKDSFQKVTLRRYGKCEYENLQLRKGCKHVDECTGHKGGHNTVNQCLTATPSKIFQCNKYVKVFDKFSNSNRYKRRHTGNKHFKCKECSKSFCVLSQLTQHRRIHTRVNSYKCEECGKAFNWFSTLTKHKRIHTGEKPYKCEECGKAFNQSSQLTRHKIIHTEEKPNKCEECGKAFKQASHLTIHKIIHTGEKPYKYEECGKVFSQSSHLTTQKILHTGENLYKCKECGKAFNLFSNLTNHKRIHAGEKPYKCKECGRAFNISSNLNKQEKIHTGGKLNKCEECDKAFNRSLKLTAHKKILMEEKPYKCEECGKVFNQFSTLTRHKIIHTGEKPYKCKECGKAFNQSSNLTEHKKIHTAEKSYKCEECGKAFNQHSNLINHRKIYSGEKPYKCEECGKAFNRSSTLTRHKKIHTGEKPYKCEECDRAFSQSSNLTEHKKIHTGEKPYKCEECGKAFNRFSTLTKHKRIHTGEKPYKCEECGKAFNQSYQLTRHKIVHTKEKLNKCEEFGKAFKQSSHRTIHKIIHTGEKPYKCEEHGKVFNQSSNLTTQKIIHTGENLYKFEEHGKAFNLFSNITNHKIIYTGEKPHKCEECGKAYNRFSNLTIHKRIHTGEKPYQCAECGKAFNCSSTLNRHKIIHTGEKPYKCKECGKAFNLSSTLTAHKKIHTGEKPYKCEECGKAFNQSSNLTTHKKIHTSEKPYKCEECGKSFNQFSSLNIHKIIHTGEKPYKCGDYGRAFNLSSNLTTHKKIHTGEKPYKCEYGKT

SEQ ID NO: 98985 - protein, 91 aa, Homo sapiens
  Payload ID: 19753
  Gene Name: zinc finger protein 107
  ENSP ID: ENSP00000353234
MVAKPPVMSFHFAQDLWPEQNIKDSFQKVTLRRYGKCEYENLQLRKGCKHVDECTGHKGGHNTVNQCLTATPSKIFQCNKYVKVFDKFSNS

SEQ ID NO: 98986 - protein, 783 aa, Homo sapiens; identical to SEQ ID NO: 98984
  Payload ID: 19753
  Gene Name: zinc finger protein 107
  Uniprot ID: Q9UII5
  ENSP ID: ENSP00000378789

SEQ ID NO: 98987 - protein, 783 aa, Homo sapiens; identical to SEQ ID NO: 98984
  Payload ID: 19753
  Gene Name: zinc finger protein 107
  Uniprot ID: Q9UII5
  ENSP ID: ENSP00000400037

SEQ ID NO: 98988 - protein, 820 aa, Homo sapiens
  Payload ID: 19753
  Gene Name: zinc finger protein 107
  ENSP ID: ENSP00000481898
MEPLTFKDVAIEFSLEEWQCLDTAQRDLYRNVLLENYRNLVFLVMSFHFAQDLWPEQNIKDSFQKVTLRRYGKCEYENLQLRKGCKHVDECTGHKGGHNTVNQCLTATPSKIFQCNKYVKVFDKFSNSNRYKRRHTGNKHFKCKECSKSFCVLSQLTQHRRIHTRVNSYKCEECGKAFNWFSTLTKHKRIHTGEKPYKCEECGKAFNQSSQLTRHKIIHTEEKPNKCEECGKAFKQASHLTIHKIIHTGEKPYKYEECGKVFSQSSHLTTQKILHTGENLYKCKECGKAFNLFSNLTNHKRIHAGEKPYKCKECGRAFNISSNLNKQEKIHTGGKLNKCEECDKAFNRSLKLTAHKKILMEEKPYKCEECGKVFNQFSTLTRHKIIHTGEKPYKCKECGKAFNQSSNLTEHKKIHTAEKSYKCEECGKAFNQHSNLINHRKIYSGEKPYKCEECGKAFNRSSTLTRHKKIHTGEKPYKCEECDRAFSQSSNLTEHKKIHTGEKPYKCEECGKAFNRFSTLTKHKRIHTGEKPYKCEECGKAFNQSYQLTRHKIVHTKEKLNKCEEFGKAFKQSSHRTIHKIIHTGEKPYKCEEHGKVFNQSSNLTTQKIIHTGENLYKFEEHGKAFNLFSNITNHKIIYTGEKPHKCEECGKAYNRFSNLTIHKRIHTGEKPYQCAECGKAFNCSSTLNRHKIIHTGEKPYKCKECGKAFNLSSTLTAHKKIHTGEKPYKCEECGKAFNQSSNLTTHKKIHTSEKPYKCEECGKSFNQFSSLNIHKIIHTGEKPYKCGDYGRAFNLSSNLTTHKKIHTGEKPYKCEYGKT

SEQ ID NO: 98989 - protein, 852 aa, Homo sapiens
  Payload ID: 19753
  Gene Name: zinc finger protein 107
  ENSP ID: ENSP00000483720
MEPLTFKDVAIEFSLEEWQCLDTAQRDLYRNVLLENYRNLVFLGIAVSKPYLITCLEQKKEPWNIKRHEMVAKPPVMSFHFAQDLWPEQNIKDSFQKVTLRRYGKCEYENLQLRKGCKHVDECTGHKGGHNTVNQCLTATPSKIFQCNKYVKVFDKFSNSNRYKRRHTGNKHFKCKECSKSFCVLSQLTQHRRIHTRVNSYKCEECGKAFNWFSTLTKHKRIHTGEKPYKCEECGKAFNQSSQLTRHKIIHTEEKPNKCEECGKAFKQASHLTIHKIIHTGEKPYKYEECGKVFSQSSHLTTQKILHTGENLYKCKECGKAFNLFSNLTNHKRIHAGEKPYKCKECGRAFNISSNLNKQEKIHTGGKLNKCEECDKAFNRSLKLTAHKKILMEEKPYKCEECGKVFNQFSTLTRHKIIHTGEKPYKCKECGKAFNQSSNLTEHKKIHTAEKSYKCEECGKAFNQHSNLINHRKIYSGEKPYKCEECGKAFNRSSTLTRHKKIHTGEKPYKCEECDRAFSQSSNLTEHKKIHTGEKPYKCEECGKAFNRFSTLTKHKRIHTGEKPYKCEECGKAFNQSYQLTRHKIVHTKEKLNKCEEFGKAFKQSSHRTIHKIIHTGEKPYKCEEHGKVFNQSSNLTTQKIIHTGENLYKFEEHGKAFNLFSNITNHKIIYTGEKPHKCEECGKAYNRFSNLTIHKRIHTGEKPYQCAECGKAFNCSSTLNRHKIIHTGEKPYKCKECGKAFNLSSTLTAHKKIHTGEKPYKCEECGKAFNQSSNLTTHKKIHTSEKPYKCEECGKSFNQFSSLNIHKIIHTGEKPYKCGDYGRAFNLSSNLTTHKKIHTGEKPYKCEYGKT

SEQ ID NO: 98990 - protein, 913 aa, Homo sapiens
  Payload ID: 19754
  Gene Name: zinc finger protein 112
  Uniprot ID: Q9UJU3
  ENSP ID: ENSP00000337081
MTKFQEMVTFKDVAVVFTEEELGLLDSVQRKLYRDVMLENFRNLLLVAHQPFKPDLISQLEREEKLLMVETETPRDGCSGRKNQQKMESIQEVTVSYFSPKELSSRQTWQQSAGGLIRCQDFLKVFQGKNSQLQEQGNSLGQVWAGIPVQISEDKNYIFTHIGNGSNYIKSQGYPSWRAHHSWRKMYLKESHNYQCRCQQISMKNHFCKCDSVSWLSHHNDKLEVHRKENYSCHDCGEDIMKVSLLNQESIQTEEKPYPCTGYRKAFSNDSSSEVHQQFHLEGKPYTYSSCGKGCNYSSLLHIHQNIEREDDIENSHLKSYQRVHTEEKPCKCGEYGENFNHCSPLNTYELIHTGEMSYRHNIYEKAFSHSLDLNSIFRVHTRDEPHEYEENENVFNQSSCLQVHQKIHTEEKLYTDIEYGKSFICSSNLDIQHRVHMEENSYNSEECGNGFSLASHFQDLQIVHTKEQPYKRYVCSNSFSHNLYLQGHPKIHIGEKPRKEHGNGFNWSSKLKDHQRVHTGQKPYKCNICGKGFNHRSVLNVHQRVHTGEKPYKCEECDKGFSRSSYLQAHQRVHTGEKPYKCEECGKGFSRNSYLQGHQRVHTGEKPYKCEECGKGFSRSSHLQGHQRVHTGEKPFKCEECGKGFSWSFNLQIHQRVHTGEKPYKCEECGKGFSKASTLLAHQRVHTGEKPYQCDECGKSFSQRSYLQSHQSVHSGERPYICEVCGKGFSQRAYLQGHQRVHTRVKPYKCEMCGKGFSQSSRLEAHRRVHTGGKPYKCEVCTKGFSESSRLQAHQRVHVEGRPYKCEQCGKGFSGYSSLQAHHRVHTGEKPYKCEVCGKGFSQRSNLQAHQRVHTGEKPYKCDACGKGFRWSSGLLIHQRVHSSDKFYKSEDYGKDYPSSENLHRNEDSVLF

SEQ ID NO: 98991 - protein, 907 aa, Homo sapiens
  Payload ID: 19754
  Gene Name: zinc finger protein 112
  Uniprot ID: Q9UJU3
  ENSP ID: ENSP00000346305
MVTFKDVAVVFTEEELGLLDSVQRKLYRDVMLENFRNLLLVAHQPFKPDLISQLEREEKLLMVETETPRDGCSGRKNQQKMESIQEVTVSYFSPKELSSRQTWQQSAGGLIRCQDFLKVFQGKNSQLQEQGNSLGQVWAGIPVQISEDKNYIFTHIGNGSNYIKSQGYPSWRAHHSWRKMYLKESHNYQCRCQQISMKNHFCKCDSVSWLSHHNDKLEVHRKENYSCHDCGEDIMKVSLLNQESIQTEEKPYPCTGYRKAFSNDSSSEVHQQFHLEGKPYTYSSCGKGCNYSSLLHIHQNIEREDDIENSHLKSYQRVHTEEKPCKCGEYGENFNHCSPLNTYELIHTGEMSYRHNIYEKAFSHSLDLNSIFRVHTRDEPHEYEENENVFNQSSCLQVHQKIHTEEKLYTDIEYGKSFICSSNLDIQHRVHMEENSYNSEECGNGFSLASHFQDLQIVHTKEQPYKRYVCSNSFSHNLYLQGHPKIHIGEKPRKEHGNGFNWSSKLKDHQRVHTGQKPYKCNICGKGFNHRSVLNVHQRVHTGEKPYKCEECDKGFSRSSYLQAHQRVHTGEKPYKCEECGKGFSRNSYLQGHQRVHTGEKPYKCEECGKGFSRSSHLQGHQRVHTGEKPFKCEECGKGFSWSFNLQIHQRVHTGEKPYKCEECGKGFSKASTLLAHQRVHTGEKPYQCDECGKSFSQRSYLQSHQSVHSGERPYICEVCGKGFSQRAYLQGHQRVHTRVKPYKCEMCGKGFSQSSRLEAHRRVHTGGKPYKCEVCTKGFSESSRLQAHQRVHVEGRPYKCEQCGKGFSGYSSLQAHHRVHTGEKPYKCEVCGKGFSQRSNLQAHQRVHTGEKPYKCDACGKGFRWSSGLLIHQRVHSSDKFYKSEDYGKDYPSSENLHRNEDSVLF

SEQ ID NO: 98992 - protein, 54 aa, Homo sapiens
  Payload ID: 19754
  Gene Name: zinc finger protein 112
  ENSP ID: ENSP00000464862
MTKFQEMVTFKDVAVVFTEEELGLLDSVQRKLYRDVMLENFRNLLLHISPSSQT

SEQ ID NO: 98993 - protein, 151 aa, Homo sapiens
  Payload ID: 19754
  Gene Name: zinc finger protein 112
  ENSP ID: ENSP00000466797
MVETETPRDGCSGRKNQQKMESIQEVTVSYFSPKELSSRQTWQQSAGGLIRCQDFLKVFQGKNSQLQEQGNSLGQVWAGIPVQISEDKNYIFTHIGNGSNYIKSQGYPSWRAHHSWRKMYLKESHNYQCRCQQISMKNHFCKCDSVSWLSH

SEQ ID NO: 98994 - protein, 149 aa, Homo sapiens
  Payload ID: 19754
  Gene Name: zinc finger protein 112
  ENSP ID: ENSP00000467064
MVTFKDVAVVFTEEELGLLDSVQRKLYRDVMLENFRNLLLVAHQPFKPDLISQLEREEKLLMVETETPRDGCSGRKNQQKMESIQEVTVSYFSPKELSSRQTWQQSAGGLIRCQDFLKVFQGKNSQLQEQGNSLGQVWAGIPVQISEDK

SEQ ID NO: 98995 - protein, 146 aa, Homo sapiens
  Payload ID: 19754
  Gene Name: zinc finger protein 112
  ENSP ID: ENSP00000467994
MGLGPRSLPFSRKRKRKMTKFQEMVTFKDVAVVFTEEELGLLDSVQRKLYRDVMLENFRNLLLVAHQPFKPDLISQLEREEKLLMVETETPRDGCSGRKNQQKMESIQEVTVSYFSPKELSSRQTWQQSAGGLIRCQDFLKVFQGK

SEQ ID NO: 98996 - protein, 417 aa, Homo sapiens
  Payload ID: 19755
  Gene Name: zinc finger protein 114
  Uniprot ID: Q8NC26
  ENSP ID: ENSP00000318898
MSQDSVTFADVAVNFTKEEWTLLDPAQRNLYRDVMLENSRNLAFIDWATPCKTKDATPQPDILPKRTFPEANRVCLTSISSQHSTLREDWRCPKTEEPHRQGVNNVKPPAVAPEKDESPVSICEDHEMRNHSKPTCRLVPSQGDSIRQCILTRDSSIFKYNPVLNDSQKTHENNEDDGVLGWNIQWVPCGRKTELKSSTWTGSQNTVHHIRDEIDTGANRHQRNPFGKAFREDGSLRAHNTHGREKMYDFTQCENTSRNNSIHAMQMQLYTAETNKKDCQTGATSANAPNSGSHKSHCTGEKTHKCPECGRAFFYQSFLMRHMKIHTGEKPYECGKCGKAFRYSLHLNKHLRKHVVQKKPYECEECGKVIRESSKYTHIRSHTGEKPYKCKTCGKDFAKSSGLKKHLKTHKDEKPCE

SEQ ID NO: 98997 - protein, 114 aa, Homo sapiens
  Payload ID: 19755
  Gene Name: zinc finger protein 114
  ENSP ID: ENSP00000469287
MSQGLALLPRLDCSGRIIAYCNLHLPGSGNPPSSASRVAETTGTRPHSRDSVTFADVAVNFTKEEWTLLDPAQRNLYRDVMLENSRNLAFIDWATPCKTKDATPQPDILPKRTF

SEQ ID NO: 98998 - protein, 417 aa, Homo sapiens; identical to SEQ ID NO: 98996
  Payload ID: 19755
  Gene Name: zinc finger protein 114
  Uniprot ID: Q8NC26
  ENSP ID: ENSP00000469998

SEQ ID NO: 98999 - protein, 60 aa, Homo sapiens
  Payload ID: 19755
  Gene Name: zinc finger protein 114
  ENSP ID: ENSP00000471237
MSQGLALLPRLDCSGRIIAYCNLHLPGSGNPPSSASRVAETTGTRPHSRDSVTFADVAVN

SEQ ID NO: 99000 - protein, 131 aa, Homo sapiens
  Payload ID: 19755
  Gene Name: zinc finger protein 114
  ENSP ID: ENSP00000471469
MSQGLALLPRLDCSGRIIAYCNLHLPGSGNPPSSASRVAETTGTRPHSRDSVTFADVAVNFTKEEWTLLDPAQRNLYRDVMLENSRNLAFIDWATPCKTKDATPQPDILPKRTFPEANRVCLTSISSQHST

SEQ ID NO: 99001 - protein, 417 aa, Homo sapiens; identical to SEQ ID NO: 98996
  Payload ID: 19755
  Gene Name: zinc finger protein 114
  Uniprot ID: Q8NC26
  ENSP ID: ENSP00000471727

SEQ ID NO: 99002 - protein, 383 aa, Homo sapiens
  Payload ID: 19755
  Gene Name: zinc finger protein 114
  Uniprot ID: Q8NC26
  ENSP ID: ENSP00000472747
MLENSRNLAFIDWATPCKTKDATPQPDILPKRTFPEANRVCLTSISSQHSTLREDWRCPKTEEPHRQGVNNVKPPAVAPEKDESPVSICEDHEMRNHSKPTCRLVPSQGDSIRQCILTRDSSIFKYNPVLNDSQKTHENNEDDGVLGWNIQWVPCGRKTELKSSTWTGSQNTVHHIRDEIDTGANRHQRNPFGKAFREDGSLRAHNTHGREKMYDFTQCENTSRNNSIHAMQMQLYTAETNKKDCQTGATSANAPNSGSHKSHCTGEKTHKCPECGRAFFYQSFLMRHMKIHTGEKPYECGKCGKAFRYSLHLNKHLRKHVVQKKPYECEECGKVIRESSKYTHIRSHTGEKPYKCKTCGKDFAKSSGLKKHLKTHKDEKPCE

SEQ ID NO: 99003 - protein, 483 aa, Homo sapiens
  Payload ID: 19756
  Gene Name: zinc finger protein 117
  Uniprot ID: Q03924
  ENSP ID: ENSP00000282869
MKRHEMVAKHLVMFYYFAQHLWPEQNIRDSFQKVTLRRYRKCGYENLQLRKGCKSVVECKQHKGDYSGLNQCLKTTLSKIFQCNKYVEVFHKISNSNRHKMRHTENKHFKCKECRKTFCMLSHLTQHKRIQTRVNFYKCEAYGRAFNWSSTLNKHKRIHTGEKPYKCKECGKAFNQTSHLIRHKRIHTEEKPYKCEECGKAFNQSSTLTTHNIIHTGEIPYKCEKCVRAFNQASKLTEHKLIHTGEKRYECEECGKAFNRSSKLTEHKYIHTGEKLYKCEECGKAFNQSSTLTTHKRIHSGEKPYKCEECGKAFKQFSNLTDHKKIHTGEKPYKCEECGKAFNQLSNLTRHKVIHTGEKPYKCGECGKAFNQSSALNTHKIIHTGENPHKCRESGKVFHLSSKLSTCKKIHTGEKLYKCEECGKAFNRSSTLIGHKRIHTGEKPYKCEECGKAFNQSSTLTTHKIIHTEEKQYKCDECGKAST

SEQ ID NO: 99004 - protein, 483 aa, Homo sapiens; identical to SEQ ID NO: 99003
  Payload ID: 19756
  Gene Name: zinc finger protein 117
  Uniprot ID: Q03924
  ENSP ID: ENSP00000479944

SEQ ID NO: 99005 - protein, 383 aa, Homo sapiens
  Payload ID: 19756
  Gene Name: zinc finger protein 117
  ENSP ID: ENSP00000484825
MKRHEMVAKHLVMFYYFAQHLWPEQNIRDSFQKVTLRRYRKCGYENLQLRKGCKSVVECKQHKGDYSGLNQCLKTTLSKIFQCNKYVEVFHKISNSNRHKMRHTENKHFKCKECRKTFCMLSHLTQHKRIQTRVNFYKCEAYGRAFNWSSTLNKHKRIHTGEKPYKCKECGKAFNQTSHLIRHKRIHTEEKPYKCEECGKAFNQSSTLTTHNIIHTGEIPYKCEKCVRAFNQASKLTEHKLIHTGEKRYECEECGKAFNRSSKLTEHKYIHTGEKLYKCEECDKAFNLSSTLTKHKVIHTGEKLYKCKECGKAFKQFSHLAIHNIIHTGEKLYKCEECGKAFNLSSNLTAHKKNRTGEKPYKCEECGKANLSSTLTPHKTIHI

SEQ ID NO: 99006 - protein, 659 aa, Homo sapiens
  Payload ID: 19757
  Gene Name: zinc finger protein 12
  Uniprot ID: P17014
  ENSP ID: ENSP00000344745
MNKSLGPVSFKDVAVDFTQEEWQQLDPEQKITYRDVMLENYSNLVSVGYHIIKPDVISKLEQGEEPWIVEGEFLLQSYPDEVWQTDDLIERIQEEENKPSRQTVFIETLIEEREYISSDGSYARMKADECSGCGKSLLHIKLEKTHPGDQAYEFNQNGEPYTLNEESLYQKIRILEKPFEYIECQKAFQKDTVFVNHMEEKPYKWNGSEIAFLQMSDLTVHQTSHMEMKPYECSECGKSFCKKSKFIIHQRTHTGEKPYECNQCGKSFCQKGTLTVHQRTHTGEKPYECNECGKNFYQKLHLIQHQRTHSGEKPYECSYCGKSFCQKTHLTQHQRTHSGERPYVCHDCGKTFSQKSALNDHQKIHTGVKLYKCSECGKCFCRKSTLTTHLRTHTGEKPYECNECGKFFSRLSYLTVHYRTHSGEKPYECNECGKTFYLNSALMRHQRVHTGEKPYECNECGKLFSQLSYLTIHHRTHSGVKPYECSECGKTFYQNSALCRHRRIHKGEKPYECYICGKFFSQMSYLTIHHRIHSGEKPYECSECGKTFCQNSALNRHQRTHTGEKAYECYECGKCFSQMSYLTIHHRIHSGEKPFECNECGKAFSRMSYLTVHYRTHSGEKPYECTECGKKFYHKSAFNSHQRIHRRGNMNVIDVGRLL

SEQ ID NO: 99007 - protein, 66 aa, Homo sapiens
  Payload ID: 19757
  Gene Name: zinc finger protein 12
  ENSP ID: ENSP00000378375
MNKSLGPVSFKDVAVDFTQEEWQQLDPEQKITYRDVMLENYSNLVSGITLSNRMLSASWSKEKSHG

SEQ ID NO: 99008 - protein, 623 aa, Homo sapiens
  Payload ID: 19757
  Gene Name: zinc finger protein 12
  Uniprot ID: P17014
  ENSP ID: ENSP00000384405
MLENYSNLVSVGYHIIKPDVISKLEQGEEPWIVEGEFLLQSYPDEVWQTDDLIERIQEEENKPSRQTVFIETLIEEREYISSDGSYARMKADECSGCGKSLLHIKLEKTHPGDQAYEFNQNGEPYTLNEESLYQKIRILEKPFEYIECQKAFQKDTVFVNHMEEKPYKWNGSEIAFLQMSDLTVHQTSHMEMKPYECSECGKSFCKKSKFIIHQRTHTGEKPYECNQCGKSFCQKGTLTVHQRTHTGEKPYECNECGKNFYQKLHLIQHQRTHSGEKPYECSYCGKSFCQKTHLTQHQRTHSGERPYVCHDCGKTFSQKSALNDHQKIHTGVKLYKCSECGKCFCRKSTLTTHLRTHTGEKPYECNECGKFFSRLSYLTVHYRTHSGEKPYECNECGKTFYLNSALMRHQRVHTGEKPYECNECGKLFSQLSYLTIHHRTHSGVKPYECSECGKTFYQNSALCRHRRIHKGEKPYECYICGKFFSQMSYLTIHHRIHSGEKPYECSECGKTFCQNSALNRHQRTHTGEKAYECYECGKCFSQMSYLTIHHRIHSGEKPFECNECGKAFSRMSYLTVHYRTHSGEKPYECTECGKKFYHKSAFNSHQRIHRRGNMNVIDVGRLL

SEQ ID NO: 99009 - protein, 697 aa, Homo sapiens
  Payload ID: 19757
  Gene Name: zinc finger protein 12
  Uniprot ID: P17014
  ENSP ID: ENSP00000385939
MNKSLGPVSFKDVAVDFTQEEWQQLDPEQKITYRDVMLENYSNLVSVGYHIIKPDVISKLEQGEEPWIVEGEFLLQSYPDEVWQTDDLIERIQEEENKPSRQTVFIETLIEERGNVPGKTFDVETNPVPSRKIAYKNSLCDSCEKCLTSVSEYISSDGSYARMKADECSGCGKSLLHIKLEKTHPGDQAYEFNQNGEPYTLNEESLYQKIRILEKPFEYIECQKAFQKDTVFVNHMEEKPYKWNGSEIAFLQMSDLTVHQTSHMEMKPYECSECGKSFCKKSKFIIHQRTHTGEKPYECNQCGKSFCQKGTLTVHQRTHTGEKPYECNECGKNFYQKLHLIQHQRTHSGEKPYECSYCGKSFCQKTHLTQHQRTHSGERPYVCHDCGKTFSQKSALNDHQKIHTGVKLYKCSECGKCFCRKSTLTTHLRTHTGEKPYECNECGKFFSRLSYLTVHYRTHSGEKPYECNECGKTFYLNSALMRHQRVHTGEKPYECNECGKLFSQLSYLTIHHRTHSGVKPYECSECGKTFYQNSALCRHRRIHKGEKPYECYICGKFFSQMSYLTIHHRIHSGEKPYECSECGKTFCQNSALNRHQRTHTGEKAYECYECGKCFSQMSYLTIHHRIHSGEKPFECNECGKAFSRMSYLTVHYRTHSGEKPYECTECGKKFYHKSAFNSHQRIHRRGNMNVIDVGRLL

SEQ ID NO: 99010 - protein, 390 aa, Homo sapiens
  Payload ID: 19758
  Gene Name: zinc finger protein 121
  Uniprot ID: P58317
  ENSP ID: ENSP00000326967
MAEIHNGGELCDFMENGEIFSEHSCLNAHMGTENTGDTYDCDEYGENFPMLHNSAPAGETLSVLNQCRKAFSLPPNVHQRTWIGDKSFEYSDCEEAFVDQSHLQANRITHNGETLYEQKQCGRAFTYSTSHAVSVKMHTVEKPYECKECGKFFRYSSYLNSHMRTHTGEKPYECKECGKCFTVSSHLVEHVRIHTGEKPYQCKECGRAFAGRSGLTKHVRIHTGEKPYECNECGKAYNRFYLLTEHFKTHTEEKPFECKVCGKSFRSSSCLKNHFRIHTGIKPYKCKECGKAFTVSSSLHNHVKIHTGEKPYECKDCGKAFATSSQLIEHIRTHTGEKPYICKECGKTFRASSHLQKHVRIHTGEKPYICNECGKAYNRFYLLTKHLKTH

SEQ ID NO: 99011 - protein, 151 aa, Homo sapiens
  Payload ID: 19758
  Gene Name: zinc finger protein 121
  ENSP ID: ENSP00000467838
MAEIHNGGELCDFMENGEIFSEHSCLNAHMGTENTGDTYDCDEYGENFPMLHNSAPAGETLSVLNQCRKAFSLPPNVHQRTWIGDKSFEYSDCEEAFVDQSHLQANRITHNGETLYEQKQCGRAFTYSTSHAVSVKMHTVEKPYECKECGK

SEQ ID NO: 99012 - protein, 390 aa, Homo sapiens; identical to SEQ ID NO: 99010
  Payload ID: 19758
  Gene Name: zinc finger protein 121
  Uniprot ID: P58317
  ENSP ID: ENSP00000468643

SEQ ID NO: 99013 - protein, 289 aa, Homo sapiens
  Payload ID: 19759
  Gene Name: zinc finger protein 124
  Uniprot ID: Q15973
  ENSP ID: ENSP00000340749
MSGHPGSWEMNSVAFEDVAVNFTQEEWALLDPSQKNLYRDVMQETFRNLASIGNKGEDQSIEDQYKNSSRNLSSFQIHQRNHTGEKPYECMECGKALGFSRSLNRHKRIHTGEKRYECKQCGKAFSRSSHLRDHERTHTGEKPYECKHCGKAFRYSNCLHYHERTHTGEKPYVCMECGKAFSCLSSLQGHIKAHAGEEPYPCKQCGKAFRYASSLQKHEKTHIAQKPYVCNNCGKGFRCSSSLRDHERTHTGEKPYECQKCGKAFSRASTLWKHKKTHTGEKPYKCKKM

SEQ ID NO: 99014 - protein, 351 aa, Homo sapiens
  Payload ID: 19759
  Gene Name: zinc finger protein 124
  Uniprot ID: Q15973
  ENSP ID: ENSP00000440365
MSGHPGSWEMNSVAFEDVAVNFTQEEWALLDPSQKNLYRDVMQETFRNLASIGNKGEDQSIEDQYKNSSRNLRHIISHSGNNPYGCEECGKKPCTCKQCQKTSLSVTRVHRDTVMHTGNGHYGCTICEKVFNIPSSFQIHQRNHTGEKPYECMECGKALGFSRSLNRHKRIHTGEKRYECKQCGKAFSRSSHLRDHERTHTGEKPYECKHCGKAFRYSNCLHYHERTHTGEKPYVCMECGKAFSCLSSLQGHIKAHAGEEPYPCKQCGKAFRYASSLQKHEKTHIAQKPYVCNNCGKGFRCSSSLRDHERTHTGEKPYECQKCGKAFSRASTLWKHKKTHTGEKPYKCKKM

SEQ ID NO: 99015 - protein, 73 aa, Homo sapiens
  Payload ID: 19759
  Gene Name: zinc finger protein 124
  Uniprot ID: Q15973
  ENSP ID: ENSP00000462445
MSGHPGSWEMNSVAFEDVAVNFTQEEWALLDPSQKNLYRDVMQETFRNLASIGNKGEDQSIEDQYKNSSRNLR

SEQ ID NO: 99016 - protein, 77 aa, Homo sapiens
  Payload ID: 19759
  Gene Name: zinc finger protein 124
  ENSP ID: ENSP00000463191
MSGHPGSWEMNSVAFEDVAVNFTQEEWALLDPSQKNLYRDVMQETFRNLASIGNKGEDQSIEDQYKNSSRNLRCTGS

SEQ ID NO: 99017 - protein, 589 aa, Homo sapiens
  Payload ID: 19760
  Gene Name: zinc finger protein 131
  Uniprot ID: P52739
  ENSP ID: ENSP00000305804
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGKNEAKKRKIAETSNVITESLPSAESEPVEIEVEIAEGTIEVEDEGIETLEEVASAKQSVKYIQSTGSSDDSALALLADITSKYRQGDRKGQIKEDGCPSDPTSKQEHMKSHSTESFKCEICNKRYLRESAWKQHLNCYHLEEGGVSKKQRTGKKIHVCQYCEKQFDHFGHFKEHLRKHTGEKPFECPNCHERFARNSTLKCHLTACQTGVGAKKGRKKLYECQVCNSVFNSWDQFKDHLVIHTGDKPNHCTLCDLWFMQGNELRRHLSDAHNISERLVTEEVLSVETRVQTEPVTSMTIIEQVGKVHVLPLLQVQVDSAQVTVEQVHPDLLQDSQVHDSHMSELPEQVQVSYLEVGRIQTEEGTEVHVEELHVERVNQMPVEVQTELLEADLDHVTPEIMNQEERESSQADAAEAAREDHEDAEDLETKPTVDSEAEKAENEDRTALPVLE

SEQ ID NO: 99018 - protein, 589 aa, Homo sapiens; identical to SEQ ID NO: 99017
  Payload ID: 19760
  Gene Name: zinc finger protein 131
  Uniprot ID: P52739
  ENSP ID: ENSP00000421246

SEQ ID NO: 99019 - protein, 264 aa, Homo sapiens
  Payload ID: 19760
  Gene Name: zinc finger protein 131
  ENSP ID: ENSP00000422079
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGKNEAKKRKIAETSNVITESLPSAESEPVEIEVEIAEGTIEVEDEGIETLEEVASAKQSVKYIQSTGSSDDSALALLADITSKYRQGDRKGQIKEDGCPSDPTSKQEHMKSHSTESFKCEICNKRYL

SEQ ID NO: 99020 - protein, 151 aa, Homo sapiens
  Payload ID: 19760
  Gene Name: zinc finger protein 131
  ENSP ID: ENSP00000422659
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGKNEAKKRKIAETS

SEQ ID NO: 99021 - protein, 68 aa, Homo sapiens
  Payload ID: 19760
  Gene Name: zinc finger protein 131
  ENSP ID: ENSP00000423254
  MOD_RES (1)..(1): Any amino acid
XKKQRTGKKIHVCQYCEKQFDHFGHFKEHLRKHTVLDAKKFTVMRPHLVRALPVATLQSPEAMQGITW

SEQ ID NO: 99022 - protein, 589 aa, Homo sapiens; identical to SEQ ID NO: 99017
  Payload ID: 19760
  Gene Name: zinc finger protein 131
  Uniprot ID: P52739
  ENSP ID: ENSP00000423945

SEQ ID NO: 99023 - protein, 139 aa, Homo sapiens
  Payload ID: 19760
  Gene Name: zinc finger protein 131
  ENSP ID: ENSP00000424771
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGK

SEQ ID NO: 99024 - protein, 83 aa, Homo sapiens
  Payload ID: 19760
  Gene Name: zinc finger protein 131
  ENSP ID: ENSP00000425139
MEAEETMECLQEFPEHHKMILDRLNEQREQDRFTDITLIVDGHHFKAHKAVLAACSKFFYKFFQEFTQEPLVEIEGTKKTQLP

SEQ ID NO: 99025 - protein, 253 aa, Homo sapiens
  Payload ID: 19760
  Gene Name: zinc finger protein 131
  ENSP ID: ENSP00000425623
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGKNEAKKRKIAETSNVITESLPSAESEPVEIEVEIAEGTIEVEDEGIETLEEVASAKQSVKYIQSTGSSDDSALALLADITSKYRQGDRKGQIKEDGCPSDPTSKQVEGAHEITLH

SEQ ID NO: 99026 - protein, 66 aa, Homo sapiens
  Payload ID: 19760
  Gene Name: zinc finger protein 131
  ENSP ID: ENSP00000425722
MEAEETMECLQEFPEHHKMILDRLNEQREQDRFTDITLIVDGHHFKAHKAVLAACSHVLPQIFSIL

SEQ ID NO: 99027 - protein, 623 aa, Homo sapiens
  Payload ID: 19760
  Gene Name: zinc finger protein 131
  Uniprot ID: P52739
  ENSP ID: ENSP00000426504
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGKNEAKKRKIAETSNVITESLPSAESEPVEIEVEIAEGTIEVEDEGIETLEEVASAKQSVKYIQSTGSSDDSALALLADITSKYRQGDRKGQIKEDGCPSDPTSKQVEGIEIVELQLSHVKDLFHCEKCNRSFKLFYHFKEHMKSHSTESFKCEICNKRYLRESAWKQHLNCYHLEEGGVSKKQRTGKKIHVCQYCEKQFDHFGHFKEHLRKHTGEKPFECPNCHERFARNSTLKCHLTACQTGVGAKKGRKKLYECQVCNSVFNSWDQFKDHLVIHTGDKPNHCTLCDLWFMQGNELRRHLSDAHNISERLVTEEVLSVETRVQTEPVTSMTIIEQVGKVHVLPLLQVQVDSAQVTVEQVHPDLLQDSQVHDSHMSELPEQVQVSYLEVGRIQTEEGTEVHVEELHVERVNQMPVEVQTELLEADLDHVTPEIMNQEERESSQADAAEAAREDHEDAEDLETKPTVDSEAEKAENEDRTALPVLE

SEQ ID NO: 99028 - protein, 124 aa, Homo sapiens
  Payload ID: 19760
  Gene Name: zinc finger protein 131
  ENSP ID: ENSP00000426614
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVR

SEQ ID NO: 99029 - protein, 79 aa, Homo sapiens
  Payload ID: 19760
  Gene Name: zinc finger protein 131
  ENSP ID: ENSP00000427003
MGSRYVPRLASNSWAELLLPNSASQSAGITSVSHRARPHLFLQSSPTAMEAEETMECLQEFPEHHKMILDRLNEQREQD

SEQ ID NO: 99030 - protein, 706 aa, Homo sapiens
  Payload ID: 19761
  Gene Name: zinc finger protein 132
  Uniprot ID: P52740
  ENSP ID: ENSP00000254166
MALPSPQVLMGLPALLMGPAQHTSWPCGSAVPTLKSMVTFEDVAVYFSQEEWELLDAAQRHLYHSVMLENLELVTSLGSWHGVEGEGAHPKQNVSVEVLQVRIPNADPSTKKANSCDMCGPFLKDILHLAEHQGTQSEEKPYTCGACGRDFWLNANLHQHQKEHSGGKPFRWYKDRDALMKSSKVHLSENPFTCREGGKVILGSCDLLQLQAVDSGQKPYSNLGQLPEVCTTQKLFECSNCGKAFLKSSTLPNHLRTHSEEIPFTCPTGGNFLEEKSILGNKKFHTGEIPHVCKECGKAFSHSSKLRKHQKFHTEVKYYECIACGKTFNHKLTFVHHQRIHSGERPYECDECGKAFSNRSHLIRHEKVHTGERPFECLKCGRAFSQSSNFLRHQKVHTQVRPYECSQCGKSFSRSSALIQHWRVHTGERPYECSECGRAFNNNSNLAQHQKVHTGERPFECSECGRDFSQSSHLLRHQKVHTGERPFECCDCGKAFSNSSTLIQHQKVHTGQRPYECSECRKSFSRSSSLIQHWRIHTGEKPYECSECGKAFAHSSTLIEHWRVHTKERPYECNECGKFFSQNSILIKHQKVHTGEKPYKCSECGKFFSRKSSLICHWRVHTGERPYECSECGRAFSSNSHLVRHQRVHTQERPYECIQCGKAFSERSTLVRHQKVHTRERTYECSQCGKLFSHLCNLAQHKKIHT

SEQ ID NO: 99031 - protein, 654 aa, Homo sapiens
  Payload ID: 19762
  Gene Name: zinc finger protein 133
  Uniprot ID: P52736
  ENSP ID: ENSP00000346090
MAFRDVAVDFTQDEWRLLSPAQRTLYREVMLENYSNLVSLGISFSKPELITQLEQGKETWREEKKCSPATCPADPEPELYLDPFCPPGFSSQKFPMQHVLCNHPPWIFTCLCAEGNIQPGDPGPGDQEKQQQASEGRPWSDQAEGPEGEGAMPLFGRTKKRTLGAFSRPPQRQPVSSRNGLRGVELEASPAQSGNPEETDKLLKRIEVLGFGTVNCGECGLSFSKMTNLLSHQRIHSGEKPYVCGVCEKGFSLKKSLARHQKAHSGEKPIVCRECGRGFNRKSTLIIHERTHSGEKPYMCSECGRGFSQKSNLIIHQRTHSGEKPYVCRECGKGFSQKSAVVRHQRTHLEEKTIVCSDCGLGFSDRSNLISHQRTHSGEKPYACKECGRCFRQRTTLVNHQRTHSKEKPYVCGVCGHSFSQNSTLISHRRTHTGEKPYVCGVCGRGFSLKSHLNRHQNIHSGEKPIVCKDCGRGFSQQSNLIRHQRTHSGEKPMVCGECGRGFSQKSNLVAHQRTHSGERPYVCRECGRGFSHQAGLIRHKRKHSREKPYMCRQCGLGFGNKSALITHKRAHSEEKPCVCRECGQGFLQKSHLTLHQMTHTGEKPYVCKTCGRGFSLKSHLSRHRKTTSVHHRLPVQPDPEPCAGQPSDSLYSL

SEQ ID NO: 99032 - protein, 99 aa, Homo sapiens
  Payload ID: 19762
  Gene Name: zinc finger protein 133
  ENSP ID: ENSP00000353105
MAFRDVAVDFTQDEWRLLSPAQRTLYREVMLENYSNLVSLGISFSKPELITQLEQGKETWREEKKCSPATCPDHQEYGNNCDLQKEADPEPELYLDPFC

SEQ ID NO: 99033 - protein, 653 aa, Homo sapiens
  Payload ID: 19762
  Gene Name: zinc finger protein 133
  Uniprot ID: P52736
  ENSP ID: ENSP00000366899
MAFRDVAVDFTQDEWRLLSPAQRTLYREVMLENYSNLVSLGISFSKPELITQLEQGKETWREEKKCSPATCPDPEPELYLDPFCPPGFSSQKFPMQHVLCNHPPWIFTCLCAEGNIQPGDPGPGDQEKQQQASEGRPWSDQAEGPEGEGAMPLFGRTKKRTLGAFSRPPQRQPVSSRNGLRGVELEASPAQSGNPEETDKLLKRIEVLGFGTVNCGECGLSFSKMTNLLSHQRIHSGEKPYVCGVCEKGFSLKKSLARHQKAHSGEKPIVCRECGRGFNRKSTLIIHERTHSGEKPYMCSECGRGFSQKSNLIIHQRTHSGEKPYVCRECGKGFSQKSAVVRHQRTHLEEKTIVCSDCGLGFSDRSNLISHQRTHSGEKPYACKECGRCFRQRTTLVNHQRTHSKEKPYVCGVCGHSFSQNSTLISHRRTHTGEKPYVCGVCGRGFSLKSHLNRHQNIHSGEKPIVCKDCGRGFSQQSNLIRHQRTHSGEKPMVCGECGRGFSQKSNLVAHQRTHSGERPYVCRECGRGFSHQAGLIRHKRKHSREKPYMCRQCGLGFGNKSALITHKRAHSEEKPCVCRECGQGFLQKSHLTLHQMTHTGEKPYVCKTCGRGFSLKSHLSRHRKTTSVHHRLPVQPDPEPCAGQPSDSLYSL

SEQ ID NO: 99034 - protein, 654 aa, Homo sapiens; identical to SEQ ID NO: 99031
  Payload ID: 19762
  Gene Name: zinc finger protein 133
  Uniprot ID: P52736
  ENSP ID: ENSP00000383945

SEQ ID NO: 99035 - protein, 591 aa, Homo sapiens
  Payload ID: 19762
  Gene Name: zinc finger protein 133
  Uniprot ID: P52736
  ENSP ID: ENSP00000385279
MCNGRKTVLADPEPELYLDPFCPPGFSSQKFPMQHVLCNHPPWIFTCLCAEGNIQPGDPGPGDQEKQQQASEGRPWSDQAEGPEGEGAMPLFGRTKKRTLGAFSRPPQRQPVSSRNGLRGVELEASPAQSGNPEETDKLLKRIEVLGFGTVNCGECGLSFSKMTNLLSHQRIHSGEKPYVCGVCEKGFSLKKSLARHQKAHSGEKPIVCRECGRGFNRKSTLIIHERTHSGEKPYMCSECGRGFSQKSNLIIHQRTHSGEKPYVCRECGKGFSQKSAVVRHQRTHLEEKTIVCSDCGLGFSDRSNLISHQRTHSGEKPYACKECGRCFRQRTTLVNHQRTHSKEKPYVCGVCGHSFSQNSTLISHRRTHTGEKPYVCGVCGRGFSLKSHLNRHQNIHSGEKPIVCKDCGRGFSQQSNLIRHQRTHSGEKPMVCGECGRGFSQKSNLVAHQRTHSGERPYVCRECGRGFSHQAGLIRHKRKHSREKPYMCRQCGLGFGNKSALITHKRAHSEEKPCVCRECGQGFLQKSHLTLHQMTHTGEKPYVCKTCGRGFSLKSHLSRHRKTTSVHHRLPVQPDPEPCAGQPSDSLYSL

SEQ ID NO: 99036 - protein, 653 aa, Homo sapiens; identical to SEQ ID NO: 99033
  Payload ID: 19762
  Gene Name: zinc finger protein 133
  Uniprot ID: P52736
  ENSP ID: ENSP00000400897

SEQ ID NO: 99037 - protein, 142 aa, Homo sapiens
  Payload ID: 19762
  Gene Name: zinc finger protein 133
  ENSP ID: ENSP00000403835
MAFRDVAVDFTQDEWRLLSPAQRTLYREVMLENYSNLVSLGISFSKPELITQLEQGKETWREEKKCSPATCPADPEPELYLDPFCPPGFSSQKFPMQHVLCNHPPWIFTCLCAEGNIQPGDPGPGDQEKQQQASEGRPWSDQ

SEQ ID NO: 99038 - protein, 179 aa, Homo sapiens
  Payload ID: 19762
  Gene Name: zinc finger protein 133
  ENSP ID: ENSP00000406638
MAFRDVAVDFTQDEWRLLSPAQRTLYREVMLENYSNLVSLGISFSKPELITQLEQGKETWREEKKCSPATCPADPEPELYLDPFCPPGFSSQKFPMQHVLCNHPPWIFTCLCAEGNIQPGDPGPGDQEKQQQASEGRPWSDQAEGPEGEGAMPLFGRTKKRTLGAFSRPPQRQPVSSRN

SEQ ID NO: 99039 - protein, 667 aa, Homo sapiens
  Payload ID: 19762
  Gene Name: zinc finger protein 133
  ENSP ID: ENSP00000439427
MGAAGLQGAPGGAEHPGRCGPGAVPRIRGSVVLAPRWRSSPAGGWSDPLFFGGAGISFSKPELITQLEQGKETWREEKKCSPATCPDPEPELYLDPFCPPGFSSQKFPMQHVLCNHPPWIFTCLCAEGNIQPGDPGPGDQEKQQQASEGRPWSDQAEGPEGEGAMPLFGRTKKRTLGAFSRPPQRQPVSSRNGLRGVELEASPAQSGNPEETDKLLKRIEVLGFGTVNCGECGLSFSKMTNLLSHQRIHSGEKPYVCGVCEKGFSLKKSLARHQKAHSGEKPIVCRECGRGFNRKSTLIIHERTHSGEKPYMCSECGRGFSQKSNLIIHQRTHSGEKPYVCRECGKGFSQKSAVVRHQRTHLEEKTIVCSDCGLGFSDRSNLISHQRTHSGEKPYACKECGRCFRQRTTLVNHQRTHSKEKPYVCGVCGHSFSQNSTLISHRRTHTGEKPYVCGVCGRGFSLKSHLNRHQNIHSGEKPIVCKDCGRGFSQQSNLIRHQRTHSGEKPMVCGECGRGFSQKSNLVAHQRTHSGERPYVCRECGRGFSHQAGLIRHKRKHSREKPYMCRQCGLGFGNKSALITHKRAHSEEKPCVCRECGQGFLQKSHLTLHQMTHTGEKPYVCKTCGRGFSLKSHLSRHRKTTSVHHRLPVQPDPEPCAGQPSDSLYSL

SEQ ID NO: 99040 - protein, 635 aa, Homo sapiens
  Payload ID: 19762
  Gene Name: zinc finger protein 133
  ENSP ID: ENSP00000442978
MGAAGLQGAPGGAEHPGRCGPGAVPRIRGSVVLAPRWRSSPAGGWSDPLFFGGADPEPELYLDPFCPPGFSSQKFPMQHVLCNHPPWIFTCLCAEGNIQPGDPGPGDQEKQQQASEGRPWSDQAEGPEGEGAMPLFGRTKKRTLGAFSRPPQRQPVSSRNGLRGVELEASPAQSGNPEETDKLLKRIEVLGFGTVNCGECGLSFSKMTNLLSHQRIHSGEKPYVCGVCEKGFSLKKSLARHQKAHSGEKPIVCRECGRGFNRKSTLIIHERTHSGEKPYMCSECGRGFSQKSNLIIHQRTHSGEKPYVCRECGKGFSQKSAVVRHQRTHLEEKTIVCSDCGLGFSDRSNLISHQRTHSGEKPYACKECGRCFRQRTTLVNHQRTHSKEKPYVCGVCGHSFSQNSTLISHRRTHTGEKPYVCGVCGRGFSLKSHLNRHQNIHSGEKPIVCKDCGRGFSQQSNLIRHQRTHSGEKPMVCGECGRGFSQKSNLVAHQRTHSGERPYVCRECGRGFSHQAGLIRHKRKHSREKPYMCRQCGLGFGNKSALITHKRAHSEEKPCVCRECGQGFLQKSHLTLHQMTHTGEKPYVCKTCGRGFSLKSHLSRHRKTTSVHHRLPVQPDPEPCAGQPSDSLYSL

SEQ ID NO: 99041 - protein, 654 aa, Homo sapiens; identical to SEQ ID NO: 99031
  Payload ID: 19762
  Gene Name: zinc finger protein 133
  Uniprot ID: P52736
  ENSP ID: ENSP00000481326

SEQ ID NO: 99042 - protein, 559 aa, Homo sapiens
  Payload ID: 19762
  Gene Name: zinc finger protein 133
  Uniprot ID: P52736
  ENSP ID: ENSP00000485741
MQHVLCNHPPWIFTCLCAEGNIQPGDPGPGDQEKQQQASEGRPWSDQAEGPEGEGAMPLFGRTKKRTLGAFSRPPQRQPVSSRNGLRGVELEASPAQSGNPEETDKLLKRIEVLGFGTVNCGECGLSFSKMTNLLSHQRIHSGEKPYVCGVCEKGFSLKKSLARHQKAHSGEKPIVCRECGRGFNRKSTLIIHERTHSGEKPYMCSECGRGFSQKSNLIIHQRTHSGEKPYVCRECGKGFSQKSAVVRHQRTHLEEKTIVCSDCGLGFSDRSNLISHQRTHSGEKPYACKECGRCFRQRTTLVNHQRTHSKEKPYVCGVCGHSFSQNSTLISHRRTHTGEKPYVCGVCGRGFSLKSHLNRHQNIHSGEKPIVCKDCGRGFSQQSNLIRHQRTHSGEKPMVCGECGRGFSQKSNLVAHQRTHSGERPYVCRECGRGFSHQAGLIRHKRKHSREKPYMCRQCGLGFGNKSALITHKRAHSEEKPCVCRECGQGFLQKSHLTLHQMTHTGEKPYVCKTCGRGFSLKSHLSRHRKTTSVHHRLPVQPDPEPCAGQPSDSLYSL

SEQ ID NO: 99043 - protein, 47 aa, Homo sapiens
  Payload ID: 19762
  Gene Name: zinc finger protein 133
  ENSP ID: ENSP00000486044
MAFRDVAVDFTQDEWRLLSPAQRTLYREVMLENYSNLVSLVTYFLFL

SEQ ID NO: 99044 - protein, 657 aa, Homo sapiens
  Payload ID: 19762
  Gene Name: zinc finger protein 133
  Uniprot ID: P52736
  ENSP ID: ENSP00000487315
MAHMAFRDVAVDFTQDEWRLLSPAQRTLYREVMLENYSNLVSLGISFSKPELITQLEQGKETWREEKKCSPATCPADPEPELYLDPFCPPGFSSQKFPMQHVLCNHPPWIFTCLCAEGNIQPGDPGPGDQEKQQQASEGRPWSDQAEGPEGEGAMPLFGRTKKRTLGAFSRPPQRQPVSSRNGLRGVELEASPAQSGNPEETDKLLKRIEVLGFGTVNCGECGLSFSKMTNLLSHQRIHSGEKPYVCGVCEKGFSLKKSLARHQKAHSGEKPIVCRECGRGFNRKSTLIIHERTHSGEKPYMCSECGRGFSQKSNLIIHQRTHSGEKPYVCRECGKGFSQKSAVVRHQRTHLEEKTIVCSDCGLGFSDRSNLISHQRTHSGEKPYACKECGRCFRQRTTLVNHQRTHSKEKPYVCGVCGHSFSQNSTLISHRRTHTGEKPYVCGVCGRGFSLKSHLNRHQNIHSGEKPIVCKDCGRGFSQQSNLIRHQRTHSGEKPMVCGECGRGFSQKSNLVAHQRTHSGERPYVCRECGRGFSHQAGLIRHKRKHSREKPYMCRQCGLGFGNKSALITHKRAHSEEKPCVCRECGQGFLQKSHLTLHQMTHTGEKPYVCKTCGRGFSLKSHLSRHRKTTSVHHRLPVQPDPEPCAGQPSDSLYSL

SEQ ID NO: 99045 - protein, 427 aa, Homo sapiens
  Payload ID: 19763
  Gene Name: zinc finger protein 134
  Uniprot ID: P52741
  ENSP ID: ENSP00000379464
MTLVTAGGAWTGPGCWHEVKDEESSSEQSISIAVSHVNTSKAGLPAQTALPCDICGPILKDILHLDEHQGTHHGLKLHTCGACGRQFWFSANLHQYQKCYSIEQPLRRDKSEASIVKNCTVSKEPHPSEKPFTCKEEQKNFQATLGGCQQKAIHSKRKTHRSTESGDAFHGEQMHYKCSECGKAFSRKDTLVQHQRIHSGEKPYECSECGKAFSRKATLVQHQRIHTGERPYECSECGKTFSRKDNLTQHKRIHTGEMPYKCNECGKYFSHHSNLIVHQRVHNGARPYKCSDCGKVFRHKSTLVQHESIHTGENPYDCSDCGKSFGHKYTLIKHQRIHTESKPFECIECGKFFSRSSDYIAHQRVHTGERPFVCSKCGKDFIRTSHLVRHQRVHTGERPYECSECGKAYSLSSHLNRHQKVHTAGRL

SEQ ID NO: 99046 - protein, 66 aa, Homo sapiens
  Payload ID: 19763
  Gene Name: zinc finger protein 134
  ENSP ID: ENSP00000469065
MTLVTAGGAWTGPGCWHEVKDEESSSEQSISIAVSHVNTSKAGLPAQTALPCDICGPILKDILHLD

SEQ ID NO: 99047 - protein, 46 aa, Homo sapiens
  Payload ID: 19763
  Gene Name: zinc finger protein 134
  ENSP ID: ENSP00000472314
MTLVTAGGAWTGPGEWELRDAITSGLGSCSSGNLCCAHHKCQGQRP

SEQ ID NO: 99048 - protein, 348 aa, Homo sapiens
  Payload ID: 19763
  Gene Name: zinc finger protein 134
  Uniprot ID: P52741
  ENSP ID: ENSP00000481521
MWGMWETILVQCNLHQYQKCYSIEQPLRRDKSEASIVKNCTVSKEPHPSEKPFTCKEEQKNFQATLGGCQQKAIHSKRKTHRSTESGDAFHGEQMHYKCSECGKAFSRKDTLVQHQRIHSGEKPYECSECGKAFSRKATLVQHQRIHTGERPYECSECGKTFSRKDNLTQHKRIHTGEMPYKCNECGKYFSHHSNLIVHQRVHNGARPYKCSDCGKVFRHKSTLVQHESIHTGENPYDCSDCGKSFGHKYTLIKHQRIHTESKPFECIECGKFFSRSSDYIAHQRVHTGERPFVCSKCGKDFIRTSHLVRHQRVHTGERPYECSECGKAYSLSSHLNRHQKVHTAGRL

SEQ ID NO: 99049 - protein, 658 aa, Homo sapiens
  Payload ID: 19764
  Gene Name: zinc finger protein 135
  Uniprot ID: P52742
  ENSP ID: ENSP00000321406
MTPGVRVSTDPEQVTFEDVVVGFSQEEWGQLKPAQRTLYRDVMLDTFRLLVSVGHWLPKPNVISLLEQEAELWAVESRLPQGVYPDLETRPKVKLSVLKQGISEEISNSVILVERFLWDGLWYCRGEDTEGHWEWSCESLESLAVPVAFTPVKTPVLEQWQRNGFGENISLNPDLPHQPMTPERQSPHTWGTRGKREKPDLNVLQKTCVKEKPYKCQECGKAFSHSSALIEHHRTHTGERPYECHECLKGFRNSSALTKHQRIHTGEKPYKCTQCGRTFNQIAPLIQHQRTHTGEKPYECSECGKSFSFRSSFSQHERTHTGEKPYECSECGKAFRQSIHLTQHLRIHTGEKPYQCGECGKAFSHSSSLTKHQRIHTGEKPYECHECGKAFTQITPLIQHQRTHTGEKPYECGECGKAFSQSTLLTEHRRIHTGEKPYGCNECGKTFSHSSSLSQHERTHTGEKPYECSQCGKAFRQSTHLTQHQRIHTGEKPYECNDCGKAFSHSSSLTKHQRIHTGEKPYECNQCGRAFSQLAPLIQHQRIHTGEKPYECNQCGRAFSQSSLLIEHQRIHTKEKPYGCNECGKSFSHSSSLSQHERTHTGEKPYECHDCGKSFRQSTHLTQHRRIHTGEKPYACRDCGKAFTHSSSLTKHQRTHTG

SEQ ID NO: 99050 - protein, 390 aa, Homo sapiens
  Payload ID: 19764
  Gene Name: zinc finger protein 135
  Uniprot ID: P52742
  ENSP ID: ENSP00000369437
MELGSRRRSVGCRCRGLCLAVRREQVTFEDVVVGFSQEEWGQLKPAQRTLYRDVMLDTFRLLVSVGHWLPKPNVISLLEQEAELWAVESRLPQGVYPDLETRPKVKLSVLKQGISEEISNSVILVERFLWDGLWYCRGEDTEGHWEWSCESLESLAVPVAFTPVKTPVLEQWQRNGFGENISLNPDLPHQPMTPERQSPHTWGTRGKREKPDLNVLQKTCVKEKPYKCQECGKAFSHSSALIEHHRTHTGERPYECHECLKGFRNSSALTKHQRIHTGEKPYKCTQCGRTFNQIAPLIQHQRTHTGEKPYECSECGKSFSFRSSFSQHERTHTGEKPYECSECGKAFRQSIHLTQHLRIHTGEKPYQCGECGKAFTHSSSLTKHQRTHTG

SEQ ID NO: 99051 - protein, 670 aa, Homo sapiens
  Payload ID: 19764
  Gene Name: zinc finger protein 135
  Uniprot ID: P52742
  ENSP ID: ENSP00000422074
MTPGVRVSTDPEQVTFEDVVVGFSQEEWGQLKPAQRTLYRDVMLDTFRLLVSVGHWLPKPNVISLLEQEAELWAVESRLPQGVYPEIKGHFQFLLLSDLETRPKVKLSVLKQGISEEISNSVILVERFLWDGLWYCRGEDTEGHWEWSCESLESLAVPVAFTPVKTPVLEQWQRNGFGENISLNPDLPHQPMTPERQSPHTWGTRGKREKPDLNVLQKTCVKEKPYKCQECGKAFSHSSALIEHHRTHTGERPYECHECLKGFRNSSALTKHQRIHTGEKPYKCTQCGRTFNQIAPLIQHQRTHTGEKPYECSECGKSFSFRSSFSQHERTHTGEKPYECSECGKAFRQSIHLTQHLRIHTGEKPYQCGECGKAFSHSSSLTKHQRIHTGEKPYECHECGKAFTQITPLIQHQRTHTGEKPYECGECGKAFSQSTLLTEHRRIHTGEKPYGCNECGKTFSHSSSLSQHERTHTGEKPYECSQCGKAFRQSTHLTQHQRIHTGEKPYECNDCGKAFSHSSSLTKHQRIHTGEKPYECNQCGRAFSQLAPLIQHQRIHTGEKPYECNQCGRAFSQSSLLIEHQRIHTKEKPYGCNECGKSFSHSSSLSQHERTHTGEKPYECHDCGKSFRQSTHLTQHRRIHTGEKPYACRDCGKAFTHSSSLTKHQRTHTG

SEQ ID NO: 99052 - protein, 616 aa, Homo sapiens
  Payload ID: 19764
  Gene Name: zinc finger protein 135
  ENSP ID: ENSP00000427691
MLDTFRLLVSVGHWLPKPNVISLLEQEAELWAVESRLPQGVYPDLETRPKVKLSVLKQGISEEISNSVILVERFLWDGLWYCRGEDTEGHWEWSCESLESLAVPVAFTPVKTPVLEQWQRNGFGENISLNPDLPHQPMTPERQSPHTWGTRGKREKPDLNVLQKTCVKEKPYKCQECGKAFSHSSALIEHHRTHTGERPYECHECLKGFRNSSALTKHQRIHTGEKPYKCTQCGRTFNQIAPLIQHQRTHTGEKPYECSECGKSFSFRSSFSQHERTHTGEKPYECSECGKAFRQSIHLTQHLRIHTGEKPYQCGECGKAFSHSSSLTKHQRIHTGEKPYECHECGKAFTQITPLIQHQRTHTGEKPYECGECGKAFSQSTLLTEHRRIHTGEKPYGCNECGKTFSHSSSLSQHERTHTGEKPYECSQCGKAFRQSTHLTQHQRIHTGEKPYECNDCGKAFSHSSSLTKHQRIHTGEKPYECNQCGRAFSQLAPLIQHQRIHTGEKPYECNQCGRAFSQSSLLIEHQRIHTKEKPYGCNECGKSFSHSSSLSQHERTHTGEKPYECHDCGKSFRQSTHLTQHRRIHTGEKPYACRDCGKAFTHSSSLTKHQRTHTG

SEQ ID NO: 99053 - protein, 682 aa, Homo sapiens
  Payload ID: 19764
  Gene Name: zinc finger protein 135
  Uniprot ID: P52742
  ENSP ID: ENSP00000441410
MELGSRRRSVGCRCRGLCLAVRREQVTFEDVVVGFSQEEWGQLKPAQRTLYRDVMLDTFRLLVSVGHWLPKPNVISLLEQEAELWAVESRLPQGVYPEIKGHFQFLLLSDLETRPKVKLSVLKQGISEEISNSVILVERFLWDGLWYCRGEDTEGHWEWSCESLESLAVPVAFTPVKTPVLEQWQRNGFGENISLNPDLPHQPMTPERQSPHTWGTRGKREKPDLNVLQKTCVKEKPYKCQECGKAFSHSSALIEHHRTHTGERPYECHECLKGFRNSSALTKHQRIHTGEKPYKCTQCGRTFNQIAPLIQHQRTHTGEKPYECSECGKSFSFRSSFSQHERTHTGEKPYECSECGKAFRQSIHLTQHLRIHTGEKPYQCGECGKAFSHSSSLTKHQRIHTGEKPYECHECGKAFTQITPLIQHQRTHTGEKPYECGECGKAFSQSTLLTEHRRIHTGEKPYGCNECGKTFSHSSSLSQHERTHTGEKPYECSQCGKAFRQSTHLTQHQRIHTGEKPYECNDCGKAFSHSSSLTKHQRIHTGEKPYECNQCGRAFSQLAPLIQHQRIHTGEKPYECNQCGRAFSQSSLLIEHQRIHTKEKPYGCNECGKSFSHSSSLSQHERTHTGEKPYECHDCGKSFRQSTHLTQHRRIHTGEKPYACRDCGKAFTHSSSLTKHQRTHTG

SEQ ID NO: 99054 - protein, 73 aa, Homo sapiens
  Payload ID: 19764
  Gene Name: zinc finger protein 135
  ENSP ID: ENSP00000471344
MTPGVRVSTDPEQVTFEDVVVGFSQEEWGQLKPAQRTLYRDVMLDTFRLLVSVGSCSVTQAGVQWLNLSSLQP

SEQ ID NO: 99055 - protein, 540 aa, Homo sapiens
  Payload ID: 19765
  Gene Name: zinc finger protein 136
  Uniprot ID: P52737
  ENSP ID: ENSP00000344162
MDSVAFEDVDVNFTQEEWALLDPSQKNLYRDVMWETMRNLASIGKKWKDQNIKDHYKHRGRNLRSHMLERLYQTKDGSQRGGIFSQFANQNLSKKIPGVKLCESIVYGEVSMGQSSLNRHIKDHSGHEPKEYQEYGEKPDTRNQCWKPFSSHHSFRTHEIIHTGEKLYDCKECGKTFFSLKRIRRHIITHSGYTPYKCKVCGKAFDYPSRFRTHERSHTGEKPYECQECGKAFTCITSVRRHMIKHTGDGPYKCKVCGKPFHSLSSFQVHERIHTGEKPFKCKQCGKAFSCSPTLRIHERTHTGEKPYECKQCGKAFSYLPSLRLHERIHTGEKPFVCKQCGKAFRSASTFQIHERTHTGEKPYECKECGEAFSCIPSMRRHMIKHTGEGPYKCKVCGKPFHSLSPFRIHERTHTGEKPYVCKHCGKAFVSSTSIRIHERTHTGEKPYECKQCGKAFSYLNSFRTHEMIHTGEKPFECKRCGKAFRSSSSFRLHERTHTGQKPYHCKECGKAYSCRASFQRHMLTHAEDGPPYKCMWESL

SEQ ID NO: 99056 - protein, 89 aa, Homo sapiens
  Payload ID: 19765
  Gene Name: zinc finger protein 136
  ENSP ID: ENSP00000388759
MLERLYQTKDGSQRGGIFSQFANQNLSKKIPGVKLCESIVYGEVSMGQSSLNRHIKDHSGHEPKEYQEYGEKPDTRNQCWKPFSSHHSF

SEQ ID NO: 99057 - protein, 26 aa, Homo sapiens
  Payload ID: 19765
  Gene Name: zinc finger protein 136
  ENSP ID: ENSP00000397176
MWETMRNLASIGKKWKDQNIKDHYKH

SEQ ID NO: 99058 - protein, 42 aa, Homo sapiens
  Payload ID: 19765
  Gene Name: zinc finger protein 136
  ENSP ID: ENSP00000403707
MWETMRNLASIGKKWKDQNIKDHYKHRGRNLRSHMLERLYQT

SEQ ID NO: 99059 - protein, 319 aa, Homo sapiens
  Payload ID: 19766
  Gene Name: zinc finger protein 138
  ENSP ID: ENSP00000303533
MGPLTFMDVAIEFSLEEWQCLDTAQRNVYRHVMLENYRNLVFLDLITCLEQGKEPWNMKRHEMVVAKHSALCSRFAQDLWLEQNIKDSFQKVTLSRYGKYGHKNLQLRKGCKSVDECKGHQGGFNGLNQCLKITTSKIFQCNKYVKVMHKFSNSNRHKIRHTENKHFRCKECDKSLCMLSRLTQHKKIHTRENFYKCEECGKTFNWSTNLSKPKKIHTGEKPYKCEVCGKAFHQSSILTKHKIIRTGEKPYKCAHCGKAFKQSSHLTRHKIIHTEEKPYKCEQCGKVFKQSPTLTKHQIIYTGEEPYKCEECGKAFNLS

SEQ ID NO: 99060 - protein, 100 aa, Homo sapiens
  Payload ID: 19766
  Gene Name: zinc finger protein 138
  ENSP ID: ENSP00000352770
MGPLTFMDVAIEFSLEEWQCLDTAQRNVYRHVMLENYRNLVFLAVAFTFDLSGLNILSFQSILPFVSALYVMGNRNQCLQKHLEARNKDLCVLVLPKTFG

SEQ ID NO: 99061 - protein, 287 aa, Homo sapiens
  Payload ID: 19766
  Gene Name: zinc finger protein 138
  ENSP ID: ENSP00000399528
MDVAIEFSLEEWQCLDTAQRNVYRHVMLENYRNLVFLALCSRFAQDLWLEQNIKDSFQKVTLSRYGKYGHKNLQLRKGCKSVDECKGHQGGFNGLNQCLKITTSKIFQCNKYVKVMHKFSNSNRHKIRHTENKHFRCKECDKSLCMLSRLTQHKKIHTRENFYKCEECGKTFNWSTNLSKPKKIHTGEKPYKCEVCGKAFHQSSILTKHKIIRTGEKPYKCAHCGKAFKQSSHLTRHKIIHTEEKPYKCEQCGKVFKQSPTLTKHQIIYTGEEPYKCEECGKAFNLS

SEQ ID NO: 99062 - protein, 293 aa, Homo sapiens
  Payload ID: 19766
  Gene Name: zinc finger protein 138
  Uniprot ID: P52744
  ENSP ID: ENSP00000407262
MGPLTFMDVAIEFSLEEWQCLDTAQRNVYRHVMLENYRNLVFLALCSRFAQDLWLEQNIKDSFQKVTLSRYGKYGHKNLQLRKGCKSVDECKGHQGGFNGLNQCLKITTSKIFQCNKYVKVMHKFSNSNRHKIRHTENKHFRCKECDKSLCMLSRLTQHKKIHTRENFYKCEECGKTFNWSTNLSKPKKIHTGEKPYKCEVCGKAFHQSSILTKHKIIRTGEKPYKCAHCGKAFKQSSHLTRHKIIHTEEKPYKCEQCGKVFKQSPTLTKHQIIYTGEEPYKCEECGKAFNLS

SEQ ID NO: 99063 - protein, 62 aa, Homo sapiens
  Payload ID: 19766
  Gene Name: zinc finger protein 138
  ENSP ID: ENSP00000415995
MGPLTFMDVAIEFSLEEWQCLDTAQRNVYRHVMLENYRNLVFLARPDYLSGTRKRALEYEET

SEQ ID NO: 99064 - protein, 126 aa, Homo sapiens
  Payload ID: 19766
  Gene Name: zinc finger protein 138
  ENSP ID: ENSP00000419197
MGPLTFMDVAIEFSLEEWQCLDTAQRNVYRHVMLENYRNLVFLDLITCLEQGKEPWNMKRHEMVVAKHSAVAFTFDLSGLNILSFQSILPFVSALYVMGNRNQCLQKHLEARNKDLCVLVLPKTFG

SEQ ID NO: 99065 - protein, 642 aa, Homo sapiens
  Payload ID: 19767
  Gene Name: zinc finger protein 14
  Uniprot ID: P17017
  ENSP ID: ENSP00000340514
MDSVSFEDVAVNFTLEEWALLDSSQKKLYEDVMQETFKNLVCLGKKWEDQDIEDDHRNQGKNRRCHMVERLCESRRGSKCGETTSQMPNVNINKETFTGAKPHECSFCGRDFIHHSSLNRHMRSHTGQKPNEYQEYEKQPCKCKAVGKTFSYHHCFRKHERTHTGVKPYECKQCGKAFIYYQPFQRHERTHAGQKPYECKQCGKTFIYYQSFQKHAHTGKKPYECKQCGKAFICYQSFQRHKRTHTGEKPYECKQCGKAFSCPTYFRTHERTHTGEKPYKCKECGKAFSFLSSFRRHKRTHSGEKPYECKECGKAFFYSASFRAHVIIHTGARPYKCKECGKAFNSSNSCRVHERTHIGEKPYECKRCGKSFSWSISLRLHERTHTGEKPYECKQCHKTFSFSSSLREHETTHTGEKPYECKQCGKTFSFSSSLQRHERTHNAEKPYECKQCGKAFRCSSYFRIHERSHTGEKPYECKQCGKVFIRSSSFRLHERTHTGEKPYECKLCGKTFSFSSSLREHEKIHTGNKPFECKQCGKAFLRSSQIRLHERTHTGEKPYQCKQCGKAFISSSKFRMHERTHTGEKPYRCKQCGKAFRFSSSVRIHERSHTGEKPYECKQCGKAFISSSHFRLHERTHMGEKV

SEQ ID NO: 99066 - protein, 457 aa, Homo sapiens
  Payload ID: 19768
  Gene Name: zinc finger protein 140
  Uniprot ID: P52738
  ENSP ID: ENSP00000347755
MSQGSVTFRDVAIDFSQEEWKWLQPAQRDLYRCVMLENYGHLVSLGLSISKPDVVSLLEQGKEPWLGKREVKRDLFSVSESSGEIKDFSPKNVIYDDSSQYLIMERILSQGPVYSSFKGGWKCKDHTEMLQENQGCIRKVTVSHQEALAQHMNISTVERPYGCHECGKTFGRRFSLVLHQRTHTGEKPYACKECGKTFSQISNLVKHQMIHTGKKPHECKDCNKTFSYLSFLIEHQRTHTGEKPYECTECGKAFSRASNLTRHQRIHIGKKQYICRKCGKAFSSGSELIRHQITHTGEKPYECIECGKAFRRFSHLTRHQSIHTTKTPYECNECRKAFRCHSFLIKHQRIHAGEKLYECDECGKVFTWHASLIQHTKSHTGEKPYACAECDKAFSRSFSLILHQRTHTGEKPYVCKVCNKSFSWSSNLAKHQRTHTLDNPYEYENSFNYHSFLTEHQ

SEQ ID NO: 99067 - protein, 77 aa, Homo sapiens
  Payload ID: 19768
  Gene Name: zinc finger protein 140
  ENSP ID: ENSP00000375895
MSQDLGRGFLSPTTTCLAEPQDPVPCSSFSGVSDIQRCGHRLLPGGVEMASACSKRFVQMCNVGELWPSGLTGSFHF

SEQ ID NO: 99068 - protein, 87 aa, Homo sapiens
  Payload ID: 19768
  Gene Name: zinc finger protein 140
  ENSP ID: ENSP00000389566
MLENYGHLVSLGLSISKPDVVSLLEQGKEPWLGKREVKRDLFSVSESSGEIKDFSPKNVIYDDSSQYLIMERILSQGPVYSSFKGGW

SEQ ID NO: 99069 - protein, 101 aa, Homo sapiens
  Payload ID: 19768
  Gene Name: zinc finger protein 140
  ENSP ID: ENSP00000415016
MSQGSVTFRDVAIDFSQEEWKWLQPAQRDLYRCVMLENYGHLVSLGLSISKPDVVSLLEQGKEPWLGKREVKRDLFSVLKEAGNARIILRCCKKIRDVLGK

SEQ ID NO: 99070 - protein, 161 aa, Homo sapiens
  Payload ID: 19768
  Gene Name: zinc finger protein 140
  ENSP ID: ENSP00000415499
MREFGGMRAGHANICPSFQGSVTFRDVAIDFSQEEWKWLQPAQRDLYRCVMLENYGHLVSLGLSISKPDVVSLLEQGKEPWLGKREVKRDLFSVSESSGEIKDFSPKNVIYDDSSQYLIMERILSQGPVYSSFKGGWKCKDHTEMLQENQGCIRKVTVSHQ

SEQ ID NO: 99071 - protein, 114 aa, Homo sapiens
  Payload ID: 19768
  Gene Name: zinc finger protein 140
  ENSP ID: ENSP00000437913
MSQGSVTFRDVAIDFSQEEWKWLQPAQRDLYRCVMLENYGHLVSLAGLSISKPDVVSLLEQGKEPWLGKREVKRDLFSGFFSANCVSFFSWAHVDGSAFLVDGNFFCKFFRVKW

SEQ ID NO: 99072 - protein, 79 aa, Homo sapiens
  Payload ID: 19768
  Gene Name: zinc finger protein 140
  ENSP ID: ENSP00000441170
MSQGSVTFRDVAIDFSQEEWKWLQPAQRDLYRCVMLENYGHLVSLGLSISKPDVVSLLEQGKEPWLGKREVKRDLFSGN

SEQ ID NO: 99073 - protein, 116 aa, Homo sapiens
  Payload ID: 19768
  Gene Name: zinc finger protein 140
  ENSP ID: ENSP00000444905
MSQGSVTFRDVAIDFSQEEWKWLQPAQRDLYRCVMLENYGHLVSLGLSISKPDVVSLLEQGKEPWLGKREVKRDLFSVSESSGEIKDFSPKNVIYDDSSQYLIMERILSQGPVYSS

SEQ ID NO: 99074 - protein, 354 aa, Homo sapiens
  Payload ID: 19768
  Gene Name: zinc finger protein 140
  Uniprot ID: P52738
  ENSP ID: ENSP00000445411
MERILSQGPVYSSFKGGWKCKDHTEMLQENQGCIRKVTVSHQEALAQHMNISTVERPYGCHECGKTFGRRFSLVLHQRTHTGEKPYACKECGKTFSQISNLVKHQMIHTGKKPHECKDCNKTFSYLSFLIEHQRTHTGEKPYECTECGKAFSRASNLTRHQRIHIGKKQYICRKCGKAFSSGSELIRHQITHTGEKPYECIECGKAFRRFSHLTRHQSIHTTKTPYECNECRKAFRCHSFLIKHQRIHAGEKLYECDECGKVFTWHASLIQHTKSHTGEKPYACAECDKAFSRSFSLILHQRTHTGEKPYVCKVCNKSFSWSSNLAKHQRTHTLDNPYEYENSFNYHSFLTEHQ

SEQ ID NO: 99075 - protein, 474 aa, Homo sapiens
  Payload ID: 19769
  Gene Name: zinc finger protein 141
  Uniprot ID: Q15928
  ENSP ID: ENSP00000240499
MELLTFRDVAIEFSPEEWKCLDPDQQNLYRDVMLENYRNLVSLGVAISNPDLVTCLEQRKEPYNVKIHKIVARPPAMCSHFTQDHWPVQGIEDSFHKLILRRYEKCGHDNLQLRKGCKSLNECKLQKGGYNEFNECLSTTQSKILQCKASVKVVSKFSNSNKRKTRHTGEKHFKECGKSFQKFSHLTQHKVIHAGEKPYTCEECGKAFKWSLIFNEHKRIHTGEKPFTCEECGSIFTTSSHFAKHKIIHTGEKPYKCEECGKAFNRFTTLTKHKRIHAGEKPITCEECRKIFTSSSNFAKHKRIHTGEKPYKCEECGKAFNRSTTLTKHKRIHTGEKPYTCEECGKAFRQSSKLNEHKKVHTGERPYKCDECGKAFGRSRVLNEHKKIHTGEKPYKCEECGKAFRRSTDRSQHKKIHSADKPYKCKECDKAFKQFSLLSQHKKIHTVDKPYKCKDCDKAFKRFSHLNKHKKIHT

SEQ ID NO: 99076 - protein, 113 aa, Homo sapiens
  Payload ID: 19769
  Gene Name: zinc finger protein 141
  ENSP ID: ENSP00000424403
MELLTFRDVAIEFSPEEWKCLDPDQQNLYRDVMLENYRNLVSLGVAISNPDLVTCLEQRKEPYNVKIHKIVARPPEFFHLYDNKPILAFWRIASEKSQSASVYRQLTHRSRAT

SEQ ID NO: 99077 - protein, 201 aa, Homo sapiens
  Payload ID: 19769
  Gene Name: zinc finger protein 141
  ENSP ID: ENSP00000425799
MELLTFRDVAIEFSPEEWKCLDPDQQNLYRDVMLENYRNLVSLGVAISNPDLVTCLEQRKEPYNVKIHKIVARPPAMCSHFTQDHWPVQGIEDSFHKLILRRYEKCGHDNLQLRKGCKSLNECKLQKGGYNEFNECLSTTQSKILQCKASVKVVSKFSNSNKRKTRHTGEKHFKECGKSFQKFSHLTQHKNSSISMTTSPF

SEQ ID NO: 99078 - protein, 14 aa, Homo sapiens
  Payload ID: 19770
  Gene Name: zinc finger protein 142
  ENSP ID: ENSP00000391599
MTDPLLDSQPASST

SEQ ID NO: 99079 - protein, 98 aa, Homo sapiens
  Payload ID: 19770
  Gene Name: zinc finger protein 142
  ENSP ID: ENSP00000397456
MTDPLLDSQPASSTGEMDGLCPELLLIPPPLSNRGILGPVQSPCPSRDPAPIPTEPGCLLVEATATEEGPGNMEIIVETVAGTLTPGAPGETPATAAS

SEQ ID NO: 99080 - protein, 1687 aa, Homo sapiens
  Payload ID: 19770
  Gene Name: zinc finger protein 142
  Uniprot ID: P52746
  ENSP ID: ENSP00000398798
MTDPLLDSQPASSTGEMDGLCPELLLIPPPLSNRGILGPVQSPCPSRDPAPIPTEPGCLLVEATATEEGPGNMEIIVETVAGTLTPGAPGETPAPKLPPGEREPSQEAGTPLPGQETAEEENVEKEEKSDTQKDSQKAVDKGQGAQRLEGDVVSGTESLFKTHMCPECKRCFKKRTHLVEHLHLHFPDPSLQCPNCQKFFTSKSKLKTHLLRELGEKAHHCPLCHYSAVERNALNRHMASMHEDISNFYSDTYACPVCREEFRLSQALKEHLKSHTAAAAAEPLPLRCFQEGCSYAAPDRKAFIKHLKETHGVRAVECRHHSCPMLFATAEAMEAHHKSHYAFHCPHCDFACSNKHLFRKHKKQGHPGSEELRCTFCPFATFNPVAYQDHVGKMHAHEKIHQCPECNFATAHKRVLIRHMLLHTGEKPHKCELCDFTCRDVSYLSKHMLTHSNTKDYMCTECGYVTKWKHYLRVHMRKHAGDLRYQCNQCSYRCHRADQLSSHKLRHQGKSLMCEVCAFACKRKYELQKHMASQHHPGTPAPLYPCHYCSYQSRHKQAVLSHENCKHTRLREFHCALCDYRTFSNTTLLFHKRKAHGYVPGDQAWQLRYASQEPEGAMQGPTPPPDSEPSNQLSARPEGPGHEPGTVVDPSLDQALPEMSEEVNTGRQEGSEAPHGGDLGGSPSPAEVEEGSCTLHLEALGVELESVTEPPLEEVTETAPMEFRPLGLEGPDGLEGPELSSFEGIGTSDLSAEENPLLEKPVSEPSTNPPSLEEAPNNWVGTFKTTPPAETAPLPPLPESESLLKALRRQDKEQAEALVLEGRVQMVVIQGEGRAFRCPHCPFITRREKALNLHSRTGCQGRREPLLCPECGASFKQQRGLSTHLLKKCPVLLRKNKGLPRPDSPIPLQPVLPGTQASEDTESGKPPPASQEAELLLPKDAPLELPREPEETEEPLATVSGSPVPPAGNSLPTEAPKKHCFDPVPPAGNSSPTEAPKKHHLDPVPPAGNSSPTEALKKHRFEQGKFHCNSCPFLCSRLSSITSHVAEGCRGGRGGGGKRGTPQTQPDVSPLSNGDSAPPKNGSTESSSGDGDTVLVQKQKGARFSCPTCPFSCQQERALRTHQIRGCPLEESGELHCSLCPFTAPAATALRLHQKRRHPTAAPARGPRPHLQCGDCGFTCKQSRCMQQHRRLKHEGVKPHQCPFCDFSTTRRYRLEAHQSRHTGIGRIPCSSCPQTFGTNSKLRLHRLRVHDKTPTHFCPLCDYSGYLRHDITRHVNSCHQGTPAFACSQCEAQFSSETALKQHALRRHPEPAQPAPGSPAETTEGPLHCSRCGLLCPSPASLRGHTRKQHPRLECGACQEAFPSRLALDEHRRQQHFSHRCQLCDFAARERVGLVKHYLEQHEETSAAVAASDGDGDAGQPPLHCPFCDFTCRHQLVLDHHVKGHGGTRLYKCTDCAYSTKNRQKITWHSRIHTGEKPYHCHLCPYACADPSRLKYHMRIHKEERKYLCPECGYKCKWVNQLKYHMTKHTGLKPYQCPECEYCTNRADALRVHQETRHREARAFMCEQCGKAFKTRFLLRTHLRKHSEAKPYVCNVCHRAFRWAAGLRHHALTHTDRHPFFCRLCNYKAKQKFQVVKHVRRHHPDQADPNQGVGKDPTTPTVHLHDVQLEDPSPPAPAAPHTGPEG

SEQ ID NO: 99081 - protein, 26 aa, Homo sapiens
  Payload ID: 19770
  Gene Name: zinc finger protein 142
  ENSP ID: ENSP00000400424
MTDPLLDSQPASSTGEMDGLCPELLL

SEQ ID NO: 99082 - protein, 98 aa, Homo sapiens; identical to SEQ ID NO: 99079
  Payload ID: 19770
  Gene Name: zinc finger protein 142
  ENSP ID: ENSP00000405477

SEQ ID NO: 99083 - protein, 1687 aa, Homo sapiens; identical to SEQ ID NO: 99080
  Payload ID: 19770
  Gene Name: zinc finger protein 142
  Uniprot ID: P52746
  ENSP ID: ENSP00000408643

SEQ ID NO: 99084 - protein, 294 aa, Homo sapiens
  Payload ID: 19770
  Gene Name: zinc finger protein 142
  ENSP ID: ENSP00000415156
  MOD_RES (1)..(1): Any amino acid
XPASSTGEMDGLCPELLLIPPPLSNRGILGPVQSPCPSRDPAPIPTEPGCLLVEATATEEGPGNMEIIVETVAGTLTPGAPGETPGVLVKVVEVYFCERCEQSFAEPTLLALHQCSETHIQPVQGLSSPPCSVELPPSNPTLPGPLQGQSPPVSPLSCPVCRQEFAQPQALKSHFKIHRGTPDTFSCPESGCVFSAEDRKGLQHHLRQTHRAVPVPCSFRGCPLLFGSQQGMELHRQAHYPFHCSHCSFIGSNVKLFRQHQRSHGAGTQGELSAVQGLPSQELLPAPKLPPGER

SEQ ID NO: 99085 - protein, 610 aa, Homo sapiens
  Payload ID: 19771
  Gene Name: zinc finger protein 143
  ENSP ID: ENSP00000299606
MLLAQINRDSQGMTEFPGGGMEAQHVTLCLTEAVTVADGDNLENMEGVSLQAVTLADGSTAYIQHNSKDAKLIDGQVIQLEDGSAAYVQHVPIPKSNSYDQSALQAVQLEDGTTAYIHHAVQVPQSDTILAIQADGTVAGLHTGDATIDPDTISALEQYAAKVSIDGSESVAGTGMIGENEQEKKMQIVLQGHATRVTAKSQQSGEKAFRCEYDGCGKLYTTAHHLKVHERSHTGDRPYQCEHAGCGKAFATGYGLKSHVRTHTGEKPYRCSEDNCTKSFKTSGDLQKHIRTHTGERPFKCPFEGCGRSFTTSNIRKVHVRTHTGERPYYCTEPGCGRAFASATNYKNHVRIHTGEKPYVCTVPGCDKRFTEYSSLYKHHVVHTHSKPYNCNHCGKTYKQISTLAMHKRTAHNDTEPIEEEQEAFFEPPPGQGEDVLKGSQITYVTGVEGDDVVSTQVATVTQSGLSQQVTLISQDGTQHVNISQADMQAIGNTITMVTQDGTPITVPAHDAVISSAGTHSVAMVTAEGTEGEQVAIVAQDLAAFHTASSEMGHQQHSHHLVTTETRPLTLVATSNGTQIAVQLGEQPSLEEAIRIASRIQQGETPGLDD

SEQ ID NO: 99086 - protein, 607 aa, Homo sapiens
  Payload ID: 19771
  Gene Name: zinc finger protein 143
  Uniprot ID: P52747
  ENSP ID: ENSP00000379843
MLLAQINRDSQGMTEFPGGGMEAQHVTLCLTEAVTVADAKLIDGQVIQLEDGSAAYVQHVPIPKSTGDSLRLEDGQAVQLEDGTTAFIHHTSKDSYDQSALQAVQLEDGTTAYIHHAVQVPQSDTILAIQADGTVAGLHTGDATIDPDTISALEQYAAKVSIDGSESVAGTGMIGENEQEKKMQIVLQGHATRVTAKSQQSGEKAFRCEYDGCGKLYTTAHHLKVHERSHTGDRPYQCEHAGCGKAFATGYGLKSHVRTHTGEKPYRCSEDNCTKSFKTSGDLQKHIRTHTGERPFKCPFEGCGRSFTTSNIRKVHVRTHTGERPYYCTEPGCGRAFASATNYKNHVRIHTGEKPYVCTVPGCDKRFTEYSSLYKHHVVHTHSKPYNCNHCGKTYKQISTLAMHKRTAHNDTEPIEEEQEAFFEPPPGQGEDVLKGSQITYVTGVEGDDVVSTQVATVTQSGLSQQVTLISQDGTQHVNISQADMQAIGNTITMVTQDGTPITVPAHDAVISSAGTHSVAMVTAEGTEGEQVAIVAQDLAAFHTASSEMGHQQHSHHLVTTETRPLTLVATSNGTQIAVQLGEQPSLEEAIRIASRIQQGETPGLDD

SEQ ID NO: 99087 - protein, 638 aa, Homo sapiens
  Payload ID: 19771
  Gene Name: zinc finger protein 143
  Uniprot ID: P52747
  ENSP ID: ENSP00000379847
MLLAQINRDSQGMTEFPGGGMEAQHVTLCLTEAVTVADGDNLENMEGVSLQAVTLADGSTAYIQHNSKDAKLIDGQVIQLEDGSAAYVQHVPIPKSTGDSLRLEDGQAVQLEDGTTAFIHHTSKDSYDQSALQAVQLEDGTTAYIHHAVQVPQSDTILAIQADGTVAGLHTGDATIDPDTISALEQYAAKVSIDGSESVAGTGMIGENEQEKKMQIVLQGHATRVTAKSQQSGEKAFRCEYDGCGKLYTTAHHLKVHERSHTGDRPYQCEHAGCGKAFATGYGLKSHVRTHTGEKPYRCSEDNCTKSFKTSGDLQKHIRTHTGERPFKCPFEGCGRSFTTSNIRKVHVRTHTGERPYYCTEPGCGRAFASATNYKNHVRIHTGEKPYVCTVPGCDKRFTEYSSLYKHHVVHTHSKPYNCNHCGKTYKQISTLAMHKRTAHNDTEPIEEEQEAFFEPPPGQGEDVLKGSQITYVTGVEGDDVVSTQVATVTQSGLSQQVTLISQDGTQHVNISQADMQAIGNTITMVTQDGTPITVPAHDAVISSAGTHSVAMVTAEGTEGEQVAIVAQDLAAFHTASSEMGHQQHSHHLVTTETRPLTLVATSNGTQIAVQLGEQPSLEEAIRIASRIQQGETPGLDD

SEQ ID NO: 99088 - protein, 637 aa, Homo sapiens
  Payload ID: 19771
  Gene Name: zinc finger protein 143
  Uniprot ID: P52747
  ENSP ID: ENSP00000379849
MLLAQINRDSQGMTEFPGGGMEAQHVTLCLTEAVTVADGDNLENMEGVSLQAVTLADGSTAYIQHNSKDAKLIDGQVIQLEDGSAAYVQHVPIPKSRDSLRLEDGQAVQLEDGTTAFIHHTSKDSYDQSALQAVQLEDGTTAYIHHAVQVPQSDTILAIQADGTVAGLHTGDATIDPDTISALEQYAAKVSIDGSESVAGTGMIGENEQEKKMQIVLQGHATRVTAKSQQSGEKAFRCEYDGCGKLYTTAHHLKVHERSHTGDRPYQCEHAGCGKAFATGYGLKSHVRTHTGEKPYRCSEDNCTKSFKTSGDLQKHIRTHTGERPFKCPFEGCGRSFTTSNIRKVHVRTHTGERPYYCTEPGCGRAFASATNYKNHVRIHTGEKPYVCTVPGCDKRFTEYSSLYKHHVVHTHSKPYNCNHCGKTYKQISTLAMHKRTAHNDTEPIEEEQEAFFEPPPGQGEDVLKGSQITYVTGVEGDDVVSTQVATVTQSGLSQQVTLISQDGTQHVNISQADMQAIGNTITMVTQDGTPITVPAHDAVISSAGTHSVAMVTAEGTEGEQVAIVAQDLAAFHTASSEMGHQQHSHHLVTTETRPLTLVATSNGTQIAVQLGEQPSLEEAIRIASRIQQGETPGLDD

SEQ ID NO: 99089 - protein, 142 aa, Homo sapiens
  Payload ID: 19771
  Gene Name: zinc finger protein 143
  ENSP ID: ENSP00000388628
MLLAQINRDSQGMTEFPGGGMEAQHVTLCLTEAVTVADGDNLENMEGVSLQAVTLADGSTAYIQHNSKDAKLIDGQVIQLEDGSAAYVQHVPIPKSRDSLRLEDGQAVQLEDGTTAFIHHTSKDSYDQSALQAVQLEDGTTA

SEQ ID NO: 99090 - protein, 73 aa, Homo sapiens
  Payload ID: 19771
  Gene Name: zinc finger protein 143
  ENSP ID: ENSP00000392323
MLLAQINRDSQGMTEFPGGGMEAQHVTLCLTEAVTVADGDNLENMEGVSLQAVTLADGSTAYIQHNSKDAKLI

SEQ ID NO: 99091 - protein, 83 aa, Homo sapiens
  Payload ID: 19771
  Gene Name: zinc finger protein 143
  ENSP ID: ENSP00000395221
MLLAQINRDSQGMTEFPGGGMEAQHVTLCLTEAVTVADGDNLENMEGVSLQAVTLADGSTAYIQHNSKDAKLIDGQVIQLEDG

SEQ ID NO: 99092 - protein, 168 aa, Homo sapiens
  Payload ID: 19771
  Gene Name: zinc finger protein 143
  ENSP ID: ENSP00000401493
  MOD_RES (1)..(1): Any amino acid
XVEGDDVVSTQVATVTQSGLSQQVTLISQDGTQHVNISQADMQAIGNTITMVTQDGTPITVPAHDAVISSAGTHSVAMVTAEGTEGEQVAIVAQDLAAFHTASSEMGHQQHSHHLVTTETRPLTLVATSNGTQIAVQVSTKAYCPQSTAVLLIAFNFVHCASCITFTG

SEQ ID NO: 99093 - protein, 190 aa, Homo sapiens
  Payload ID: 19771
  Gene Name: zinc finger protein 143
  ENSP ID: ENSP00000409432
MLLAQINRDSQGMTEFPGGGMEAQHVTLCLTEAVTVADGDNLENMEGVSLQAVTLADGSTAYIQHNSKDAKLIDGQVIQLEDGSAAYVQHVPIPKSTGDSLRLEDGQAVQLEDGTTAFIHHTSKDSYDQSALQAVQLEDGTTAYIHHAVQVPQSDTILAIQADGTVAGLHTGDATIDPDTISALEQYAAK

SEQ ID NO: 99094 - protein, 86 aa, Homo sapiens
  Payload ID: 19771
  Gene Name: zinc finger protein 143
  ENSP ID: ENSP00000431306
MLLAQINRDSQGMTEFPGGGMEAQHVTLCLTEAVTVADGDNLENMEGVSLQAVTLADGSTAYIQHNSKGSLDVLLNCLRTLREESR

SEQ ID NO: 99095 - protein, 637 aa, Homo sapiens; identical to SEQ ID NO: 99088
  Payload ID: 19771
  Gene Name: zinc finger protein 143
  Uniprot ID: P52747
  ENSP ID: ENSP00000432154

SEQ ID NO: 99096 - protein, 151 aa, Homo sapiens
  Payload ID: 19771
  Gene Name: zinc finger protein 143
  ENSP ID: ENSP00000433221
MLLAQINRDSQGMTEFPGGGMEAQHVTLCLTEAVTVADGDNLENMEGVSLQAVTLADGSTAYIQHNSKDAKLIDGQVIQLEDGSAAYVQHVPIPKSRDSLRLEDGQAVQLEDGTTAFIHHTSKDSYDQSALQAVQLEDGTTAYIHHAVQVP

SEQ ID NO: 99097 - protein, 175 aa, Homo sapiens
  Payload ID: 19771
  Gene Name: zinc finger protein 143
  ENSP ID: ENSP00000433743
MLLAQINRDSQGMTEFPGGGMEAQHVTLCLTEAVTVADGDNLENMEGVSLQAVTLADGSTAYIQHNSKDAKLIDGQVIQLEDGSAAYVQHVPIPKSTGDSLRLEDGQAVQLEDGTTAFIHHTSKDSYDQSALQAVQLEDGTTAYIHHAVQVPQSDTILAIQADGTVAGLHTGDAT

SEQ ID NO: 99098 - protein, 136 aa, Homo sapiens
  Payload ID: 19771
  Gene Name: zinc finger protein 143
  ENSP ID: ENSP00000434638
MLLAQINRDSQGMTEFPGGGMEAQHVTLCLTEAVTVADGDNLENMEGVSLQAVTLADGSTAYIQHNSKDAKLIDGQVIQLEDGSAAYVQHVPIPKSTGDSLRLEDGQAVQLEDGTTAFIHHTSKDSYDQSALQAVQ

SEQ ID NO: 99099 - protein, 175 aa, Homo sapiens
  Payload ID: 19771
  Gene Name: zinc finger protein 143
  ENSP ID: ENSP00000434922
MLLAQINRDSQGMTEFPGGGMEAQHVTLCLTEAVTVADAKLIDGQVIQLEDGSAAYVQHVPIPKSRDSLRLEDGQAVQLEDGTTAFIHHTSKDSYDQSALQAVQLEDGTTAYIHHAVQVPQSDTILAIQADGTVAGLHTGDATIDPDTISALEQYAAKVSIDGSESVAGTGMIGE

SEQ ID NO: 99100 - protein, 166 aa, Homo sapiens
  Payload ID: 19771
  Gene Name: zinc finger protein 143
  ENSP ID: ENSP00000435881
MLLAQINRDSQGMTEFPGGGMEAQHVTLCLTEAVTVADGDNLENMEGVSLQAVTLADGSTAYIQHNSKDAKLIDGQVIQLEDGSAAYVQHVPIPKSTGDSLRLEDGQAVQLEDGTTAFIHHTSKVMTRVHYRRFSWKMVPQLISTMQCKSRSLTPSWQFRLMGQWQ

SEQ ID NO: 99101 - protein, 292 aa, Homo sapiens
  Payload ID: 19772
  Gene Name: zinc finger protein 146
  Uniprot ID: Q15072
  ENSP ID: ENSP00000392095
MSHLSQQRIYSGENPFACKVCGKVFSHKSNLTEHEHFHTREKPFECNECGKAFSQKQYVIKHQNTHTGEKLFECNECGKSFSQKENLLTHQKIHTGEKPFECKDCGKAFIQKSNLIRHQRTHTGEKPFVCKECGKTFSGKSNLTEHEKIHIGEKPFKCSECGTAFGQKKYLIKHQNIHTGEKPYECNECGKAFSQRTSLIVHVRIHSGDKPYECNVCGKAFSQSSSLTVHVRSHTGEKPYGCNECGKAFSQFSTLALHLRIHTGKKPYQCSECGKAFSQKSHHIRHQKIHTH

SEQ ID NO: 99102 - protein, 292 aa, Homo sapiens; identical to SEQ ID NO: 99101
  Payload ID: 19772
  Gene Name: zinc finger protein 146
  Uniprot ID: Q15072
  ENSP ID: ENSP00000400391

SEQ ID NO: 99103 - protein, 794 aa, Homo sapiens
  Payload ID: 19773
  Gene Name: zinc finger protein 148
  Uniprot ID: Q9UQR1
  ENSP ID: ENSP00000353863
MNIDDKLEGLFLKCGGIDEMQSSRTMVVMGGVSGQSTVSGELQDSVLQDRSMPHQEILAADEVLQESEMRQQDMISHDELMVHEETVKNDEEQMETHERLPQGLQYALNVPISVKQEITFTDVSEQLMRDKKQIREPVDLQKKKKRKQRSPAKILTINEDGSLGLKTPKSHVCEHCNAAFRTNYHLQRHVFIHTGEKPFQCSQCDMRFIQKYLLQRHEKIHTGEKPFRCDECGMRFIQKYHMERHKRTHSGEKPYQCEYCLQYFSRTDRVLKHKRMCHENHDKKLNRCAIKGGLLTSEEDSGFSTSPKDNSLPKKKRQKTEKKSSGMDKESALDKSDLKKDKNDYLPLYSSSTKVKDEYMVAEYAVEMPHSSVGGSHLEDASGEIHPPKLVLKKINSKRSLKQPLEQNQTISPLSTYEESKVSKYAFELVDKQALLDSEGNADIDQVDNLQEGPSKPVHSSTNYDDAMQFLKKKRYLQAASNNSREYALNVGTIASQPSVTQAAVASVIDESTTASILESQALNVEIKSNHDKNVIPDEVLQTLLDHYSHKANGQHEISFSVADTEVTSSISINSSEVPEVTPSENVGSSSQASSSDKANMLQEYSKFLQQALDRTSQNDAYLNSPSLNFVTDNQTLPNQPAFSSIDKQVYATMPINSFRSGMNSPLRTTPDKSHFGLIVGDSQHSFPFSGDETNHASATSTQDFLDQVTSQKKAEAQPVHQAYQMSSFEQPFRAPYHGSRAGIATQFSTANGQVNLRGPGTSAEFSEFPLVNVNDNRAGMTSSPDATTGQTFG

SEQ ID NO: 99104 - protein, 83 aa, Homo sapiens
  Payload ID: 19773
  Gene Name: zinc finger protein 148
  ENSP ID: ENSP00000417847
MNIDDKLEGLFLKCGGIDEMQSSRTMVVMGGVSGQSTVSGELQDSVLQDRSMPHQEILAADEVLQESEMRQQDMISHDELMVH

SEQ ID NO: 99105 - protein, 794 aa, Homo sapiens; identical to SEQ ID NO: 99103
  Payload ID: 19773
  Gene Name: zinc finger protein 148
  Uniprot ID: Q9UQR1
  ENSP ID: ENSP00000419322

SEQ ID NO: 99106 - protein, 75 aa, Homo sapiens
  Payload ID: 19773
  Gene Name: zinc finger protein 148
  ENSP ID: ENSP00000419585
MNIDDKLEGLFLKCGGIDEMQSSRTMVVMGGVSGQSTVSGELQDSVLQDRSMPHQEILAADEVLQESEMRQQDMI

SEQ ID NO: 99107 - protein, 25 aa, Homo sapiens
  Payload ID: 19773
  Gene Name: zinc finger protein 148
  ENSP ID: ENSP00000420038
MNIDDKLEGLFLKCGGIDEMQSSRT

SEQ ID NO: 99108 - protein, 144 aa, Homo sapiens
  Payload ID: 19773
  Gene Name: zinc finger protein 148
  ENSP ID: ENSP00000420102
MKGEKPFQCSQCDMRFIQKYLLQRHEKIHTGEKPFRCDECGDETNHASATSTQDFLDQVTSQKKAEAQPVHQAYQMSSFEQPFRAPYHGSRAGIATQFSTANGQVNLRGPGTSAEFSEFPLVNVNDNRAGMTSSPDATTGQTFG

SEQ ID NO: 99109 - protein, 794 aa, Homo sapiens; identical to SEQ ID NO: 99103
  Payload ID: 19773
  Gene Name: zinc finger protein 148
  Uniprot ID: Q9UQR1
  ENSP ID: ENSP00000420335

SEQ ID NO: 99110 - protein, 794 aa, Homo sapiens; identical to SEQ ID NO: 99103
  Payload ID: 19773
  Gene Name: zinc finger protein 148
  Uniprot ID: Q9UQR1
  ENSP ID: ENSP00000420448

SEQ ID NO: 99111 - protein, 454 aa, Homo sapiens
  Payload ID: 19773
  Gene Name: zinc finger protein 148
  ENSP ID: ENSP00000437916
MNIDDKLEGLFLKCGGIDEMQSSRTMVVMGGVSGQSTVSGELQDSVLQDRSMPHQEILAADEVLQESEMRQQDMISHDELMVHEETVKNDEEQMETHERLPQGLQYALNVPISVKQEITFTDVSEQLMRDKKQIREPVDLQKKKKRKQRSPAKILTINEDGSLGLKTPKSHVCEHCNAAFRTNYHLQRHVFIHTGEKPFQCSQCDMRFIQKYLLQRHEKIHTGEKPFRCDECGMRFIQKYHMERHKRTHSGEKPYQCEYCLQYFSRTDRVLKHKRMCHENHDKKLNRCAIKGGLLTSEEDSGFSTSPKDNSLPKKKRQKTEKKSSGMDKESALDKSDLKKDKNDYLPLYSSSTKVKDEYMVAEYAVEMPHSSVGGSHLEDASGEIHPPKLVLKKINSKRSLKQPLEQNQTISPLSTYEESKFQSMLLNLWINRLYWTQKAMLTLIRLIICRRAQ

SEQ ID NO: 99112 - protein, 437 aa, Homo sapiens
  Payload ID: 19774
  Gene Name: zinc finger protein 154
  Uniprot ID: Q13106
  ENSP ID: ENSP00000421258
MAAATLRTPTQGTVTFEDVAVHFSWEEWGLLDEAQRCLYRDVMLENLALLTSLDVHHQKQHLGEKHFRSNVGRALFVKTCTFHVSGEPSTCREVGKDFLAKLGFLHQQAAHTGEQSNSKSDGGAISHRGKTHYNCGEHTKAFSGKHTLVQQQRTLTTERCYICSECGKSFSKSYSLNDHWRLHTGEKPYECRECGKSFRQSSSLIQHRRVHTAVRPHECDECGKLFSNKSNLIKHRRVHTGERPYECSECGKSFSQRSALLQHRGVHTGERPYECSECGKFFTYHSSLIKHQKVHSGSRPYECSECGKSFSQNSSLIEHHRVHTGERPYKCSECGKSFSQRSALLQHRGVHTGERPYECSECGKFFPYSSSLRKHQRVHTGSRPYECSECGKSFTQNSGLIKHRRVHTGEKPYECTECGKSFSHNSSLIKHQRIHSR

SEQ ID NO: 99113 - protein, 437 aa, Homo sapiens; identical to SEQ ID NO: 99112
  Payload ID: 19774
  Gene Name: zinc finger protein 154
  Uniprot ID: Q13106
  ENSP ID: ENSP00000469633

SEQ ID NO: 99114 - protein, 538 aa, Homo sapiens
  Payload ID: 19775
  Gene Name: zinc finger protein 155
  Uniprot ID: Q12901
  ENSP ID: ENSP00000270014
MTTFKEAVTFKDVAVVFTEEELGLLDPAQRKLYRDVMLENFRNLLSVGHQPFHQDTCHFLREEKFWMMGTATQREGNSGGKIQTELESVPEAGAHEEWSCQQIWEQIAKDLTRSQDSIINNSQFFENGDVPSQVEAGLPTIHTGQKPSQGGKCKQSISDVPIFDLPQQLYSEEKSYTCDECGKSICYISALHVHQRVHVGEKLFMCDVCGKEFSQSSHLQTHQRVHTGEKPFKCEQCGKGFSRRSALNVHRKLHTGEKPYICEACGKAFIHDSQLKEHKRIHTGEKPFKCDICGKTFYFRSRLKSHSMVHTGEKPFRCDTCDKSFHQRSALNRHCMVHTGEKPYRCEQCGKGFIGRLDFYKHQVVHTGEKPYNCKECGKSFRWSSCLLNHQRVHSGEKSFKCEECGKGFYTNSQLSSHQRSHSGEKPYKCEECGKGYVTKFNLDLHQRVHTGERPYNCKECGKNFSRASSILNHKRLHCQKKPFKCEDCGKRLVHRTYRKDQPRDYSGENPSKCEDCGRRYKRRLNLDILLSLFLNDT

SEQ ID NO: 99115 - protein, 549 aa, Homo sapiens
  Payload ID: 19775
  Gene Name: zinc finger protein 155
  Uniprot ID: Q12901
  ENSP ID: ENSP00000385163
MIKRSKVLVFCSKIMEEAVTFKDVAVVFTEEELGLLDPAQRKLYRDVMLENFRNLLSVGHQPFHQDTCHFLREEKFWMMGTATQREGNSGGKIQTELESVPEAGAHEEWSCQQIWEQIAKDLTRSQDSIINNSQFFENGDVPSQVEAGLPTIHTGQKPSQGGKCKQSISDVPIFDLPQQLYSEEKSYTCDECGKSICYISALHVHQRVHVGEKLFMCDVCGKEFSQSSHLQTHQRVHTGEKPFKCEQCGKGFSRRSALNVHRKLHTGEKPYICEACGKAFIHDSQLKEHKRIHTGEKPFKCDICGKTFYFRSRLKSHSMVHTGEKPFRCDTCDKSFHQRSALNRHCMVHTGEKPYRCEQCGKGFIGRLDFYKHQVVHTGEKPYNCKECGKSFRWSSCLLNHQRVHSGEKSFKCEECGKGFYTNSQLSSHQRSHSGEKPYKCEECGKGYVTKFNLDLHQRVHTGERPYNCKECGKNFSRASSILNHKRLHCQKKPFKCEDCGKRLVHRTYRKDQPRDYSGENPSKCEDCGRRYKRRLNLDILLSLFLNDT

SEQ ID NO: 99116 - protein, 90 aa, Homo sapiens
  Payload ID: 19775
  Gene Name: zinc finger protein 155
  ENSP ID: ENSP00000465201
MTTFKEAVTFKDVAVVFTEEELGLLDPAQRKLYRDVMLENFRNLLSVGHQPFHQDTCHFLREEKFWMMGTATQREGNSGGKIQTELESVP

SEQ ID NO: 99117 - protein, 538 aa, Homo sapiens; identical to SEQ ID NO: 99114
  Payload ID: 19775
  Gene Name: zinc finger protein 155
  Uniprot ID: Q12901
  ENSP ID: ENSP00000465691

SEQ ID NO: 99118 - protein, 115 aa, Homo sapiens
  Payload ID: 19775
  Gene Name: zinc finger protein 155
  ENSP ID: ENSP00000465981
MTTFKEAVTFKDVAVVFTEEELGLLDPAQRKLYRDVMLENFRNLLSVGHQPFHQDTCHFLREEKFWMMGTATQREGNSGGKIQTELESVPEAGAHEEWSCQQIWEQIAKDLTRSQ

SEQ ID NO: 99119 - protein, 150 aa, Homo sapiens
  Payload ID: 19775
  Gene Name: zinc finger protein 155
  ENSP ID: ENSP00000467110
MTTFKEAVTFKDVAVVFTEEELGLLDPAQRKLYRDVMLENFRNLLSVGHQPFHQDTCHFLREEKFWMMGTATQREGNSGGKIQTELESVPEAGAHEEWSCQQIWEQIAKDLTRSQDSIINNSQFFENGDVPSQVEAGLPTIHTGQKPSQG

SEQ ID NO: 99120 - protein, 538 aa, Homo sapiens; identical to SEQ ID NO: 99114
  Payload ID: 19775
  Gene Name: zinc finger protein 155
  Uniprot ID: Q12901
  ENSP ID: ENSP00000481677

SEQ ID NO: 99121 - protein, 506 aa, Homo sapiens
  Payload ID: 19776
  Gene Name: zinc finger protein 157
  Uniprot ID: P51786
  ENSP ID: ENSP00000366273
MPANGTSPQRFPALIPGEPGRSFEGSVSFEDVAVDFTRQEWHRLDPAQRTMHKDVMLETYSNLASVGLCVAKPEMIFKLERGEELWILEEESSGHGYSGSLSLLCGNGSVGDNALRHDNDLLHHQKIQTLDQNVEYNGCRKAFHEKTGFVRRKRTPRGDKNFECHECGKAYCRKSNLVEHLRIHTGERPYECGECAKTFSARSYLIAHQKTHTGERPFECNECGKSFGRKSQLILHTRTHTGERPYECTECGKTFSEKATLTIHQRTHTGEKPYECSECGKTFRVKISLTQHHRTHTGEKPYECGECGKNFRAKKSLNQHQRIHTGEKPYECGECGKFFRMKMTLNNHQRTHTGEKPYQCNECGKSFRVHSSLGIHQRIHTGEKPYECNECGNAFYVKARLIEHQRMHSGEKPYECSECGKIFSMKKSLCQHRRTHTGEKPYECSECGNAFYVKVRLIEHQRIHTGERPFECQECGKAFCRKAHLTEHQRTHIGWSWRCTMKKASH

SEQ ID NO: 99122 - protein, 682 aa, Homo sapiens
  Payload ID: 19777
  Gene Name: zinc finger protein 16
  Uniprot ID: P17020
  ENSP ID: ENSP00000276816
MPSLRTRREEAEMELSVPGPSPWTPAAQARVRDAPAVTHPGSAACGTPCCSDTELEAICPHYQQPDCDTRTEDKEFLHKEDIHEDLESQAEISENYAGDVSQVPELGDLCDDVSERDWGVPEGRRLPQSLSQEGDFTPAAMGLLRGPLGEKDLDCNGFDSRFSLSPNLMACQEIPTEERPHPYDMGGQSFQHSVDLTGHEGVPTAESPLICNECGKTFQGNPDLIQRQIVHTGEASFMCDDCGKTFSQNSVLKNRHRSHMSEKAYQCSECGKAFRGHSDFSRHQSHHSSERPYMCNECGKAFSQNSSLKKHQKSHMSEKPYECNECGKAFRRSSNLIQHQRIHSGEKPYVCSECGKAFRRSSNLIKHHRTHTGEKPFECGECGKAFSQSAHLRKHQRVHTGEKPYECNDCGKPFSRVSNLIKHHRVHTGEKPYKCSDCGKAFSQSSSLIQHRRIHTGEKPHVCNVCGKAFSYSSVLRKHQIIHTGEKPYRCSVCGKAFSHSSALIQHQGVHTGDKPYACHECGKTFGRSSNLILHQRVHTGEKPYECTECGKTFSQSSTLIQHQRIHNGLKPHECNQCGKAFNRSSNLIHHQKVHTGEKPYTCVECGKGFSQSSHLIQHQIIHTGERPYKCSECGKAFSQRSVLIQHQRIHTGVKPYDCAACGKAFSQRSKLIKHQLIHTRE

SEQ ID NO: 99123 - protein, 682 aa, Homo sapiens; identical to SEQ ID NO: 99122
  Payload ID: 19777
  Gene Name: zinc finger protein 16
  Uniprot ID: P17020
  ENSP ID: ENSP00000378369

SEQ ID NO: 99124 - protein, 124 aa, Homo sapiens
  Payload ID: 19777
  Gene Name: zinc finger protein 16
  ENSP ID: ENSP00000432755
MPSLRTRREEAEMELSVPGPSPWTPAAQARVRDAPAVTHPGSAACGTPCCSDTELEAICPHYQQPDCDTRTEDKEFLHKEDIHEDLESQAEISENYAGDVSQVPELGDLCDDVSERDWGVPEGR

SEQ ID NO: 99125 - protein, 221 aa, Homo sapiens
  Payload ID: 19777
  Gene Name: zinc finger protein 16
  ENSP ID: ENSP00000434321
MPSLRTRREEAEMELSVPGPSPWTPAAQARVRDAPAVTHPGSAACGTPCCSDTELEAICPHYQQPDCDTRTEDKEFLHKEDIHEDLESQAEISENYAGDVSQVPELGDLCDDVSERDWGVPEGRRLPQSLSQEGDFTPAAMGLLRGPLGEKDLDCNGFDSRFSLSPNLMACQEIPTEERPHPYDMGGQSFQHSVDLTGHEGVPTAESPLICNECGKTFQGN

SEQ ID NO: 99126 - protein, 682 aa, Homo sapiens; identical to SEQ ID NO: 99122
  Payload ID: 19777
  Gene Name: zinc finger protein 16
  Uniprot ID: P17020
  ENSP ID: ENSP00000484504

SEQ ID NO: 99127 - protein, 147 aa, Homo sapiens
  Payload ID: 19778
  Gene Name: zinc finger protein 160
  Uniprot ID: Q9HCG1
  ENSP ID: ENSP00000347273
MALTQVRLTFRDVAIEFSQEEWKCLDPAQRILYRDVMLENYWNLVSLGLCHFDMNIISMLEEGKEPWTVKSCVKIARKPRTPECVKGVVTDLLRRWKHWLLLLGICCPKPHGRVSSRLRLSRSLGHFFHSAFATFMGVCDKRVGSIF

SEQ ID NO: 99128 - protein, 818 aa, Homo sapiens
  Payload ID: 19778
  Gene Name: zinc finger protein 160
  Uniprot ID: Q9HCG1
  ENSP ID: ENSP00000406201
MALTQVRLTFRDVAIEFSQEEWKCLDPAQRILYRDVMLENYWNLVSLGLCHFDMNIISMLEEGKEPWTVKSCVKIARKPRTPECVKGVVTDIPPKCTIKDLLPKEKSSTEAVFHTVVLERHESPDIEDFSFKEPQKNVHDFECQWRDDTGNYKGVLMAQKEGKRDQRDRRDIENKLMNNQLGVSFHSHLPELQLFQGEGKMYECNQVEKSTNNGSSVSPLQQIPSSVQTHRSKKYHELNHFSLLTQRRKANSCGKPYKCNECGKAFTQNSNLTSHRRIHSGEKPYKCSECGKTFTVRSNLTIHQVIHTGEKPYKCHECGKVFRHNSYLATHRRIHTGEKPYKCNECGKAFRGHSNLTTHQLIHTGEKPFKCNECGKLFTQNSHLISHWRIHTGEKPYKCNECGKAFSVRSSLAIHQTIHTGEKPYKCNECGKVFRYNSYLGRHRRVHTGEKPYKCNECGKAFSMHSNLATHQVIHTGTKPFKCNECSKVFTQNSQLANHRRIHTGEKPYKCNECGKAFSVRSSLTTHQAIHSGEKPYKCIECGKSFTQKSHLRSHRGIHSGEKPYKCNECGKVFAQTSQLARHWRVHTGEKPYKCNDCGRAFSDRSSLTFHQAIHTGEKPYKCHECGKVFRHNSYLATHRRIHTGEKPYKCNECGKAFSMHSNLTTHKVIHTGEKPYKCNQCGKVFTQNSHLANHQRTHTGEKPYRCNECGKAFSVRSSLTTHQAIHTGKKPYKCNECGKVFTQNAHLANHRRIHTGEKPYRCTECGKAFRVRSSLTTHMAIHTGEKRYKCNECGKVFRQSSNLASHHRMHTGEKPYK

SEQ ID NO: 99129 - protein, 818 aa, Homo sapiens; identical to SEQ ID NO: 99128
  Payload ID: 19778
  Gene Name: zinc finger protein 160
  Uniprot ID: Q9HCG1
  ENSP ID: ENSP00000409597

SEQ ID NO: 99130 - protein, 556 aa, Homo sapiens
  Payload ID: 19778
  Gene Name: zinc finger protein 160
  ENSP ID: ENSP00000469393
MALTQVRLTFRDVAIEFSQEEWKCLDPAQRILYRDVMLENYWNLVSLGLCHFDMNIISMLEEGKEPWTVKSCVKIARKPRTPECVKGVVTDIPPKCTIKDLLPKEKSSTEAVFHTVVLERHESPDIEDFSFKEPQKNVHDFECQWRDDTGNYKGVLMAQKEGKRDQRDRRDIENKLMNNQLGVSFHSHLPELQLFQGEGKMYECNQVEKSTNNGSSVSPLQQIPSSVQTHRSKKYHELNHFSLLTQRRKANSCGKPYKCNECGKAFTQNSNLTSHRRIHSGEKPYKCSECGKTFTVRSNLTIHQVIHTGEKPYKCHECGKVFRHNSYLATHRRIHTGEKPYKCNECGKAFRGHSNLTTHQLIHTGEKPFKCNECGKLFTQNSHLISHWRIHTGEKPYKCNECGKAFSVRSSLAIHQTIHTGEKPYKCNECGKVFRYNSYLGRHRRVHTGEKPYKCNECGKAFSMHSNLATHQVIHTGTKPFKCNECSKVFTQNSQLANHRRIHTGEKPYKCNECGKAFSVRSSLTTHQAIHSGEKPYKCIECGKSFTQKSHLRSHR

SEQ ID NO: 99131 - protein, 117 aa, Homo sapiens
  Payload ID: 19778
  Gene Name: zinc finger protein 160
  ENSP ID: ENSP00000470305
MLENYWNLVSLGLCHFDMNIISMLEEGKEPWTVKSCVKIARKPRTPECVKGVVTDIPPKCTIKDLLPKEKSSTEAVFHTVVLERHESPDIEDFSFKEPQKNVHDFECQWRDDTGNYK

SEQ ID NO: 99132 - protein, 782 aa, Homo sapiens
  Payload ID: 19778
  Gene Name: zinc finger protein 160
  ENSP ID: ENSP00000470573
MLENYWNLVSLGLCHFDMNIISMLEEGKEPWTVKSCVKIARKPRTPECVKGVVTDIPPKCTIKDLLPKEKSSTEAVFHTVVLERHESPDIEDFSFKEPQKNVHDFECQWRDDTGNYKGVLMAQKEGKRDQRDRRDIENKLMNNQLGVSFHSHLPELQLFQGEGKMYECNQVEKSTNNGSSVSPLQQIPSSVQTHRSKKYHELNHFSLLTQRRKANSCGKPYKCNECGKAFTQNSNLTSHRRIHSGEKPYKCSECGKTFTVRSNLTIHQVIHTGEKPYKCHECGKVFRHNSYLATHRRIHTGEKPYKCNECGKAFRGHSNLTTHQLIHTGEKPFKCNECGKLFTQNSHLISHWRIHTGEKPYKCNECGKAFSVRSSLAIHQTIHTGEKPYKCNECGKVFRYNSYLGRHRRVHTGEKPYKCNECGKAFSMHSNLATHQVIHTGTKPFKCNECSKVFTQNSQLANHRRIHTGEKPYKCNECGKAFSVRSSLTTHQAIHSGEKPYKCIECGKSFTQKSHLRSHRGIHSGEKPYKCNECGKVFAQTSQLARHWRVHTGEKPYKCNDCGRAFSDRSSLTFHQAIHTGEKPYKCHECGKVFRHNSYLATHRRIHTGEKPYKCNECGKAFSMHSNLTTHKVIHTGEKPYKCNQCGKVFTQNSHLANHQRTHTGEKPYRCNECGKAFSVRSSLTTHQAIHTGKKPYKCNECGKVFTQNAHLANHRRIHTGEKPYRCTECGKAFRVRSSLTTHMAIHTGEKRYKCNECGKVFRQSSNLASHHRMHTGEKPYK

SEQ ID NO: 99133 - protein, 818 aa, Homo sapiens; identical to SEQ ID NO: 99128
  Payload ID: 19778
  Gene Name: zinc finger protein 160
  Uniprot ID: Q9HCG1
  ENSP ID: ENSP00000470961

SEQ ID NO: 99134 - protein, 13 aa, Homo sapiens
  Payload ID: 19778
  Gene Name: zinc finger protein 160
  ENSP ID: ENSP00000472387
MALTQVRLTFRDV

SEQ ID NO: 99135 - protein, 485 aa, Homo sapiens
  Payload ID: 19779
  Gene Name: zinc finger protein 165
  Uniprot ID: P49910
  ENSP ID: ENSP00000366542
MATEPKKAAAQNSPEDEGLLIVKIEEEEFIHGQDTCLQRSELLKQELCRQLFRQFCYQDSPGPREALSRLRELCCQWLKPEIHTKEQILELLVLEQFLTILPGDLQAWVHEHYPESGEEAVTILEDLERGTDEAVLQVQAHEHGQEIFQKKVSPPGPALNVKLQPVETKAHFDSSEPQLLWDCDNESENSRSMPKLEIFEKIESQRIISGRISGYISEASGESQDICKSAGRVKRQWEKESGESQRLSSAQDEGFGKILTHKNTVRGEIISHDGCERRLNLNSNEFTHQKSCKHGTCDQSFKWNSDFINHQIIYAGEKNHQYGKSFKSPKLAKHAAVFSGDKTHQCNECGKAFRHSSKLARHQRIHTGERCYECNECGKSFAESSDLTRHRRIHTGERPFGCKECGRAFNLNSHLIRHQRIHTREKPYECSECGKTFRVSSHLIRHFRIHTGEKPYECSECGRAFSQSSNLSQHQRIHMRENLLM

SEQ ID NO: 99136 - protein, 125 aa, Homo sapiens
  Payload ID: 19780
  Gene Name: zinc finger protein 169
  ENSP ID: ENSP00000340711
MSPGLLTTRKEALMAFRDVAVAFTQKEWKLLSSAQRTLYREVMLENYSHLVSLGIAFSKPKLIEQLEQGDEPWREENEHLLDLCPAQTPSSWLLHKQQAEQMFLRQGLIGLSWSKSKGAAPKKGR

SEQ ID NO: 99137 - protein, 603 aa, Homo sapiens
  Payload ID: 19780
  Gene Name: zinc finger protein 169
  Uniprot ID: Q14929
  ENSP ID: ENSP00000378792
MSPGLLTTRKEALMAFRDVAVAFTQKEWKLLSSAQRTLYREVMLENYSHLVSLGIAFSKPKLIEQLEQGDEPWREENEHLLDLCPEPRTEFQPSFPHLVAFSSSQLLRQYALSGHPTQIFPSSSAGGDFQLEAPRCSSEKGESGETEGPDSSLRKRPSRISRTFFSPHQGDPVEWVEGNREGGTDLRLAQRMSLGGSDTMLKGADTSESGAVIRGNYRLGLSKKSSLFSHQKHHVCPECGRGFCQRSDLIKHQRTHTGEKPYLCPECGRRFSQKASLSIHQRKHSGEKPYVCRECGRHFRYTSSLTNHKRIHSGERPFVCQECGRGFRQKIALLLHQRTHLEEKPFVCPECGRGFCQKASLLQHQSSHTGERPFLCLECGRSFRQQSLLLSHQVTHSGEKPYVCAECGHSFRQKVTLIRHQRTHTGEKPYLCPQCGRGFSQKVTLIGHQRTHTGEKPYLCPDCGRGFGQKVTLIRHQRTHTGEKPYLCPKCGRAFGFKSLLTRHQRTHSEEELYVDRVCGQGLGQKSHLISDQRTHSGEKPCICDECGRGFGFKSALIRHQRTHSGEKPYVCRECGRGFSQKSHLHRHRRTKSGHQLLPQEVF

SEQ ID NO: 99138 - protein, 126 aa, Homo sapiens
  Payload ID: 19780
  Gene Name: zinc finger protein 169
  ENSP ID: ENSP00000474608
MSPGLLTTRKEALMAFRDVAVAFTQKEWKLLSSAQRTLYREVMLENYSHLVSLGIAFSKPKLIEQLEQGDEPWREENEHLLDLCPGEWEALGKRGCRAVRSSAGKEGGAIFEVLGGSSSSGLLGHW

SEQ ID NO: 99139 - protein, 111 aa, Homo sapiens
  Payload ID: 19780
  Gene Name: zinc finger protein 169
  ENSP ID: ENSP00000475038
MSPGLLTTRKEALMAFRDVAVAFTQKEWKLLSSAQRTLYREVMLENYSHLVSLGIAFSKPKLIEQLEQGDEPWREENEHLLDLCPESRSVTQAGVQWHDLGSLQPLPPVFK

SEQ ID NO: 99140 - protein, 664 aa, Homo sapiens
  Payload ID: 19781
  Gene Name: zinc finger protein 17
  Uniprot ID: P17021
  ENSP ID: ENSP00000302455
MLMDAGQDYMVFEDVAIHFSQEEWGILNDVQRHLHSDVMLENFALLSSVGCWHGAKDEEAPSKQCVSVGVSQVTTLKPALSTQKAQPCETCSSLLKDILHLAEHDGTHPKRTAKLYLHQKEHLREKLTRSDEGRPSFVNDSVHLAKRNLTCMQGGKDFTGDSDLQQQALHSGWKPHRDTHGVEAFQSGQNNYSCTQCGKDFCHQHTLFEHQKIHTEERPYECSECGKLFRYNSDLIKHQRNHTGERPYKCSECGKAFSLKYNVVQHQKIHTGERPYECSECGKAFLRKSHLLQHQRIHTRPRPYVCSECGKAFLTQAHLVGHQKIHTGERPYGCNECGKYFMYSSALIRHQKVHTGERPFYCCECGKFFMDSCTLIIHQRVHTGEKPYECNECGKFFRYRSTLIRHQKVHTGEKPYECSECGKFFMDTSTLIIHQRVHTGEKPYECNKCGKFFRYCFTLNRHQRVHSGERPYECSECGKFFVDSCTLKSHQRVHTGERPFECSICGKSFRCRSTLDTHQRIHTGERPYECSECGKFFRHNSNHIRHRRNHFGERSFECTECGRVFSQNSHLIRHQKVHTRERTYKCSKCGKFFMDSSTLISHERVHTGEKPYECSECGKVFRYNSSLIKHRRIHTGERPYQCSECGRVFNQNSHLIQHQKVHTR

SEQ ID NO: 99141 - protein, 51 aa, Homo sapiens
  Payload ID: 19781
  Gene Name: zinc finger protein 17
  ENSP ID: ENSP00000470712
MNLTEVGAASQGAPPDPSSECRSPEEGPCRSGPCVPKRGAFLCGVPVSAVL

SEQ ID NO: 99142 - protein, 662 aa, Homo sapiens
  Payload ID: 19781
  Gene Name: zinc finger protein 17
  Uniprot ID: P17021
  ENSP ID: ENSP00000471905
MNLTEDYMVFEDVAIHFSQEEWGILNDVQRHLHSDVMLENFALLSSVGCWHGAKDEEAPSKQCVSVGVSQVTTLKPALSTQKAQPCETCSSLLKDILHLAEHDGTHPKRTAKLYLHQKEHLREKLTRSDEGRPSFVNDSVHLAKRNLTCMQGGKDFTGDSDLQQQALHSGWKPHRDTHGVEAFQSGQNNYSCTQCGKDFCHQHTLFEHQKIHTEERPYECSECGKLFRYNSDLIKHQRNHTGERPYKCSECGKAFSLKYNVVQHQKIHTGERPYECSECGKAFLRKSHLLQHQRIHTRPRPYVCSECGKAFLTQAHLVGHQKIHTGERPYGCNECGKYFMYSSALIRHQKVHTGERPFYCCECGKFFMDSCTLIIHQRVHTGEKPYECNECGKFFRYRSTLIRHQKVHTGEKPYECSECGKFFMDTSTLIIHQRVHTGEKPYECNKCGKFFRYCFTLNRHQRVHSGERPYECSECGKFFVDSCTLKSHQRVHTGERPFECSICGKSFRCRSTLDTHQRIHTGERPYECSECGKFFRHNSNHIRHRRNHFGERSFECTECGRVFSQNSHLIRHQKVHTRERTYKCSKCGKFFMDSSTLISHERVHTGEKPYECSECGKVFRYNSSLIKHRRIHTGERPYQCSECGRVFNQNSHLIQHQKVHTR

SEQ ID NO: 99143 - protein, 49 aa, Homo sapiens
  Payload ID: 19781
  Gene Name: zinc finger protein 17
  ENSP ID: ENSP00000472791
MLMDAGQDYMVFEDVAIHFSQEEWGILNDVQRHLHSDVMLENFALLSSV

SEQ ID NO: 99144 - protein, 407 aa, Homo sapiens
  Payload ID: 19782
  Gene Name: zinc finger protein 174
  Uniprot ID: Q15697
  ENSP ID: ENSP00000268655
MAAKMEITLSSNTEASSKQERHIIAKLEEKRGPPLQKNCPDPELCRQSFRRFCYQEVSGPQEALSQLRQLCRQWLQPELHTKEQILELLVMEQFLTILPPEIQARVRHRCPMSSKEIVTLVEDFHRASKKPKQWVAVCMQGQKVLLEKTGSQLGEQELPDFQPQTPRRDLRESSPAEPSQAGAYDRLSPHHWEKSPLLQEPTPKLAGTEAPRMRSDNKENPQQEGAKGAKPCAVSAGRSKGNGLQNPEPRGANMSEPRLSRRQVSSPNAQKPFAHYQRHCRVEYISSPLKSHPLRELKKSKGGKRSLSNRLQHLGHQPTRSAKKPYKCDDCGKSFTWNSELKRHKRVHTGERPYTCGECGNCFGRQSTLKLHQRIHTGEKPYQCGQCGKSFRQSSNLHQHHRLHHGD

SEQ ID NO: 99145 - protein, 234 aa, Homo sapiens
  Payload ID: 19782
  Gene Name: zinc finger protein 174
  Uniprot ID: Q15697
  ENSP ID: ENSP00000339781
MAAKMEITLSSNTEASSKQERHIIAKLEEKRGPPLQKNCPDPELCRQSFRRFCYQEVSGPQEALSQLRQLCRQWLQPELHTKEQILELLVMEQFLTILPPEIQARVRHRCPMSSKEIVTLVEDFHRASKKPKQWVAVCMQGQKVLLEKTGSQLGEQELPDFQPQTPRRDLRESSPAEPSQAGAYDRLSPHHWEKSPLLQEPTPKLAGTELLIEKTDPNMATDELPCKLWLSFIA

SEQ ID NO: 99146 - protein, 249 aa, Homo sapiens
  Payload ID: 19782
  Gene Name: zinc finger protein 174
  ENSP ID: ENSP00000459681
MAAKMEITLSSNTEASSKQERHIIAKLEEKRGPPLQKNCPDPELCRQSFRRFCYQEVSGPQEALSQLRQLCRQWLQPELHTKEQILELLVMEQFLTILPPEIQARVRHRCPMSSKEIVTLVEDFHRASKKPKQWVAVCMQGQKVLLEKTGSQLGEQELPDFQPQTPRRDLRESSPAEPSQAGAYDRLSPHHWEKSPLLQEPTPKLAGTGKHSAFSLPLISPLSPSMYLMVLQRHRPHVCVFLNVIYNSR

SEQ ID NO: 99147 - protein, 407 aa, Homo sapiens; identical to SEQ ID NO: 99144
  Payload ID: 19782
  Gene Name: zinc finger protein 174
  Uniprot ID: Q15697
  ENSP ID: ENSP00000460397

SEQ ID NO: 99148 - protein, 234 aa, Homo sapiens; identical to SEQ ID NO: 99145
  Payload ID: 19782
  Gene Name: zinc finger protein 174
  Uniprot ID: Q15697
  ENSP ID: ENSP00000461502

SEQ ID NO: 99149 - protein, 711 aa, Homo sapiens
  Payload ID: 19783
  Gene Name: zinc finger protein 175
  Uniprot ID: Q9Y473
  ENSP ID: ENSP00000262259
MPADVNLSQKPQVLGPEKQDGSCEASVSFEDVTVDFSREEWQQLDPAQRCLYRDVMLELYSHLFAVGYHIPNPEVIFRMLKEKEPRVEEAEVSHQRCQEREFGLEIPQKEISKKASFQKDMVGEFTRDGSWCSILEELRLDADRTKKDEQNQIQPMSHSAFFNKKTLNTESNCEYKDPGKMIRTRPHLASSQKQPQKCCLFTESLKLNLEVNGQNESNDTEQLDDVVGSGQLFSHSSSDACSKNIHTGETFCKGNQCRKVCGHKQSLKQHQIHTQKKPDGCSECGGSFTQKSHLFAQQRIHSVGNLHECGKCGKAFMPQLKLSVYLTDHTGDIPCICKECGKVFIQRSELLTHQKTHTRKKPYKCHDCGKAFFQMLSLFRHQRTHSREKLYECSECGKGFSQNSTLIIHQKIHTGERQYACSECGKAFTQKSTLSLHQRIHSGQKSYVCIECGQAFIQKAHLIVHQRSHTGEKPYQCHNCGKSFISKSQLDIHHRIHTGEKPYECSDCGKTFTQKSHLNIHQKIHTGERHHVCSECGKAFNQKSILSMHQRIHTGEKPYKCSECGKAFTSKSQFKEHQRIHTGEKPYVCTECGKAFNGRSNFHKHQITHTRERPFVCYKCGKAFVQKSELITHQRTHMGEKPYECLDCGKSFSKKPQLKVHQRIHTGERPYVCSECGKAFNNRSNFNKHQTTHTRDKSYKCSYSVKGFTKQ

SEQ ID NO: 99150 - protein, 112 aa, Homo sapiens
  Payload ID: 19783
  Gene Name: zinc finger protein 175
  ENSP ID: ENSP00000440578
MPADVNLSQKPQVLGPEKQDGSCEASVSFEDVTVDFSREEWQQLDPAQRCLYRDVMLELYSHLFAVGYHIPNPEVIFRMLKEKEPRVEEAEVSHQRCQGLAQLAPPFHLHHL

SEQ ID NO: 99151 - protein, 51 aa, Homo sapiens
  Payload ID: 19783
  Gene Name: zinc finger protein 175
  ENSP ID: ENSP00000444424
MPADVNLSQKPQVLGPEKQDGSCEVNRGSPGDSSPEREGRHRMQQVWAPCS

SEQ ID NO: 99152 - protein, 70 aa, Homo sapiens
  Payload ID: 19783
  Gene Name: zinc finger protein 175
  ENSP ID: ENSP00000470922
MPADVNLSQKPQVLGPEKQDGSCEASVSFEDVTVDFSREEWQQLDPAQRCLYRDVMLELYSHLFAVGEHN

SEQ ID NO: 99153 - protein, 321 aa, Homo sapiens
  Payload ID: 19784
  Gene Name: zinc finger protein 177
  Uniprot ID: Q13360
  ENSP ID: ENSP00000341497
MAAGWLTTWSQNSVTFQEVAVDFSQEEWALLDPAQKNLYKDVMLENFRNLASVGYQLCRHSLISKVDQEQLKTDERGILQGDCADWETQLKPKDTIAMQNIPGGKTSNGINTNCVRTHSGEMPYECSDCGKAFIFQSSLKKHMRSHTGEKPYECDHCGKSFSQSSHLNVHKRTHTGEKPYDCKECGKAFTVPSSLQKHVRTHTGEKPYECSDCGKAFIDQSSLKKHTRSHTGEKPYECNQCGKSFSTGSYLIVHKRTHTGEKTYECKECGKAFRNSSCLRVHVRTHTGEKPYKCIQCEKAFSTSTNLIMHKRIHNGQKLHE

SEQ ID NO: 99154 - protein, 126 aa, Homo sapiens
  Payload ID: 19784
  Gene Name: zinc finger protein 177
  ENSP ID: ENSP00000465438
MAAGWLTTWSQNSVTFQEVAVDFSQEEWALLDPAQKNLYKDVMLENFRNLASVGYQLCRHSLISKVDQEQLKTDERGILQGDCADWETQLKPKDTIAMQNIPGGKTSNGINTKIYTPRGGQRKDTK

SEQ ID NO: 99155 - protein, 17 aa, Homo sapiens
  Payload ID: 19784
  Gene Name: zinc finger protein 177
  ENSP ID: ENSP00000467978
MAAGWLTTWSQNSVTFQ

SEQ ID NO: 99156 - protein, 481 aa, Homo sapiens
  Payload ID: 19784
  Gene Name: zinc finger protein 177
  Uniprot ID: Q13360
  ENSP ID: ENSP00000468531
MAAGWLTTWSQNSVTFQEVAVDFSQEEWALLDPAQKNLYKDVMLENFRNLASVGYQLCRHSLISKVDQEQLKTDERGILQGDCADWETQLKPKDTIAMQNIPGGKTSNGINTAENQPGEHSLECNHCGKFRKNTRFICTRYCKGEKCYKYIKYSKVFNHPSTLRSHVSIHIGEKTLEFTDCRKAFNQESSLRKHLRTPTGQKFQEYEQCDMSFSLHSSCSVREQIPTGEKGDECSDYGKISPLSVHTKTGSVEEGLECNEHEKTFTDPLSLQNCVRTHSGEMPYECSDCGKAFIFQSSLKKHMRSHTGEKPYECDHCGKSFSQSSHLNVHKRTHTGEKPYDCKECGKAFTVPSSLQKHVRTHTGEKPYECSDCGKAFIDQSSLKKHTRSHTGEKPYECNQCGKSFSTGSYLIVHKRTHTGEKTYECKECGKAFRNSSCLRVHVRTHTGEKPYKCIQCEKAFSTSTNLIMHKRIHNGQKLHE

SEQ ID NO: 99157 - protein, 549 aa, Homo sapiens
  Payload ID: 19785
  Gene Name: zinc finger protein 18
  Uniprot ID: P17022
  ENSP ID: ENSP00000315664
MPVDLGQALGLLPSLAKAEDSQFSESDAALQEELSSPETARQLFRQFRYQVMSGPHETLKQLRKLCFQWLQPEVHTKEQILEILMLEQFLTILPGEIQMWVRKQCPGSGEEAVTLVESLKGDPQRLWQWISIQVLGQDILSEKMESPSCQVGEVEPHLEVVPQELGLENSSSGPGELLSHIVKEESDTEAELALAASQPARLEERLIRDQDLGASLLPAAPQEQWRQLDSTQKEQYWDLMLETYGKMVSGAGISHPKSDLTNSIEFGEELAGIYLHVNEKIPRPTCIGDRQENDKENLNLENHRDQELLHASCQASGEVPSQASLRGFFTEDEPGCFGEGENLPEALQNIQDEGTGEQLSPQERISEKQLGQHLPNPHSGEMSTMWLEEKRETSQKGQPRAPMAQKLPTCRECGKTFYRNSQLIFHQRTHTGETYFQCTICKKAFLRSSDFVKHQRTHTGEKPCKCDYCGKGFSDFSGLRHHEKIHTGEKPYKCPICEKSFIQRSNFNRHQRVHTGEKPYKCSHCGKSFSWSSSLDKHQRSHLGKKPFQ

SEQ ID NO: 99158 - protein, 548 aa, Homo sapiens
  Payload ID: 19785
  Gene Name: zinc finger protein 18
  Uniprot ID: P17022
  ENSP ID: ENSP00000391376
MPVDLGQALGLLPSLAKAEDSQFSESDAALQEELSSPETARQLFRQFRYQVMSGPHETLKQLRKLCFQWLQPEVHTKEQILEILMLEQFLTILPGEIQMWVRKQCPGSGEEAVTLVESLKGDPQRLWQWISIQVLGQDILSEKMESPSCQVGEVEPHLEVVPQELGLENSSSGPGELLSHIVKEESDTEAELALAASQPARLEERLIRDQDLGASLLPAAPQEQWRQLDSTQKEQYWDLMLETYGKMVSGGISHPKSDLTNSIEFGEELAGIYLHVNEKIPRPTCIGDRQENDKENLNLENHRDQELLHASCQASGEVPSQASLRGFFTEDEPGCFGEGENLPEALQNIQDEGTGEQLSPQERISEKQLGQHLPNPHSGEMSTMWLEEKRETSQKGQPRAPMAQKLPTCRECGKTFYRNSQLIFHQRTHTGETYFQCTICKKAFLRSSDFVKHQRTHTGEKPCKCDYCGKGFSDFSGLRHHEKIHTGEKPYKCPICEKSFIQRSNFNRHQRVHTGEKPYKCSHCGKSFSWSSSLDKHQRSHLGKKPFQ

SEQ ID NO: 99159 - protein, 549 aa, Homo sapiens; identical to SEQ ID NO: 99157
  Payload ID: 19785
  Gene Name: zinc finger protein 18
  Uniprot ID: P17022
  ENSP ID: ENSP00000462296

SEQ ID NO: 99160 - protein, 232 aa, Homo sapiens
  Payload ID: 19785
  Gene Name: zinc finger protein 18
  ENSP ID: ENSP00000462383
HIVKEESDTEAELALAASQPARLEERLIRDQDLGASLLPAAPQEQWRQLDSTQKEQYWDLMLETYGKMVSGGDRQENDKENLNLENHRDQELLHASCQASGEVPSQASLRGFFTEDEPGCFGEGENLPEALQNIQDEGTGEQLSPQERISEKQLGQHLPNPHSGEMSTMWLEEKRETSQKGQPRAPMAQKLPTCRECGKTFYRNSQLIFHQRTHTGETYFQCTICKKAFLRS

SEQ ID NO: 99161 - protein, 96 aa, Homo sapiens
  Payload ID: 19785
  Gene Name: zinc finger protein 18
  ENSP ID: ENSP00000462416
MPVDLGQALGLLPSLAKAEDSQFSESDAALQEELSSPETARQLFRQFRYQVMSGPHETLKQLRKLCFQWLQPEVHTKEQILEILMLEQFLTILPGE

SEQ ID NO: 99162 - protein, 243 aa, Homo sapiens
  Payload ID: 19785
  Gene Name: zinc finger protein 18
  ENSP ID: ENSP00000462877
  MOD_RES (1)..(1): Any amino acid
XLSHIVKEESDTEAELALAASQPARLEERLIRDQDLGASLLPAAPQWRQLDSTQKEQYWDLMLETYGKMVSGGISHPKSDLTNSIEFGEELAGIYLHVNEKIPRPTCIGDRQENDKENLNLENHRDQELLHASCQASGEVPSQASLRGFFTEDEPGCFGEGENLPEALQNIQDEGTGEQLSPQERISEKQLGQHLPNPHSGEMSTMWLEEKRETSQKGQPRAPMAQKLPTCRECGKTFYRNSQ

SEQ ID NO: 99163 - protein, 549 aa, Homo sapiens; identical to SEQ ID NO: 99157
  Payload ID: 19785
  Gene Name: zinc finger protein 18
  Uniprot ID: P17022
  ENSP ID: ENSP00000463471

SEQ ID NO: 99164 - protein, 692 aa, Homo sapiens
  Payload ID: 19786
  Gene Name: zinc finger protein 180
  Uniprot ID: Q9UJW8
  ENSP ID: ENSP00000221327
MRACAGSTREAGSGAQDLSTLLCLEESMEEQDEKPPEPPKVCAQDSFLPQEIIIKVEGEDTGSLTIPSQEGVNFKIVTVDFTREEQGTCNPAQRTLDRDVILENHRDLVSWDLATAVGKKDSTSKQRIFDEEPANGVKIERFTRDDPWLSSCEEVDDCKDQLEKQQEKQEILLQEVAFTQRKAVIHERVCKSDETGEKSGLNSSLFSSPVIPIRNHFHKHVSHAKKWHLNAAVNSHQKINENETLYENNECGKPPQSIHLIQFTRTQTKDKSYGFSDRIQSFCHGTPLHIHEKIHGGGKTFDFKECGQVLNPKISHNEQQRIPFEESQYKCSETSHSSSLTQNMRNNSEEKPFECNQCGKSFSWSSHLVAHQRTHTGEKPYECSECGKSFSRSSHLVSHQRTHTGEKPYRCNQCGKSFSQSYVLVVHQRTHTGEKPYECNQCGKSFRQSYKLIAHQRTHTGEKPYECNQCGKSFIQSYKLIAHQRIHTGEKPYECNQCGKSFSQSYKLVAHQRTHTGEKPFECNQCGKSFSWSSQLVAHQRTHTGEKPYECSECGKSFNRSSHLVMHQRIHTGEKPYECNQCGKSFSQSYVLVVHQRTHTGEKPYECSQCGKSFRQSSCLTQHQRTHTGEKPFECNQCGKTFSLSARLIVHQRTHTGEKPFTCIQCGKAFINSYKLIRHQATHTEEKLYECN

SEQ ID NO: 99165 - protein, 667 aa, Homo sapiens
  Payload ID: 19786
  Gene Name: zinc finger protein 180
  ENSP ID: ENSP00000375818
MRACAGSTREAGSGAQDLSTLLCLEESMEEQDEKPPEPPKVCAQEGVNFKIVTVDFTREEQGTCNPAQRTLDRDVILENHRDLVSWDLATAVGKKDSTSKQRIFDEEPANGVKIERFTRDDPWLSSCEEVDDCKDQLEKQQEKQEILLQEVAFTQRKAVIHERVCKSDETGEKSGLNSSLFSSPVIPIRNHFHKHVSHAKKWHLNAAVNSHQKINENETLYENNECGKPPQSIHLIQFTRTQTKDKSYGFSDRIQSFCHGTPLHIHEKIHGGGKTFDFKECGQVLNPKISHNEQQRIPFEESQYKCSETSHSSSLTQNMRNNSEEKPFECNQCGKSFSWSSHLVAHQRTHTGEKPYECSECGKSFSRSSHLVSHQRTHTGEKPYRCNQCGKSFSQSYVLVVHQRTHTGEKPYECNQCGKSFRQSYKLIAHQRTHTGEKPYECNQCGKSFIQSYKLIAHQRIHTGEKPYECNQCGKSFSQSYKLVAHQRTHTGEKPFECNQCGKSFSWSSQLVAHQRTHTGEKPYECSECGKSFNRSSHLVMHQRIHTGEKPYECNQCGKSFSQSYVLVVHQRTHTGEKPYECSQCGKSFRQSSCLTQHQRTHTGEKPFECNQCGKTFSLSARLIVHQRTHTGEKPFTCIQCGKAFINSYKLIRHQATHTEEKLYECN

SEQ ID NO: 99166 - protein, 65 aa, Homo sapiens
  Payload ID: 19786
  Gene Name: zinc finger protein 180
  ENSP ID: ENSP00000465426
MRACAGSTREAGSGVQLRTSAPCCAWRRAWKSRMRSPQSPRRSVHRILSFLKRLSSKSREKTLGL

SEQ ID NO: 99167 - protein, 50 aa, Homo sapiens
  Payload ID: 19786
  Gene Name: zinc finger protein 180
  ENSP ID: ENSP00000466516
MEEQDEKPPEPPKVCAQSLALSSRLECSDTILAHCRLKLLGSSHPPASAA

SEQ ID NO: 99168 - protein, 138 aa, Homo sapiens
  Payload ID: 19786
  Gene Name: zinc finger protein 180
  ENSP ID: ENSP00000466726
MRSPQSPRRSVHRWSLALLPRLEYSGMILDHCNLHLLCSSDSPASASQVAGTTGFFPSSRDYHQSRGRRHWVSDHPISGRSELQNCDCGLHTGGTGYLQPCSEDPGQRCDPGEPQGPSLLGLGNCSWKKRFNFKAEDF

SEQ ID NO: 99169 - protein, 183 aa, Homo sapiens
  Payload ID: 19786
  Gene Name: zinc finger protein 180
  ENSP ID: ENSP00000467916
MEEQDEKPPEPPKVCAQDSFLPQEIIIKVEGEDTGSLTIPSQEGVNFKIVTVDFTREEQGTCNPAQRTLDRDVILENHRDLVSWDLATAVGKKDSTSKQRIFDEEPANGVKIERFTRDDPWLSSCEEVDDCKDQLEKQQEKQEILLQEVAFTQRKAVIHERVCKSDETGEKSGLNSSLFSSPV

SEQ ID NO: 99170 - protein, 665 aa, Homo sapiens
  Payload ID: 19786
  Gene Name: zinc finger protein 180
  ENSP ID: ENSP00000468021
MEEQDEKPPEPPKVCAQDSFLPQEIIIKVEGEDTGSLTIPSQEGVNFKIVTVDFTREEQGTCNPAQRTLDRDVILENHRDLVSWDLATAVGKKDSTSKQRIFDEEPANGVKIERFTRDDPWLSSCEEVDDCKDQLEKQQEKQEILLQEVAFTQRKAVIHERVCKSDETGEKSGLNSSLFSSPVIPIRNHFHKHVSHAKKWHLNAAVNSHQKINENETLYENNECGKPPQSIHLIQFTRTQTKDKSYGFSDRIQSFCHGTPLHIHEKIHGGGKTFDFKECGQVLNPKISHNEQQRIPFEESQYKCSETSHSSSLTQNMRNNSEEKPFECNQCGKSFSWSSHLVAHQRTHTGEKPYECSECGKSFSRSSHLVSHQRTHTGEKPYRCNQCGKSFSQSYVLVVHQRTHTGEKPYECNQCGKSFRQSYKLIAHQRTHTGEKPYECNQCGKSFIQSYKLIAHQRIHTGEKPYECNQCGKSFSQSYKLVAHQRTHTGEKPFECNQCGKSFSWSSQLVAHQRTHTGEKPYECSECGKSFNRSSHLVMHQRIHTGEKPYECNQCGKSFSQSYVLVVHQRTHTGEKPYECSQCGKSFRQSSCLTQHQRTHTGEKPFECNQCGKTFSLSARLIVHQRTHTGEKPFTCIQCGKAFINSYKLIRHQATHTEEKLYECN

SEQ ID NO: 99171 - protein, 65 aa, Homo sapiens; identical to SEQ ID NO: 99166
  Payload ID: 19786
  Gene Name: zinc finger protein 180
  ENSP ID: ENSP00000468523

SEQ ID NO: 99172 - protein, 615 aa, Homo sapiens
  Payload ID: 19787
  Gene Name: zinc finger protein 181
  ENSP ID: ENSP00000376065
MPQLQYPEGYLAPNRCLVSNCGVNKMSNDELVGQNHGMEGEACIGGDVTFNDVAIDFTHEEWGWLSSAQRDLYKDVMVQNYENLVSVAGLSVTKPYVITLLEDGKEPWMMEKKLSKGMIPDWESRWENKELSTKKDNYDEDSPQTVIIEKVVKQSYEFSNSKKNLEYIEKLEGKHGSQVDHFRPAILTSRESPTADSVYKYNIFRSTFHSKSTLSEPQKISAEGNSHKYDILKKNLPKKSVIKNEKVNGGKKLLNSNKSGAAFSQGKSLTLPQTCNREKIYTCSECGKAFGKQSILNRHWRIHTGEKPYECRECGKTFSHGSSLTRHLISHSGEKPYKCIECGKAFSHVSSLTNHQSTHTGEKPYECMNCGKSFSRVSHLIEHLRIHTQEKLYECRICGKAFIHRSSLIHHQKIHTGEKPYECRECGKAFCCSSHLTRHQRIHTMEKQYECNKCLKVFSSLSFLVQHQSIHTEEKPFECQKCRKSFNQLESLNMHLRNHIRLKPYECSICGKAFSHRSSLLQHHRIHTGEKPYECIKCGKTFSCSSNLTVHQRIHTGEKPYKCNECGKAFSKGSNLTAHQRVHNGEKPNSVVSVEKPLDYMNHYTCEKSYRRETV

SEQ ID NO: 99173 - protein, 570 aa, Homo sapiens
  Payload ID: 19787
  Gene Name: zinc finger protein 181
  Uniprot ID: Q2M3W8
  ENSP ID: ENSP00000419435
MPQVTFNDVAIDFTHEEWGWLSSAQRDLYKDVMVQNYENLVSVGLSVTKPYVITLLEDGKEPWMMEKKLSKGMIPDWESRWENKELSTKKDNYDEDSPQTVIIEKVVKQSYEFSNSKKNLEYIEKLEGKHGSQVDHFRPAILTSRESPTADSVYKYNIFRSTFHSKSTLSEPQKISAEGNSHKYDILKKNLPKKSVIKNEKVNGGKKLLNSNKSGAAFSQGKSLTLPQTCNREKIYTCSECGKAFGKQSILNRHWRIHTGEKPYECRECGKTFSHGSSLTRHLISHSGEKPYKCIECGKAFSHVSSLTNHQSTHTGEKPYECMNCGKSFSRVSHLIEHLRIHTQEKLYECRICGKAFIHRSSLIHHQKIHTGEKPYECRECGKAFCCSSHLTRHQRIHTMEKQYECNKCLKVFSSLSFLVQHQSIHTEEKPFECQKCRKSFNQLESLNMHLRNHIRLKPYECSICGKAFSHRSSLLQHHRIHTGEKPYECIKCGKTFSCSSNLTVHQRIHTGEKPYKCNECGKAFSKGSNLTAHQRVHNGEKPNSVVSVEKPLDYMNHYTCEKSYRRETV

SEQ ID NO: 99174 - protein, 571 aa, Homo sapiens
  Payload ID: 19787
  Gene Name: zinc finger protein 181
  Uniprot ID: Q2M3W8
  ENSP ID: ENSP00000420727
MPQVTFNDVAIDFTHEEWGWLSSAQRDLYKDVMVQNYENLVSVAGLSVTKPYVITLLEDGKEPWMMEKKLSKGMIPDWESRWENKELSTKKDNYDEDSPQTVIIEKVVKQSYEFSNSKKNLEYIEKLEGKHGSQVDHFRPAILTSRESPTADSVYKYNIFRSTFHSKSTLSEPQKISAEGNSHKYDILKKNLPKKSVIKNEKVNGGKKLLNSNKSGAAFSQGKSLTLPQTCNREKIYTCSECGKAFGKQSILNRHWRIHTGEKPYECRECGKTFSHGSSLTRHLISHSGEKPYKCIECGKAFSHVSSLTNHQSTHTGEKPYECMNCGKSFSRVSHLIEHLRIHTQEKLYECRICGKAFIHRSSLIHHQKIHTGEKPYECRECGKAFCCSSHLTRHQRIHTMEKQYECNKCLKVFSSLSFLVQHQSIHTEEKPFECQKCRKSFNQLESLNMHLRNHIRLKPYECSICGKAFSHRSSLLQHHRIHTGEKPYECIKCGKTFSCSSNLTVHQRIHTGEKPYKCNECGKAFSKGSNLTAHQRVHNGEKPNSVVSVEKPLDYMNHYTCEKSYRRETV

SEQ ID NO: 99175 - protein, 110 aa, Homo sapiens
  Payload ID: 19787
  Gene Name: zinc finger protein 181
  ENSP ID: ENSP00000471063
MPQVTFNDVAIDFTHEEWGWLSSAQRDLYKDVMVQNYENLVSVAGLSVTKPYVITLLEDGKEPWMMEKKLSKDWESRWENKELSTKKDNYDEDSPQTVIIEKVVKQSYEF

SEQ ID NO: 99176 - protein, 75 aa, Homo sapiens
  Payload ID: 19787
  Gene Name: zinc finger protein 181
  ENSP ID: ENSP00000472046
MPQVTFNDVAIDFTHEEWGWLSSAQRDLYKDVMVQNYENLVSVGLSVTKPYVITLLEDGKEPWMMEKKLSKGMIP

SEQ ID NO: 99177 - protein, 144 aa, Homo sapiens
  Payload ID: 19787
  Gene Name: zinc finger protein 181
  ENSP ID: ENSP00000473016
MPQVTFNDVAIDFTHEEWGWLSSAQRDLYKDVMVQNYENLVSVGLSVTKPYVITLLEDGKEPWMMEKKLSKGMIPDWESRWENKELSTKKDNYDEDSPQTVIIEKVVKQSYEFSNSKKNLEYIEKLEGKHGSQVDHFRPAILTS

SEQ ID NO: 99178 - protein, 639 aa, Homo sapiens
  Payload ID: 19788
  Gene Name: zinc finger protein 182
  Uniprot ID: P17025
  ENSP ID: ENSP00000306351
MTPASASGEDSGSFYSWQKAKREQGLVTFEDVAVDFTQEEWQYLNPPQRTLYRDVMLETYSNLVFVGQQVTKPNLILKLEVEECPAEGKIPFWNFPEVCQVDEQIERQHQDDQDKCLLMQVGFSDKKTIITKSARDCHEFGNILHLSTNLVASIQRPDKHESFGNNMVDNLDLFSRSSAENKYDNGCAKLFFHTEYEKTNPGMKPYGYKECGKGLRRKKGLSLHQRIKNGEKPFECTACRKTFSKKSHLIVHWRTHTGEKPFGCTECGKAFSQKSQLIIHLRTHTGERPFECPECGKAFREKSTVIIHYRTHTGEKPYECNECGKAFTQKSNLIVHQKTHTGEKTYECTKCGESFIQKLDLIIHHSTHTGKKPHECNECKKTFSDKSTLIIHQRTHTGEKPHKCTECGKSFNEKSTLIVHQRTHTGEKPYECDVCGKTFTQKSNLGVHQRTHSGEKPFECNECEKAFSQKSYLMLHQRGHTGEKPYECNECEKAFSQKSYLIIHQRTHTEEKPYKCNECGKAFREKSKLIIHQRIHTGEKPYECPVCWKAFSQKSQLIIHQRTHTGEKPYACTECGKAFREKSTFTVHQRTHTGEKPYKCTECGKAFTQKSNLIVHQRTHAGKKAHGRGHTRKSKFMAH

SEQ ID NO: 99179 - protein, 620 aa, Homo sapiens
  Payload ID: 19788
  Gene Name: zinc finger protein 182
  Uniprot ID: P17025
  ENSP ID: ENSP00000366142
MAKPQGLVTFEDVAVDFTQEEWQYLNPPQRTLYRDVMLETYSNLVFVGQQVTKPNLILKLEVEECPAEGKIPFWNFPEVCQVDEQIERQHQDDQDKCLLMQVGFSDKKTIITKSARDCHEFGNILHLSTNLVASIQRPDKHESFGNNMVDNLDLFSRSSAENKYDNGCAKLFFHTEYEKTNPGMKPYGYKECGKGLRRKKGLSLHQRIKNGEKPFECTACRKTFSKKSHLIVHWRTHTGEKPFGCTECGKAFSQKSQLIIHLRTHTGERPFECPECGKAFREKSTVIIHYRTHTGEKPYECNECGKAFTQKSNLIVHQKTHTGEKTYECTKCGESFIQKLDLIIHHSTHTGKKPHECNECKKTFSDKSTLIIHQRTHTGEKPHKCTECGKSFNEKSTLIVHQRTHTGEKPYECDVCGKTFTQKSNLGVHQRTHSGEKPFECNECEKAFSQKSYLMLHQRGHTGEKPYECNECEKAFSQKSYLIIHQRTHTEEKPYKCNECGKAFREKSKLIIHQRIHTGEKPYECPVCWKAFSQKSQLIIHQRTHTGEKPYACTECGKAFREKSTFTVHQRTHTGEKPYKCTECGKAFTQKSNLIVHQRTHAGKKAHGRGHTRKSKFMAH

SEQ ID NO: 99180 - protein, 639 aa, Homo sapiens; identical to SEQ ID NO: 99178
  Payload ID: 19788
  Gene Name: zinc finger protein 182
  Uniprot ID: P17025
  ENSP ID: ENSP00000380165

SEQ ID NO: 99181 - protein, 751 aa, Homo sapiens
  Payload ID: 19789
  Gene Name: zinc finger protein 184
  Uniprot ID: Q99676
  ENSP ID: ENSP00000211936
MEDLSSPDSTLLQGGHNLLSSASFQEAVTFKDVIVDFTQEEWKQLDPGQRDLFRDVTLENYTHLVSIGLQVSKPDVISQLEQGTEPWIMEPSIPVGTCADWETRLENSVSAPEPDISEEELSPEVIVEKHKRDDSWSSNLLESWEYEGSLERQQANQQTLPKEIKVTEKTIPSWEKGPVNNEFGKSVNVSSNLVTQEPSPEETSTKRSIKQNSNPVKKEKSCKCNECGKAFSYCSALIRHQRTHTGEKPYKCNECEKAFSRSENLINHQRIHTGDKPYKCDQCGKGFIEGPSLTQHQRIHTGEKPYKCDECGKAFSQRTHLVQHQRIHTGEKPYTCNECGKAFSQRGHFMEHQKIHTGEKPFKCDECDKTFTRSTHLTQHQKIHTGEKTYKCNECGKAFNGPSTFIRHHMIHTGEKPYECNECGKAFSQHSNLTQHQKTHTGEKPYDCAECGKSFSYWSSLAQHLKIHTGEKPYKCNECGKAFSYCSSLTQHRRIHTREKPFECSECGKAFSYLSNLNQHQKTHTQEKAYECKECGKAFIRSSSLAKHERIHTGEKPYQCHECGKTFSYGSSLIQHRKIHTGERPYKCNECGRAFNQNIHLTQHKRIHTGAKPYECAECGKAFRHCSSLAQHQKTHTEEKPYQCNKCEKTFSQSSHLTQHQRIHTGEKPYKCNECDKAFSRSTHLTEHQNTHTGEKPYNCNECRKTFSQSTYLIQHQRIHSGEKPFGCNDCGKSFRYRSALNKHQRLHPGI

SEQ ID NO: 99182 - protein, 751 aa, Homo sapiens; identical to SEQ ID NO: 99181
  Payload ID: 19789
  Gene Name: zinc finger protein 184
  Uniprot ID: Q99676
  ENSP ID: ENSP00000366636

SEQ ID NO: 99183 - protein, 630 aa, Homo sapiens
  Payload ID: 19790
  Gene Name: zinc finger protein 185 (LIM domain)
  Uniprot ID: O15231
  ENSP ID: ENSP00000312782
MSISALGGRTKGKPLPPGEEERNNVLKQMKVRTTLKGDKSWITKQDESEGRTIELPSGRSRATSFSSAGEVPKPRPPSTRAPTGYIIRGVFTKPIDSSSQPQQQFPKANGTPKSAASLVRTANAGPPRPSSSGYKMTTEDYKKLAPYNIRRSSTSGDTEEEEEEEVVPFSSDEQKRRSEAASGVLRRTAPREHSYVLSAAKKSTGPTQETQAPFIAKRVEVVEEDGPSEKSQDPPALARSTPGSNRSSPGNKDKEAPCSRELQRDLAGEEAFRAPNTDAARSSAQLSDGNVGSGATGSRPEGLAAVDIGSERGSSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 99184 - protein, 468 aa, Homo sapiens
  Payload ID: 19790
  Gene Name: zinc finger protein 185 (LIM domain)
  Uniprot ID: O15231
  ENSP ID: ENSP00000313919
MTTEDYKKLAPYNIRRSSTSGDTEEEEEEEVVPFSSDEQKRSSPTQETQAPFIAKRVEVVEEDGPSEKSQDPPALARSTPGSNRSSPGNKDKEAPCSRELQRDLAGEEAFRAPNTDAARSSAQLSDGNVGSGATGSRPEGLAAVDIGSERGSSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 99185 - protein, 452 aa, Homo sapiens
  Payload ID: 19790
  Gene Name: zinc finger protein 185 (LIM domain)
  Uniprot ID: O15231
  ENSP ID: ENSP00000325307
MQRQAPYNIRRSSTSGDTEEEEEEEVVPFSSDEQKRRSEAASGVLRRTAPREHSYVLSAAKKSTGSPTQETQAPFIAKRVEVVEEDGPSEKSQDPPALARSTPGSNSSRGEEIVRLQILTPRAGLRLVAPDVEGMSSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 99186 - protein, 689 aa, Homo sapiens
  Payload ID: 19790
  Gene Name: zinc finger protein 185 (LIM domain)
  Uniprot ID: O15231
  ENSP ID: ENSP00000359291
MSISALGGRTKGKPLPPGEEERNNVLKQMKVRTTLKGDKSWITKQDESEGRTIELPSGRSRATSFSSAGEVPKPRPPSTRAPTGYIIRGVFTKPIDSSSQPQQQFPKANGTPKSAASLVRTANAGPPRPSSSGYKMTTEDYKKLAPYNIRRSSTSGDTEEEEEEEVVPFSSDEQKRRSEAASGVLRRTAPREHSYVLSAAKKSTGPTQETQAPFIAKRVEVVEEDGPSEKSQDPPALARSTPGSNSADGGRTKASRAIWIECLPSMPSPAGSQELSSRGEEIVRLQILTPRAGLRLVAPDVEGMRSSPGNKDKEAPCSRELQRDLAGEEAFRAPNTDAARSSAQLSDGNVGSGATGSRPEGLAAVDIGSERGSSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 99187 - protein, 721 aa, Homo sapiens
  Payload ID: 19790
  Gene Name: zinc finger protein 185 (LIM domain)
  Uniprot ID: O15231
  ENSP ID: ENSP00000359293
MSISALGGRTKGKPLPPGEEERNNVLKQMKVRTTLKGDKSWITKQDESEGRTIELPSGRSRATSFSSAGEVPKPRPPSTRAPTGYIIRGVFTKPIDSSSQPQQQFPKANGTPKSAASLVRTANAGPPRPSSSGYKMTTEDYKKLAPYNIRRSSTSGDTEEEEEEEVVPFSSDEQKRRSEAASGVLRRTAPREHSYVLSAAKKSTGPTQETQAPFIAKRVEVVEEDGPSEKSQDPPALARSTPGSNSADGGRTKASRAIWIECLPSMPSPAGSQELSSRGEEIVRLQILTPRAGLRLVAPDVEGMRSSPGNKDKEAPCSRELQRDLAGEEAFRAPNTDAARSSAQLSDGNVGSGATGSRPEGLAAVDIGSERGRLCAAASFASFLEDQDGHSANSQSCKPRPAAISSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 99188 - protein, 552 aa, Homo sapiens
  Payload ID: 19790
  Gene Name: zinc finger protein 185 (LIM domain)
  ENSP ID: ENSP00000391272
MSISALGGRTKGKPLPPGEEERNNVLKQMKVRTTLKGDKSWITKQDESEGRTIELPSGRSRATSFSSAGEVPKPRPPSTRAPTGYIIRGVFTKPIDSSSQPQQQFPKANGTPKSAASLVRTANAGPPRPSSSGYKMTTEDYKKLAPYNIRRSSTSGDTEEEEEEEVVPFSSDEQKRRSEAASGVLRRTAPREHSYVLSAAKKSTGPTQETQAPFIAKRVEVVEEDGPSEKSQDPPALARSTPGSNSADGGRTKASRAIWIECLPSMPSPAGSQELRSSPGNKDKEAPCSRELQRDLAGEEAFRAPNTDAARSSAQLSDGNVGSGATGSRPEGLAAVDIGSERGRLCAAASFASFLEDQDGHSANSQSCKPRPAAISSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRYEPNCTGTLPARAR

SEQ ID NO: 99189 - protein, 327 aa, Homo sapiens
  Payload ID: 19790
  Gene Name: zinc finger protein 185 (LIM domain)
  Uniprot ID: O15231
  ENSP ID: ENSP00000392984
MAARDELGLGGDSLEAMPVPAARGRPRITNGPEELAAPSPAALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 99190 - protein, 690 aa, Homo sapiens
  Payload ID: 19790
  Gene Name: zinc finger protein 185 (LIM domain)
  Uniprot ID: O15231
  ENSP ID: ENSP00000395228
MSISALGGRTKGKPLPPGEEERNNVLKQMKVRTTLKGDKSWITKQDESEGRTIELPSGRSRATSFSSAGEVPKPRPPSTRAPTGYIIRGVFTKPIDSSSQPQQQFPKANGTPKSAASLVRTANAGPPRPSSSGYKMTTEDYKKLAPYNIRRSSTSGDTEEEEEEEVVPFSSDEQKRRSEAASGVLRRTAPREHSYVLSAAKKSTGSPTQETQAPFIAKRVEVVEEDGPSEKSQDPPALARSTPGSNSADGGRTKASRAIWIECLPSMPSPAGSQELSSRGEEIVRLQILTPRAGLRLVAPDVEGMRSSPGNKDKEAPCSRELQRDLAGEEAFRAPNTDAARSSAQLSDGNVGSGATGSRPEGLAAVDIGSERGSSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 99191 - protein, 185 aa, Homo sapiens
  Payload ID: 19790
  Gene Name: zinc finger protein 185 (LIM domain)
  ENSP ID: ENSP00000401766
  MOD_RES (1)..(1): Any amino acid
XSPTQETQAPFIAKRVEVVEEDGPSEKSQDPPALARSTPGSNSADGGRTKASRAIWIECLPSMPSPAGSQELRSSPGNKDKEAPCSRELQRDLAGEEAFRAPNTDAASSSATSVSAVPADRKSNSTAAQEDAKADPKGVLTDFEGKDVATKVGEAWQDRPGAPRGGQGDPAVPTQQPADPSTPEQ

SEQ ID NO: 99192 - protein, 448 aa, Homo sapiens
  Payload ID: 19790
  Gene Name: zinc finger protein 185 (LIM domain)
  ENSP ID: ENSP00000409121
  MOD_RES (1)..(1): Any amino acid
XLRRTAPREHSYVLSAAKKSTGSPTQETQAPFIAKRVEVVEEDGPSEKSQDPPALARSTPGSNRSSPGNKDKEAPCSRELQRDLAGEEAFRAPNTDAARSSAQLSDGNVGSGATGSRPEGLAAVDIGSERGSSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 99193 - protein, 721 aa, Homo sapiens; identical to SEQ ID NO: 99187
  Payload ID: 19790
  Gene Name: zinc finger protein 185 (LIM domain)
  Uniprot ID: O15231
  ENSP ID: ENSP00000440847

SEQ ID NO: 99194 - protein, 692 aa, Homo sapiens
  Payload ID: 19790
  Gene Name: zinc finger protein 185 (LIM domain)
  Uniprot ID: O15231
  ENSP ID: ENSP00000444367
MSISALGGRTKGKPLPPGEEERNNVLKQMKVRTTLKGDKSWITKQDESEGRTIELPSGRSRATSFSSAGEVPKPRPPSTRAPTGYIIRGVFTKPIDSSSQPQQQFPKANGTPKSAASLVRTANAGPPRPSSSGYKMTTEDYKKLAPYNIRRSSTSGDTEEEEEEEVVPFSSDEQKRRSEAASGVLRRTAPREHSYVLSAAKKSTGPTQETQAPFIAKRVEVVEEDGPSEKSQDPPALARSTPGSNSADGGRTKASRAIWIECLPSMPSPAGSQELRSSPGNKDKEAPCSRELQRDLAGEEAFRAPNTDAARSSAQLSDGNVGSGATGSRPEGLAAVDIGSERGRLCAAASFASFLEDQDGHSANSQSCKPRPAAISSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 99195 - protein, 584 aa, Homo sapiens
  Payload ID: 19791
  Gene Name: zinc finger protein 189
  Uniprot ID: O75820
  ENSP ID: ENSP00000259395
MMENYGNLVSLDVLNRDKDEEPTVKQEIEEIEEEVEPQGVIVTRIKSEIDQDPMGRETFELVGRLDKQRGIFLWEIPRESLTQEQRMFRENTNIIRKRPNSEEKCHKCEECGKGFVRKAHFIQHQRVHTGEKPFQCNECGKSFSRSSFVIEHQRIHTGERPYECNYCGKTFSVSSTLIRHQRIHTGERPYQCNQCKQSFSQRRSLVKHQRIHTGEKPHKCSDCGKAFSWKSHLIEHQRTHTGEKPYHCTKCKKSFSRNSLLVEHQRIHTGERPHKCGECGKAFRLSTYLIQHQKIHTGEKPFLCIECGKSFSRSSFLIEHQRIHTGERPYQCKECGKSFSQLCNLTRHQRIHTGDKPHKCEECGKAFSRSSGLIQHQRIHTREKTYPYNETKESFDPNCSLVIQQEVYPKEKSYKCDECGKTFSVSAHLVQHQRIHTGEKPYLCTVCGKSFSRSSFLIEHQRIHTGERPYLCRQCGKSFSQLCNLIRHQGVHTGNKPHKCDECGKAFSRNSGLIQHQRIHTGEKPYKCEKCDKSFSQQRSLVNHQKIHAEVKTQETHECDACGEAFNCRISLIQHQKLHTAWMQ

SEQ ID NO: 99196 - protein, 626 aa, Homo sapiens
  Payload ID: 19791
  Gene Name: zinc finger protein 189
  Uniprot ID: O75820
  ENSP ID: ENSP00000342019
MASPSPPPESKGLLTFEDVAVFFTQEEWDYLDPAQRSLYKDVMMENYGNLVSLDVLNRDKDEEPTVKQEIEEIEEEVEPQGVIVTRIKSEIDQDPMGRETFELVGRLDKQRGIFLWEIPRESLTQEQRMFRENTNIIRKRPNSEEKCHKCEECGKGFVRKAHFIQHQRVHTGEKPFQCNECGKSFSRSSFVIEHQRIHTGERPYECNYCGKTFSVSSTLIRHQRIHTGERPYQCNQCKQSFSQRRSLVKHQRIHTGEKPHKCSDCGKAFSWKSHLIEHQRTHTGEKPYHCTKCKKSFSRNSLLVEHQRIHTGERPHKCGECGKAFRLSTYLIQHQKIHTGEKPFLCIECGKSFSRSSFLIEHQRIHTGERPYQCKECGKSFSQLCNLTRHQRIHTGDKPHKCEECGKAFSRSSGLIQHQRIHTREKTYPYNETKESFDPNCSLVIQQEVYPKEKSYKCDECGKTFSVSAHLVQHQRIHTGEKPYLCTVCGKSFSRSSFLIEHQRIHTGERPYLCRQCGKSFSQLCNLIRHQGVHTGNKPHKCDECGKAFSRNSGLIQHQRIHTGEKPYKCEKCDKSFSQQRSLVNHQKIHAEVKTQETHECDACGEAFNCRISLIQHQKLHTAWMQ

SEQ ID NO: 99197 - protein, 612 aa, Homo sapiens
  Payload ID: 19791
  Gene Name: zinc finger protein 189
  Uniprot ID: O75820
  ENSP ID: ENSP00000363995
MASPSPPPESKEEWDYLDPAQRSLYKDVMMENYGNLVSLDVLNRDKDEEPTVKQEIEEIEEEVEPQGVIVTRIKSEIDQDPMGRETFELVGRLDKQRGIFLWEIPRESLTQEQRMFRENTNIIRKRPNSEEKCHKCEECGKGFVRKAHFIQHQRVHTGEKPFQCNECGKSFSRSSFVIEHQRIHTGERPYECNYCGKTFSVSSTLIRHQRIHTGERPYQCNQCKQSFSQRRSLVKHQRIHTGEKPHKCSDCGKAFSWKSHLIEHQRTHTGEKPYHCTKCKKSFSRNSLLVEHQRIHTGERPHKCGECGKAFRLSTYLIQHQKIHTGEKPFLCIECGKSFSRSSFLIEHQRIHTGERPYQCKECGKSFSQLCNLTRHQRIHTGDKPHKCEECGKAFSRSSGLIQHQRIHTREKTYPYNETKESFDPNCSLVIQQEVYPKEKSYKCDECGKTFSVSAHLVQHQRIHTGEKPYLCTVCGKSFSRSSFLIEHQRIHTGERPYLCRQCGKSFSQLCNLIRHQGVHTGNKPHKCDECGKAFSRNSGLIQHQRIHTGEKPYKCEKCDKSFSQQRSLVNHQKIHAEVKTQETHECDACGEAFNCRISLIQHQKLHTAWMQ

SEQ ID NO: 99198 - protein, 85 aa, Homo sapiens
  Payload ID: 19791
  Gene Name: zinc finger protein 189
  ENSP ID: ENSP00000483461
MASPSPPPESKEEWDYLDPAQRSLYKDVMMENYGNLVSLGLTLLPRLVCSDANTACCSLNLLGLSDQSSHLSYLSSWDYRCFEQR

SEQ ID NO: 99199 - protein, 458 aa, Homo sapiens
  Payload ID: 19792
  Gene Name: zinc finger protein 19
  Uniprot ID: P17023
  ENSP ID: ENSP00000288177
MAAMPLKAQYQEMVTFEDVAVHFTKTEWTGLSPAQRALYRSVMLENFGNLTALGYPVPKPALISLLERGDMAWGLEAQDDPPAERTKNVCKDVETNIDSESTLIQGISEERDGMMSHGQLKSVPQRTDFPETRNVEKHQDIPTVKNIQGKVPRIPCARKPFICEECGKSFSYFSYYARHQRIHTGEKPFECSECGKAFNGNSSLIRHQRIHTGERPYQCEECGRAFNDNANLIRHQRIHSGDRPYYCTECGNSFTSSSEFVIHQRIHTGEKPYECNECGKAFVGNSPLLRHQKIHTGEKPYECNECGKSFGRTSHLSQHQRIHTGEKPYSCKVCGQAFNFHTKLTRHQRIHSEEKPFDCVDCGKAFSAQEQLKRHLRIHTQESSYVCDECGKALTSKRNLHQHQRIHTGEKPYECSKYEKAFGTSSQLGHLEHVYSGEKPVLDICRFGLPEFFTPFYW

SEQ ID NO: 99200 - protein, 63 aa, Homo sapiens
  Payload ID: 19792
  Gene Name: zinc finger protein 19
  ENSP ID: ENSP00000454549
MAAMPLKAQYQEMVTFEDVAVHFTKTEWTGLSPAQRALYRSVMLENFGNLTALGRSHKCSVSC

SEQ ID NO: 99201 - protein, 23 aa, Homo sapiens
  Payload ID: 19792
  Gene Name: zinc finger protein 19
  ENSP ID: ENSP00000454862
MAAMPLKAQYQEMVTFEDVAVHF

SEQ ID NO: 99202 - protein, 416 aa, Homo sapiens
  Payload ID: 19792
  Gene Name: zinc finger protein 19
  ENSP ID: ENSP00000454864
MLENFGNLTALGYPVPKPALISLLERGDMAWGLEAQDDPPAERTKNVCKDVETNIDSESTLIQGISEERDGMMSHGQLKSVPQRTDFPETRNVEKHQDIPTVKNIQGKVPRIPCARKPFICEECGKSFSYFSYYARHQRIHTGEKPFECSECGKAFNGNSSLIRHQRIHTGERPYQCEECGRAFNDNANLIRHQRIHSGDRPYYCTECGNSFTSSSEFVIHQRIHTGEKPYECNECGKAFVGNSPLLRHQKIHTGEKPYECNECGKSFGRTSHLSQHQRIHTGEKPYSCKVCGQAFNFHTKLTRHQRIHSEEKPFDCVDCGKAFSAQEQLKRHLRIHTQESSYVCDECGKALTSKRNLHQHQRIHTGEKPYECSKYEKAFGTSSQLGHLEHVYSGEKPVLDICRFGLPEFFTPFYW

SEQ ID NO: 99203 - protein, 73 aa, Homo sapiens
  Payload ID: 19792
  Gene Name: zinc finger protein 19
  ENSP ID: ENSP00000455575
MAAMPLKAQYQEMVTFEDVAVHFTKTEWTGLSPAQRALYRSVMLENFGNLTALGYPVPKPALISLLERGDMAW

SEQ ID NO: 99204 - protein, 117 aa, Homo sapiens
  Payload ID: 19792
  Gene Name: zinc finger protein 19
  ENSP ID: ENSP00000455796
MAAMPLKAQYQEMVTFEDVAVHFTKTEWTGLSPAQRALYRSVMLENFGNLTALGYPVPKPALISLLERGDMAWGLEAQDDPPAERTKNVCKDVETNIDSESTLIQGISEERDGMMSH

SEQ ID NO: 99205 - protein, 45 aa, Homo sapiens
  Payload ID: 19792
  Gene Name: zinc finger protein 19
  ENSP ID: ENSP00000456143
MAAMPLKAQYQDFPSSPYLSPLPHTLARSQRIGSGAAGTCCFRRW

SEQ ID NO: 99206 - protein, 5 aa, Homo sapiens
  Payload ID: 19792
  Gene Name: zinc finger protein 19
  ENSP ID: ENSP00000457992
MAAMP

SEQ ID NO: 99207 - protein, 458 aa, Homo sapiens; identical to SEQ ID NO: 99199
  Payload ID: 19792
  Gene Name: zinc finger protein 19
  Uniprot ID: P17023
  ENSP ID: ENSP00000458105

SEQ ID NO: 99208 - protein, 80 aa, Homo sapiens
  Payload ID: 19792
  Gene Name: zinc finger protein 19
  ENSP ID: ENSP00000462021
VTFEDVAVHFTKTEWTGLSPAQRALYRSVMLENFGNLTALGYPVPKPALISLLERGDMAWGLEAQDDPPAERTKNVCKGR

SEQ ID NO: 99209 - protein, 100 aa, Homo sapiens
  Payload ID: 19792
  Gene Name: zinc finger protein 19
  ENSP ID: ENSP00000462566
MAAMPLKAQYQEMVTFEDVAVHFTKTEWTGLSPAQRALYRSVMLENFGNLTALGYPVPKPALISLLERGDMAWGLEAQDDPPAERTKNVCKDESLEFQKS

SEQ ID NO: 99210 - protein, 388 aa, Homo sapiens
  Payload ID: 19792
  Gene Name: zinc finger protein 19
  ENSP ID: ENSP00000462810
MAWGLEAQDDPPAERTKNVCKDVETNIDSESTLIQGISEERDGMMSHGQLKSVPQRTDFPETRNVEKHQDIPTVKNIQGKVPRIPCARKPFICEECGKSFSYFSYYARHQRIHTGEKPFECSECGKAFNGNSSLIRHQRIHTGERPYQCEECGRAFNDNANLIRHQRIHSGDRPYYCTECGNSFTSSSEFVIHQRIHTGEKPYECNECGKAFVGNSPLLRHQKIHTGEKPYECNECGKSFGRTSHLSQHQRIHTGEKPYSCKVCGQAFNFHTKLTRHQRIHSEEKPFDCVDCGKAFSAQEQLKRHLRIHTQESSYVCDECGKALTSKRNLHQHQRIHTGEKPYECSKYEKAFGTSSQLGHLEHVYSGEKPVLDICRFGLPEFFTPFYW

SEQ ID NO: 99211 - protein, 606 aa, Homo sapiens
  Payload ID: 19793
  Gene Name: zinc finger protein 195
  Uniprot ID: O14628
  ENSP ID: ENSP00000005082
MTLLTFRDVAIEFSLEEWKCLDLAQQNLYRDVMLENYRNLFSVGLTVCKPGLITCLEQRKEPWNVKRQEAADGHPEMGFHHATQACLELLGSSDLPASASQSAGITGVNHRAQPGLNVSVDKFTAMSSHFTQDLLPEQGIQDAFPKRILRGYGNCGLDNLYLRKDWESLDECKLQKDYNGLNQCSSTTHSKIFQYNKYVKIFDNFSNLHRRNISNTGEKPFKCQECGKSFQMLSFLTEHQKIHTGKKFQKCGECGKTFIQCSHFTEPENIDTGEKPYKCQECNNVIKTCSVLTKNRIYAGGEHYRCEEFGKVFNQCSHLTEHEHGTEEKPCKYEECSSVFISCSSLSNQQMILAGEKLSKCETWYKGFNHSPNPSKHQRNEIGGKPFKCEECDSIFKWFSDLTKHKRIHTGEKPYKCDECGKAYTQSSHLSEHRRIHTGEKPYQCEECGKVFRTCSSLSNHKRTHSEEKPYTCEECGNIFKQLSDLTKHKKTHTGEKPYKCDECGKNFTQSSNLIVHKRIHTGEKPYKCEECGRVFMWFSDITKHKKTHTGEKPYKCDECGKNFTQSSNLIVHKRIHTGEKPYKCEKCGKAFTQFSHLTVHESIHT

SEQ ID NO: 99212 - protein, 561 aa, Homo sapiens
  Payload ID: 19793
  Gene Name: zinc finger protein 195
  Uniprot ID: O14628
  ENSP ID: ENSP00000344483
MAGAQTLLTFRDVAIEFSLEEWKCLDLAQQNLYRDVMLENYRNLFSVGLTVCKPGLITCLEQRKEPWNVKRQEAADGHPAMSSHFTQDLLPEQGIQDAFPKRILRGYGNCGLDNLYLRKDWESLDECKLQKDYNGLNQCSSTTHSKIFQYNKYVKIFDNFSNLHRRNISNTGEKPFKCQECGKSFQMLSFLTEHQKIHTGKKFQKCGECGKTFIQCSHFTEPENIDTGEKPYKCQECNNVIKTCSVLTKNRIYAGGEHYRCEEFGKVFNQCSHLTEHEHGTEEKPCKYEECSSVFISCSSLSNQQMILAGEKLSKCETWYKGFNHSPNPSKHQRNEIGGKPFKCEECDSIFKWFSDLTKHKRIHTGEKPYKCDECGKAYTQSSHLSEHRRIHTGEKPYQCEECGKVFRTCSSLSNHKRTHSEEKPYTCEECGNIFKQLSDLTKHKKTHTGEKPYKCDECGKNFTQSSNLIVHKRIHTGEKPYKCEECGRVFMWFSDITKHKKTHTGEKPYKCDECGKNFTQSSNLIVHKRIHTGEKPYKCEKCGKAFTQFSHLTVHESIHT

SEQ ID NO: 99213 - protein, 557 aa, Homo sapiens
  Payload ID: 19793
  Gene Name: zinc finger protein 195
  Uniprot ID: O14628
  ENSP ID: ENSP00000346613
MTLLTFRDVAIEFSLEEWKCLDLAQQNLYRDVMLENYRNLFSVGLTVCKPGLITCLEQRKEPWNVKRQEAADGHPAMSSHFTQDLLPEQGIQDAFPKRILRGYGNCGLDNLYLRKDWESLDECKLQKDYNGLNQCSSTTHSKIFQYNKYVKIFDNFSNLHRRNISNTGEKPFKCQECGKSFQMLSFLTEHQKIHTGKKFQKCGECGKTFIQCSHFTEPENIDTGEKPYKCQECNNVIKTCSVLTKNRIYAGGEHYRCEEFGKVFNQCSHLTEHEHGTEEKPCKYEECSSVFISCSSLSNQQMILAGEKLSKCETWYKGFNHSPNPSKHQRNEIGGKPFKCEECDSIFKWFSDLTKHKRIHTGEKPYKCDECGKAYTQSSHLSEHRRIHTGEKPYQCEECGKVFRTCSSLSNHKRTHSEEKPYTCEECGNIFKQLSDLTKHKKTHTGEKPYKCDECGKNFTQSSNLIVHKRIHTGEKPYKCEECGRVFMWFSDITKHKKTHTGEKPYKCDECGKNFTQSSNLIVHKRIHTGEKPYKCEKCGKAFTQFSHLTVHESIHT

SEQ ID NO: 99214 - protein, 629 aa, Homo sapiens
  Payload ID: 19793
  Gene Name: zinc finger protein 195
  Uniprot ID: O14628
  ENSP ID: ENSP00000382511
MTLLTFRDVAIEFSLEEWKCLDLAQQNLYRDVMLENYRNLFSVGLTVCKPGLITCLEQRKEPWNVKRQEAADGHPEMGFHHATQACLELLGSSDLPASASQSAGITGVNHRAQPGLNVSVDKFTALCSPGVLQTVKWFLEFRCIFSLAMSSHFTQDLLPEQGIQDAFPKRILRGYGNCGLDNLYLRKDWESLDECKLQKDYNGLNQCSSTTHSKIFQYNKYVKIFDNFSNLHRRNISNTGEKPFKCQECGKSFQMLSFLTEHQKIHTGKKFQKCGECGKTFIQCSHFTEPENIDTGEKPYKCQECNNVIKTCSVLTKNRIYAGGEHYRCEEFGKVFNQCSHLTEHEHGTEEKPCKYEECSSVFISCSSLSNQQMILAGEKLSKCETWYKGFNHSPNPSKHQRNEIGGKPFKCEECDSIFKWFSDLTKHKRIHTGEKPYKCDECGKAYTQSSHLSEHRRIHTGEKPYQCEECGKVFRTCSSLSNHKRTHSEEKPYTCEECGNIFKQLSDLTKHKKTHTGEKPYKCDECGKNFTQSSNLIVHKRIHTGEKPYKCEECGRVFMWFSDITKHKKTHTGEKPYKCDECGKNFTQSSNLIVHKRIHTGEKPYKCEKCGKAFTQFSHLTVHESIHT

SEQ ID NO: 99215 - protein, 561 aa, Homo sapiens; identical to SEQ ID NO: 99212
  Payload ID: 19793
  Gene Name: zinc finger protein 195
  Uniprot ID: O14628
  ENSP ID: ENSP00000387998

SEQ ID NO: 99216 - protein, 119 aa, Homo sapiens
  Payload ID: 19793
  Gene Name: zinc finger protein 195
  ENSP ID: ENSP00000390663
MPWAERNLLVYSSSKETLLTFRDVAIEFSLEEWKCLDLAQQNLYRDVMLENYRNLFSVGLTVCKPGLITCLEQRKEPWNVKRQEAADGHPAMSSHFTQDLLPEQGIQDAFPKRILRGYG

SEQ ID NO: 99217 - protein, 90 aa, Homo sapiens
  Payload ID: 19793
  Gene Name: zinc finger protein 195
  Uniprot ID: O14628
  ENSP ID: ENSP00000414353
MAGAQTLLTFRDVAIEFSLEEWKCLDLAQQNLYRDVMLENYRNLFSVGLTVCKPGLITCLEQRKEPWNVKRQEAADGHPGIFFVVTMEII

SEQ ID NO: 99218 - protein, 278 aa, Homo sapiens
  Payload ID: 19793
  Gene Name: zinc finger protein 195
  ENSP ID: ENSP00000431937
MAGAQTLLTFRDVAIEFSLEEWKCLDLAQQNLYRDVMLENYRNLFSVGLTVCKPGLITCLEQRKEPWNVKRQEAADGHPALCSPGVLQTVKWFLEFRCIFSLAMSSHFTQDLLPEQGIQDAFPKRILRGYGNCGLDNLYLRKDWESLDECKLQKDYNGLNQCSSTTHSKIFQYNKYVKIFDNFSNLHRRNISNTGEKPFKCQECGKSFQMLSFLTEHQKIHTGKKFQKCGECGKTFIQCSHFTEPENIDTGEKPYKCQECNNVIKTCSVLTKNRIYAG

SEQ ID NO: 99219 - protein, 80 aa, Homo sapiens
  Payload ID: 19793
  Gene Name: zinc finger protein 195
  ENSP ID: ENSP00000432552
MTLLTFRDVAIEFSLEEWKCLDLAQQNLYRDVMLENYRNLFSVGLTVCKPGLITCLEQRKEPWNVKRQEAADGHPASANV

SEQ ID NO: 99220 - protein, 79 aa, Homo sapiens
  Payload ID: 19793
  Gene Name: zinc finger protein 195
  ENSP ID: ENSP00000432720
MTLLTFRDVAIEFSLEEWKCLDLAQQNLYRDVMLENYRNLFSVGLTVCKPGLITCLEQRKEPWNVKRQEAADGHPGQHG

SEQ ID NO: 99221 - protein, 217 aa, Homo sapiens
  Payload ID: 19793
  Gene Name: zinc finger protein 195
  ENSP ID: ENSP00000433911
MTLLTFRDVAIEFSLEEWKCLDLAQQNLYRDVMLENYRNLFSVGLTVCKPGLITCLEQRKEPWNVKRQEAADGHPGWKCSGVIVAHCGLHFPGSEMGFHHATQACLELLGSSDLPASASQSAGITGVNHRAQPGLNVSVDKFTAMSSHFTQDLLPEQGIQDAFPKRILRGYGNCGLDNLYLRKDWESLDECKLQKDYNGLNQCSSTTHSKIFQYNKY

SEQ ID NO: 99222 - protein, 146 aa, Homo sapiens
  Payload ID: 19793
  Gene Name: zinc finger protein 195
  ENSP ID: ENSP00000434006
MTLLTFRDVAIEFSLEEWKCLDLAQQNLYRDVMLENYRNLFSVGLTVCKPGLITCLEQRKEPWNVKRQEAADGHPEFHSITQAVVQWCHLSSLQPLLPGLEPSSHFSLLRTWNYRGTPPHPANFCVFNRDRVLPCCPGWSRTPGLK

SEQ ID NO: 99223 - protein, 52 aa, Homo sapiens
  Payload ID: 19793
  Gene Name: zinc finger protein 195
  ENSP ID: ENSP00000434361
GLTVCKPGLITCLEQRKEPWNVKRQEAADGHPGCTFFETGIYSVTQAGSAVV

SEQ ID NO: 99224 - protein, 131 aa, Homo sapiens
  Payload ID: 19793
  Gene Name: zinc finger protein 195
  ENSP ID: ENSP00000434715
MAGAQTLLTFRDVAIEFSLEEWKCLDLAQQNLYRDVMLENYRNLFSVGLTVCKPGLITCLEQRKEPWNVKRQEAADGHPAMSSHFTQDLLPEQGIQDAFPKRILRGYGNCGLDNLYLRKDWESLDECKLQK

SEQ ID NO: 99225 - protein, 80 aa, Homo sapiens; identical to SEQ ID NO: 99219
  Payload ID: 19793
  Gene Name: zinc finger protein 195
  ENSP ID: ENSP00000435093

SEQ ID NO: 99226 - protein, 91 aa, Homo sapiens
  Payload ID: 19793
  Gene Name: zinc finger protein 195
  ENSP ID: ENSP00000435153
MAGAQTLLTFRDVAIEFSLEEWKCLDLAQQNLYRDVMLENYRNLFSVGLTVCKPGLITCLEQRKEPWNVKRQEAADGHPGPSVEETILSVL

SEQ ID NO: 99227 - protein, 79 aa, Homo sapiens
  Payload ID: 19793
  Gene Name: zinc finger protein 195
  ENSP ID: ENSP00000435741
MTLLTFRDVAIEFSLEEWKCLDLAQQNLYRDVMLENYRNLFSVGLTVCKPGLITCLEQRKEPWNVKRQEAADGHPGGWE

SEQ ID NO: 99228 - protein, 610 aa, Homo sapiens
  Payload ID: 19793
  Gene Name: zinc finger protein 195
  Uniprot ID: O14628
  ENSP ID: ENSP00000435828
MAGAQTLLTFRDVAIEFSLEEWKCLDLAQQNLYRDVMLENYRNLFSVGLTVCKPGLITCLEQRKEPWNVKRQEAADGHPEMGFHHATQACLELLGSSDLPASASQSAGITGVNHRAQPGLNVSVDKFTAMSSHFTQDLLPEQGIQDAFPKRILRGYGNCGLDNLYLRKDWESLDECKLQKDYNGLNQCSSTTHSKIFQYNKYVKIFDNFSNLHRRNISNTGEKPFKCQECGKSFQMLSFLTEHQKIHTGKKFQKCGECGKTFIQCSHFTEPENIDTGEKPYKCQECNNVIKTCSVLTKNRIYAGGEHYRCEEFGKVFNQCSHLTEHEHGTEEKPCKYEECSSVFISCSSLSNQQMILAGEKLSKCETWYKGFNHSPNPSKHQRNEIGGKPFKCEECDSIFKWFSDLTKHKRIHTGEKPYKCDECGKAYTQSSHLSEHRRIHTGEKPYQCEECGKVFRTCSSLSNHKRTHSEEKPYTCEECGNIFKQLSDLTKHKKTHTGEKPYKCDECGKNFTQSSNLIVHKRIHTGEKPYKCEECGRVFMWFSDITKHKKTHTGEKPYKCDECGKNFTQSSNLIVHKRIHTGEKPYKCEKCGKAFTQFSHLTVHESIHT

SEQ ID NO: 99229 - protein, 90 aa, Homo sapiens; identical to SEQ ID NO: 99217
  Payload ID: 19793
  Gene Name: zinc finger protein 195
  Uniprot ID: O14628
  ENSP ID: ENSP00000436384

SEQ ID NO: 99230 - protein, 115 aa, Homo sapiens
  Payload ID: 19793
  Gene Name: zinc finger protein 195
  ENSP ID: ENSP00000437265
MAGAQTLLTFRDVAIEFSLEEWKCLDLAQQNLYRDVMLENYRNLFSVGLTVCKPGLITCLEQRKEPWNVKRQEAADGHPEMGFHHATQACLELLGSSDLPASASQSAGITGVNHR

SEQ ID NO: 99231 - protein, 633 aa, Homo sapiens
  Payload ID: 19793
  Gene Name: zinc finger protein 195
  ENSP ID: ENSP00000477630
MAGAQTLLTFRDVAIEFSLEEWKCLDLAQQNLYRDVMLENYRNLFSVGLTVCKPGLITCLEQRKEPWNVKRQEAADGHPEMGFHHATQACLELLGSSDLPASASQSAGITGVNHRAQPGLNVSVDKFTALCSPGVLQTVKWFLEFRCIFSLAMSSHFTQDLLPEQGIQDAFPKRILRGYGNCGLDNLYLRKDWESLDECKLQKDYNGLNQCSSTTHSKIFQYNKYVKIFDNFSNLHRRNISNTGEKPFKCQECGKSFQMLSFLTEHQKIHTGKKFQKCGECGKTFIQCSHFTEPENIDTGEKPYKCQECNNVIKTCSVLTKNRIYAGGEHYRCEEFGKVFNQCSHLTEHEHGTEEKPCKYEECSSVFISCSSLSNQQMILAGEKLSKCETWYKGFNHSPNPSKHQRNEIGGKPFKCEECDSIFKWFSDLTKHKRIHTGEKPYKCDECGKAYTQSSHLSEHRRIHTGEKPYQCEECGKVFRTCSSLSNHKRTHSEEKPYTCEECGNIFKQLSDLTKHKKTHTGEKPYKCDECGKNFTQSSNLIVHKRIHTGEKPYKCEECGRVFMWFSDITKHKKTHTGEKPYKCDECGKNFTQSSNLIVHKRIHTGEKPYKCEKCGKAFTQFSHLTVHESIHT

SEQ ID NO: 99232 - protein, 90 aa, Homo sapiens; identical to SEQ ID NO: 99217
  Payload ID: 19793
  Gene Name: zinc finger protein 195
  Uniprot ID: O14628
  ENSP ID: ENSP00000482411

SEQ ID NO: 99233 - protein, 173 aa, Homo sapiens
  Payload ID: 19794
  Gene Name: zinc finger protein 197
  ENSP ID: ENSP00000334616
MTRENVAHNALRQEGLVKGKDDTWKWGTSFQGSSSSVWETSHLHFRQLRYHETSGPQEALSRLRELCRRWLRPEARTKAQILELLVLEQFLSILPGEIRTWVQLHHPGSGEEAVALVEELQKDLDGPAIQVWLLFPPLCTVSSGRGHQCHEWGSRAAPLFSMQSFTAVLMLHT

SEQ ID NO: 99234 - protein, 1029 aa, Homo sapiens
  Payload ID: 19794
  Gene Name: zinc finger protein 197
  Uniprot ID: O14709
  ENSP ID: ENSP00000345809
MTRENVAHNALRQEGLVKGKDDTWKWGTSFQGSSSSVWETSHLHFRQLRYHETSGPQEALSRLRELCRRWLRPEARTKAQILELLVLEQFLSILPGEIRTWVQLHHPGSGEEAVALVEELQKDLDGPAIQVPVLVKDQDTLQKVVSAPGTTLPPVLPGSHIAAEICPHPPTDLVAFNLQDPQHDSPAPEASALSQEENPRNQLMALMLLTAQPQELVMFEEVSVCFTSEEWACLGPIQRALYWDVMLENYGNVTSLEWETMTENEEVTSKPSSSQRADSHKGTSKRLQGSVPQVLDFEEECEWQVLASQWGNETDERADTVKKVSLCERDKKKRTPPEKQGQKWKELGDSLTFGSAISESLIGTEGKKFYKCDMCCKHFNKISHLINHRRIHTGEKPHKCKECGKGFIQRSSLLMHLRNHSGEKPYKCNECGKAFSQSAYLLNHQRIHTGEKPYKCKECGKGFYRHSGLIIHLRRHSGERPYKCNECGKVFSQNAYLIDHQRLHKGEEPYKCNKCQKAFILKKSLILHQRIHSGEKPYKCDECGKTFAQTTYLIDHQRLHSAENPYKCKECGKVFIRSKSLLLHQRVHTEKKTFGCKKCGKIFSSKSNFIDHKRMHSREKPYKCTECGKAFTQSAYLFDHQRLHNGEKPYECNECGKVFILKKSLILHQRFHTGENLYECKDCGKVFGSNRNLIDHERLHNGEKPYECRECGKTFIMSKSFMVHQKLHTQEKAYKCEDCGKAFSYNSSLLVHRRIHTGEKPFECSECGRAFSSNRNLIEHKRIHSGEKPYECDECGKCFILKKSLIGHQRIHTREKSYKCNDCGKVFSYRSNLIAHQRIHTGEKPYACSECGKGFTYNRNLIEHQRIHSGEKTYECHVCRKVLTSSRNLMVHQRIHTGEKPYKCNECGKDFSQNKNLVVHQRMHTGEKPYECDKCRKSFTSKRNLVGHQRIHTGEKPYGCNDCSKVFRQRKNLTVHQKIHTDEKPCECDVSEKEFSQTSNLHLQQKIHTIEEFSWLQNTNESKIEIQKI

SEQ ID NO: 99235 - protein, 267 aa, Homo sapiens
  Payload ID: 19794
  Gene Name: zinc finger protein 197
  Uniprot ID: O14709
  ENSP ID: ENSP00000373250
MTRENVAHNALRQEGLVKGKDDTWKWGTSFQGSSSSVWETSHLHFRQLRYHETSGPQEALSRLRELCRRWLRPEARTKAQILELLVLEQFLSILPGEIRTWVQLHHPGSGEEAVALVEELQKDLDGPAIQVPVLVKDQDTLQKVVSAPGTTLPPVLPGSHIAAEICPHPPTDLVAFNLQDPQHDSPAPEASALSQEENPRNQLMALMLLTAQPQELVMFEEVSVCFTSEEWACLGPIQRALYWDVMLENYGNVTSLGYRKYRRQRNK

SEQ ID NO: 99236 - protein, 267 aa, Homo sapiens; identical to SEQ ID NO: 99235
  Payload ID: 19794
  Gene Name: zinc finger protein 197
  Uniprot ID: O14709
  ENSP ID: ENSP00000373251

SEQ ID NO: 99237 - protein, 1029 aa, Homo sapiens; identical to SEQ ID NO: 99234
  Payload ID: 19794
  Gene Name: zinc finger protein 197
  Uniprot ID: O14709
  ENSP ID: ENSP00000379370

SEQ ID NO: 99238 - protein, 78 aa, Homo sapiens
  Payload ID: 19794
  Gene Name: zinc finger protein 197
  ENSP ID: ENSP00000394713
MTRENVAHNALRQEGLVKGKDDTWKWGTSFQGSSSSVWETSHLHFRQLRYHETSGPQEALSRLRELCRRWLRPEARTK

SEQ ID NO: 99239 - protein, 1029 aa, Homo sapiens; identical to SEQ ID NO: 99234
  Payload ID: 19794
  Gene Name: zinc finger protein 197
  Uniprot ID: O14709
  ENSP ID: ENSP00000485709

SEQ ID NO: 99240 - protein, 173 aa, Homo sapiens; identical to SEQ ID NO: 99233
  Payload ID: 19794
  Gene Name: zinc finger protein 197
  ENSP ID: ENSP00000486661

SEQ ID NO: 99241 - protein, 1029 aa, Homo sapiens; identical to SEQ ID NO: 99234
  Payload ID: 19794
  Gene Name: zinc finger protein 197
  Uniprot ID: O14709
  ENSP ID: ENSP00000486739

SEQ ID NO: 99242 - protein, 267 aa, Homo sapiens; identical to SEQ ID NO: 99235
  Payload ID: 19794
  Gene Name: zinc finger protein 197
  Uniprot ID: O14709
  ENSP ID: ENSP00000486777

SEQ ID NO: 99243 - protein, 78 aa, Homo sapiens; identical to SEQ ID NO: 99238
  Payload ID: 19794
  Gene Name: zinc finger protein 197
  ENSP ID: ENSP00000487051

SEQ ID NO: 99244 - protein, 267 aa, Homo sapiens; identical to SEQ ID NO: 99235
  Payload ID: 19794
  Gene Name: zinc finger protein 197
  Uniprot ID: O14709
  ENSP ID: ENSP00000487305

SEQ ID NO: 99245 - protein, 345 aa, Homo sapiens
  Payload ID: 19795
  Gene Name: zinc finger protein 2
  ENSP ID: ENSP00000477960
MLENYNSIVSLDWETKPEIHDASDKKSEGSLRECLGRQSPLCPKFEVHTPNGRMGTEKQSPSGETRKKSLSRDKGLRRRSALSREILTKERHQECSDCGKTFFDHSSLTRHQRTHTGEKPYDCRECGKAFSHRSSLSRHLMSHTGESPYECSVCSKAFFDRSSLTVHQRIHTGEKPFQCNECGKAFFDRSSLTRHQRIHTGESPYECHQCGKAFSQKSILTRHQLIHTGRKPYECNECGKAFYGVSSLNRHQKAHAGDPRYQCNECGKAFFDRSSLTQHQKIHTGDKPYECSECGKAFSQRCRLTRHQRVHTGEKPFECTVCGKVFSSKSSVIQHQRRYAKQGID

SEQ ID NO: 99246 - protein, 383 aa, Homo sapiens
  Payload ID: 19795
  Gene Name: zinc finger protein 2
  ENSP ID: ENSP00000480057
MLENYNSIVSLGLPVPQPDVIFQLKRGDKPWMVDLHGSEEREWPESVSLDWETKPEIHDASDKKSEGSLRECLGRQSPLCPKFEVHTPNGRMGTEKQSPSGETRKKSLSRDKGLRRRSALSREILTKERHQECSDCGKTFFDHSSLTRHQRTHTGEKPYDCRECGKAFSHRSSLSRHLMSHTGESPYECSVCSKAFFDRSSLTVHQRIHTGEKPFQCNECGKAFFDRSSLTRHQRIHTGESPYECHQCGKAFSQKSILTRHQLIHTGRKPYECNECGKAFYGVSSLNRHQKAHAGDPRYQCNECGKAFFDRSSLTQHQKIHTGDKPYECSECGKAFSQRCRLTRHQRVHTGEKPFECTVCGKVFSSKSSVIQHQRRYAKQGID

SEQ ID NO: 99247 - protein, 425 aa, Homo sapiens
  Payload ID: 19795
  Gene Name: zinc finger protein 2
  Uniprot ID: Q9BSG1
  ENSP ID: ENSP00000480297
MAAVSPTTRCQESVTFEDVAVVFTDEEWSRLVPIQRDLYKEVMLENYNSIVSLGLPVPQPDVIFQLKRGDKPWMVDLHGSEEREWPESVSLDWETKPEIHDASDKKSEGSLRECLGRQSPLCPKFEVHTPNGRMGTEKQSPSGETRKKSLSRDKGLRRRSALSREILTKERHQECSDCGKTFFDHSSLTRHQRTHTGEKPYDCRECGKAFSHRSSLSRHLMSHTGESPYECSVCSKAFFDRSSLTVHQRIHTGEKPFQCNECGKAFFDRSSLTRHQRIHTGESPYECHQCGKAFSQKSILTRHQLIHTGRKPYECNECGKAFYGVSSLNRHQKAHAGDPRYQCNECGKAFFDRSSLTQHQKIHTGDKPYECSECGKAFSQRCRLTRHQRVHTGEKPFECTVCGKVFSSKSSVIQHQRRYAKQGID

SEQ ID NO: 99248 - protein, 438 aa, Homo sapiens
  Payload ID: 19795
  Gene Name: zinc finger protein 2
  ENSP ID: ENSP00000482030
MAAVSPTTRCQESVTFEDVAVVFTDEEWSRLVPIQRDLYKEVMLENYNSIVSLGLPVPQPDVIFQLKRGDKPWMVDLHGSEEREWPESVSLAQEKNCICFLFVPDWETKPEIHDASDKKSEGSLRECLGRQSPLCPKFEVHTPNGRMGTEKQSPSGETRKKSLSRDKGLRRRSALSREILTKERHQECSDCGKTFFDHSSLTRHQRTHTGEKPYDCRECGKAFSHRSSLSRHLMSHTGESPYECSVCSKAFFDRSSLTVHQRIHTGEKPFQCNECGKAFFDRSSLTRHQRIHTGESPYECHQCGKAFSQKSILTRHQLIHTGRKPYECNECGKAFYGVSSLNRHQKAHAGDPRYQCNECGKAFFDRSSLTQHQKIHTGDKPYECSECGKAFSQRCRLTRHQRVHTGEKPFECTVCGKVFSSKSSVIQHQRRYAKQGID

SEQ ID NO: 99249 - protein, 387 aa, Homo sapiens
  Payload ID: 19795
  Gene Name: zinc finger protein 2
  ENSP ID: ENSP00000483131
MAAVSPTTRCQESVTFEDVAVVFTDEEWSRLVPIQRDLYKEVMLENYNSIVSLDWETKPEIHDASDKKSEGSLRECLGRQSPLCPKFEVHTPNGRMGTEKQSPSGETRKKSLSRDKGLRRRSALSREILTKERHQECSDCGKTFFDHSSLTRHQRTHTGEKPYDCRECGKAFSHRSSLSRHLMSHTGESPYECSVCSKAFFDRSSLTVHQRIHTGEKPFQCNECGKAFFDRSSLTRHQRIHTGESPYECHQCGKAFSQKSILTRHQLIHTGRKPYECNECGKAFYGVSSLNRHQKAHAGDPRYQCNECGKAFFDRSSLTQHQKIHTGDKPYECSECGKAFSQRCRLTRHQRVHTGEKPFECTVCGKVFSSKSSVIQHQRRYAKQGID

SEQ ID NO: 99250 - protein, 532 aa, Homo sapiens
  Payload ID: 19796
  Gene Name: zinc finger protein 20
  Uniprot ID: P17024
  ENSP ID: ENSP00000335437
MMFQDSVAFEDVAVSFTQEEWALLDPSQKNLYRDVMQETFKNLTSVGKTWKVQNIEDEYKNPRRNLSLMREKLCESKESHHCGESFNQIADDMLNRKTLPGITPCESSVCGEVGTGHSSLNTHIRADTGHKSSEYQEYGENPYRNKECKKAFSYLDSFQSHDKACTKEKPYDGKECTETFISHSCIQRHRVMHSGDGPYKCKFCGKAFYFLNLCLIHERIHTGVKPYKCKQCGKAFTRSTTLPVHERTHTGVNADECKECGNAFSFPSEIRRHKRSHTGEKPYECKQCGKVFISFSSIQYHKMTHTGEKPYECKQCGKAFRCGSHLQKHGRTHTGEKPYECRQCGKAFRCTSDLQRHEKTHTEDKPYGCKQCGKGFRCASQLQIHERTHSGEKPHECKECGKVFKYFSSLRIHERTHTGEKPHECKQCGKAFRYFSSLHIHERTHTGDKPYECKVCGKAFTCSSSIRYHERTHTGEKPYECKHCGKAFISNYIRYHERTHTGEKPYQCKQCGKAFIRASSCREHERTHTINR

SEQ ID NO: 99251 - protein, 169 aa, Homo sapiens
  Payload ID: 19796
  Gene Name: zinc finger protein 20
  ENSP ID: ENSP00000390115
MDSVAFEDVAVSFTQEEWALLDPSQKNLYRDVMQETFKNLTSVGKTWKVQNIEDEYKNPRRNLSLMREKLCESKESHHCGESFNQIADDMLNRKTLPGITPCESSVCGEVGTGHSSLNTHIRADTGHKSSEYQEYGENPYRNKECKKAFSYLDSFQSHDKACTKEKPYD

SEQ ID NO: 99252 - protein, 40 aa, Homo sapiens
  Payload ID: 19796
  Gene Name: zinc finger protein 20
  ENSP ID: ENSP00000402483
MVTICPCSFWIQWPLRMWLSASPRRSGLCWILPRRISTGM

SEQ ID NO: 99253 - protein, 131 aa, Homo sapiens
  Payload ID: 19796
  Gene Name: zinc finger protein 20
  ENSP ID: ENSP00000470025
MDSVAFEDVAVSFTQEEWALLDPSQKNLYRDVMQETFKNLTSVGKTWKVQNIEDEYKNPRRNLRRSFTLVAQAGVQRRDLGSPQPPPPGFKRFSCLSLPSSWDYKHAPPRQANFVFLVETGFLHVRLVSNS

SEQ ID NO: 99254 - protein, 394 aa, Homo sapiens
  Payload ID: 19797
  Gene Name: zinc finger protein 200
  Uniprot ID: P98182
  ENSP ID: ENSP00000380077
MMAAKVVPMPPKPKQSFILRVPPDSKLGQDLLRDATNGPKTIHQLVLEHFLTFLPKPSLVQPSQKVKETLVIMKDVSSSLQNRVHPRPLVKLLPKGVQKEQETVSLYLKANPELVVFEDLNVFHCQEECVSLDPTQQLTSEKEDDSSVGEMMLLAVNGSNPEGEDPEREPVENEDYREKSSDDDEMDSSLVSQQPPDNQEKERLNTSIPQKRKMRNLLVTIENDTPLEELSKYVDISIIALTRNRRTRRWYTCPLCGKQFNESSYLISHQRTHTGEKPYDCNHCGKSFNHKTNLNKHERIHTGEKPYSCSQCGKNFRQNSHRSRHEGIHIREKIFKCPECGKTFPKNEEFVLHLQSHEAERPYGCKKCGRRFGRLSNCTRHEKTHSACKTRKQK

SEQ ID NO: 99255 - protein, 394 aa, Homo sapiens
  Payload ID: 19797
  Gene Name: zinc finger protein 200
  Uniprot ID: P98182
  ENSP ID: ENSP00000380079
MMAAKVVPMPPKPKQSFILRVPPDSKLGQDLLRDATNGPKTIHQLVLEHFLTFLPKPSLVQPSQKVKETLVIMKDVSSSLQNRVHPRPLVKLLPKGVQKEQETVSLYLKANPEELVVFEDLNVFHCQEECVSLDPTQQLTSEKEDDSSVGEMMLLVNGSNPEGEDPEREPVENEDYREKSSDDDEMDSSLVSQQPPDNQEKERLNTSIPQKRKMRNLLVTIENDTPLEELSKYVDISIIALTRNRRTRRWYTCPLCGKQFNESSYLISHQRTHTGEKPYDCNHCGKSFNHKTNLNKHERIHTGEKPYSCSQCGKNFRQNSHRSRHEGIHIREKIFKCPECGKTFPKNEEFVLHLQSHEAERPYGCKKCGRRFGRLSNCTRHEKTHSACKTRKQK

SEQ ID NO: 99256 - protein, 394 aa, Homo sapiens; identical to SEQ ID NO: 99255
  Payload ID: 19797
  Gene Name: zinc finger protein 200
  Uniprot ID: P98182
  ENSP ID: ENSP00000380080

SEQ ID NO: 99257 - protein, 395 aa, Homo sapiens
  Payload ID: 19797
  Gene Name: zinc finger protein 200
  Uniprot ID: P98182
  ENSP ID: ENSP00000395723
MMAAKVVPMPPKPKQSFILRVPPDSKLGQDLLRDATNGPKTIHQLVLEHFLTFLPKPSLVQPSQKVKETLVIMKDVSSSLQNRVHPRPLVKLLPKGVQKEQETVSLYLKANPEELVVFEDLNVFHCQEECVSLDPTQQLTSEKEDDSSVGEMMLLAVNGSNPEGEDPEREPVENEDYREKSSDDDEMDSSLVSQQPPDNQEKERLNTSIPQKRKMRNLLVTIENDTPLEELSKYVDISIIALTRNRRTRRWYTCPLCGKQFNESSYLISHQRTHTGEKPYDCNHCGKSFNHKTNLNKHERIHTGEKPYSCSQCGKNFRQNSHRSRHEGIHIREKIFKCPECGKTFPKNEEFVLHLQSHEAERPYGCKKCGRRFGRLSNCTRHEKTHSACKTRKQK

SEQ ID NO: 99258 - protein, 395 aa, Homo sapiens; identical to SEQ ID NO: 99257
  Payload ID: 19797
  Gene Name: zinc finger protein 200
  Uniprot ID: P98182
  ENSP ID: ENSP00000405786

SEQ ID NO: 99259 - protein, 394 aa, Homo sapiens; identical to SEQ ID NO: 99255
  Payload ID: 19797
  Gene Name: zinc finger protein 200
  Uniprot ID: P98182
  ENSP ID: ENSP00000458508

SEQ ID NO: 99260 - protein, 43 aa, Homo sapiens
  Payload ID: 19797
  Gene Name: zinc finger protein 200
  ENSP ID: ENSP00000458777
MMAAKVVPMPPKPKQSFILRVPPDSKLGQDLLRDATNGPKTIH

SEQ ID NO: 99261 - protein, 648 aa, Homo sapiens
  Payload ID: 19798
  Gene Name: zinc finger protein 202
  Uniprot ID: O95125
  ENSP ID: ENSP00000337724
MATAVEPEDQDLWEEEGILMVKLEDDFTCRPESVLQRDDPVLETSHQNFRRFRYQEAASPREALIRLRELCHQWLRPERRTKEQILELLVLEQFLTVLPGELQSWVRGQRPESGEEAVTLVEGLQKQPRRPRRWVTVHVHGQEVLSEETVHLGVEPESPNELQDPVQSSTPEQSPEETTQSPDLGAPAEQRPHQEEELQTLQESEVPVPEDPDLPAERSSGDSEMVALLTALSQGLVTFKDVAVCFSQDQWSDLDPTQKEFYGEYVLEEDCGIVVSLSFPIPRPDEISQVREEEPWVPDIQEPQETQEPEILSFTYTGDRSKDEEECLEQEDLSLEDIHRPVLGEPEIHQTPDWEIVFEDNPGRLNERRFGTNISQVNSFVNLRETTPVHPLLGRHHDCSVCGKSFTCNSHLVRHLRTHTGEKPYKCMECGKSYTRSSHLARHQKVHKMNAPYKYPLNRKNLEETSPVTQAERTPSVEKPYRCDDCGKHFRWTSDLVRHQRTHTGEKPFFCTICGKSFSQKSVLTTHQRIHLGGKPYLCGECGEDFSEHRRYLAHRKTHAAEELYLCSECGRCFTHSAAFAKHLRGHASVRPCRCNECGKSFSRRDHLVRHQRTHTGEKPFTCPTCGKSFSRGYHLIRHQRTHSEKTS

SEQ ID NO: 99262 - protein, 126 aa, Homo sapiens
  Payload ID: 19798
  Gene Name: zinc finger protein 202
  ENSP ID: ENSP00000431223
MATAVEPEDQDLWEEEGILMVKLEDDFTCRPESVLQRDDPVLETSHQNFRRFRYQEAASPREALIRLRELCHQWLRPERRTKEQILELLVLEQFLTVLPGELQSWVRGQRPESGEEAVTLVEGLQK

SEQ ID NO: 99263 - protein, 45 aa, Homo sapiens
  Payload ID: 19798
  Gene Name: zinc finger protein 202
  ENSP ID: ENSP00000431761
MATAVEPEDQDLWEEEGILMVKLEDDFTCRPESVLQRDDPVLETS

SEQ ID NO: 99264 - protein, 648 aa, Homo sapiens; identical to SEQ ID NO: 99261
  Payload ID: 19798
  Gene Name: zinc finger protein 202
  Uniprot ID: O95125
  ENSP ID: ENSP00000432504

SEQ ID NO: 99265 - protein, 648 aa, Homo sapiens; identical to SEQ ID NO: 99261
  Payload ID: 19798
  Gene Name: zinc finger protein 202
  Uniprot ID: O95125
  ENSP ID: ENSP00000433881

SEQ ID NO: 99266 - protein, 10 aa, Homo sapiens
  Payload ID: 19798
  Gene Name: zinc finger protein 202
  ENSP ID: ENSP00000434338
MATAVEPEDQ

SEQ ID NO: 99267 - protein, 554 aa, Homo sapiens
  Payload ID: 19799
  Gene Name: zinc finger protein 205
  Uniprot ID: O95201
  ENSP ID: ENSP00000219091
MSADGGGIQDTQDKETPPEVPDRGHPHQEMPSKLGEAVPSGDTQESLHIKMEPEEPHSEGASQEDGAQGAWGWAPLSHGSKEKALFLPGGALPSPRIPVLSREGRTRDRQMAAALLTAWSQMPVTFEDVALYLSREEWGRLDHTQQNFYRDVLQKKNGLSLGFPFSRPFWAPQAHGKGEASGSSRQAGDEKEWRGACTGAVEVGQRVQTSSVAALGNVKPFRTRAGRVQWGVPQCAQEAACGRSSGPAKDSGQPAEPDRTPDAAPPDPSPTEPQEYRVPEKPNEEEKGAPESGEEGLAPDSEVGRKSYRCEQCGKGFSWHSHLVTHRRTHTGEKPYACTDCGKRFGRSSHLIQHQIIHTGEKPYTCPACRKSFSHHSTLIQHQRIHTGEKPYVCDRCAKRFTRRSDLVTHQGTHTGAKPHKCPICAKCFTQSSALVTHQRTHTGVKPYPCPECGKCFSQRSNLIAHNRTHTGEKPYHCLDCGKSFSHSSHLTAHQRTHRGVRPYACPLCGKSFSRRSNLHRHEKIHTTGPKALAMLMLGAAAAGALATPPPAPT

SEQ ID NO: 99268 - protein, 554 aa, Homo sapiens; identical to SEQ ID NO: 99267
  Payload ID: 19799
  Gene Name: zinc finger protein 205
  Uniprot ID: O95201
  ENSP ID: ENSP00000371627

SEQ ID NO: 99269 - protein, 118 aa, Homo sapiens
  Payload ID: 19799
  Gene Name: zinc finger protein 205
  ENSP ID: ENSP00000394360
MSADGGGIQDTQDKETPPEVPDRGHPHQEMPSKLGEAVPSGDTQESLHIKMEPEEPHSEGASQEDGAQGAWGWAPLSHGSKEKALFLPGGALPSPRIPVLSREGRTRDRQMAAALLTA

SEQ ID NO: 99270 - protein, 278 aa, Homo sapiens
  Payload ID: 19799
  Gene Name: zinc finger protein 205
  ENSP ID: ENSP00000403306
MSADGGGIQDTQDKETPPEVPDRGHPHQEMPSKLGEAVPSGDTQESLHIKMEPEEPHSEGASQEDGAQGAWGWAPLSHGSKEKALFLPGGALPSPRIPVLSREGRTRDRQMAAALLTAWSQMPVTFEDVALYLSREEWGRLDHTQQNFYRDVLQKKNGLSLGFPFSRPFWAPQAHGKGEASGSSRQAGDEKEWRGACTGAVEVGQRVQTSSVAALGNVKPFRTRAGRVQWGVPQCAQEAACGRSSGPAKDSGQPAEPDRTPDAAPPDPSPTEPQEYRV

SEQ ID NO: 99271 - protein, 255 aa, Homo sapiens
  Payload ID: 19799
  Gene Name: zinc finger protein 205
  ENSP ID: ENSP00000460890
  MOD_RES (1)..(1): Any amino acid
XLSHGSKEKALFLPGGALPSPRIPVLSREGRTRDRQMAAALLTAWSQMPVTFEDVALYLSREEWGRLDHTQQNFYRDVLQKKNGLSLGAVEVGQRVQTSSVAALGNVKPFRTRAGRVQWGVPQCAQEAACGRSSGPAKDSGQPAEPDRTPDAAPPDPSPTEPQEYRVPEKPNEEEKGAPESGEEGLAPDSEVGRKSYRCEQCGKGFSWHSHLVTHRRTHTGEKPYACTDCGKRFGRSSHLIQHQIIHTGEKPYTC

SEQ ID NO: 99272 - protein, 554 aa, Homo sapiens; identical to SEQ ID NO: 99267
  Payload ID: 19799
  Gene Name: zinc finger protein 205
  Uniprot ID: O95201
  ENSP ID: ENSP00000480401

SEQ ID NO: 99273 - protein, 478 aa, Homo sapiens
  Payload ID: 19800
  Gene Name: zinc finger protein 207
  Uniprot ID: O43670
  ENSP ID: ENSP00000322777
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 99274 - protein, 497 aa, Homo sapiens
  Payload ID: 19800
  Gene Name: zinc finger protein 207
  ENSP ID: ENSP00000340029
MAMSSLGCLCALTVLIRYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 99275 - protein, 494 aa, Homo sapiens
  Payload ID: 19800
  Gene Name: zinc finger protein 207
  Uniprot ID: O43670
  ENSP ID: ENSP00000378165
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 99276 - protein, 463 aa, Homo sapiens
  Payload ID: 19800
  Gene Name: zinc finger protein 207
  Uniprot ID: O43670
  ENSP ID: ENSP00000378168
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 99277 - protein, 198 aa, Homo sapiens
  Payload ID: 19800
  Gene Name: zinc finger protein 207
  ENSP ID: ENSP00000378172
MQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRP

SEQ ID NO: 99278 - protein, 93 aa, Homo sapiens
  Payload ID: 19800
  Gene Name: zinc finger protein 207
  ENSP ID: ENSP00000461914
MQVHKETIDAVPNAIPGRTDIELEIYGMEGIPEKDMDERRRLLEQKTQESQKKKQQDDSDEYDDDDSAASTSFQPQPVQPQQGYIPPMAQPGL

SEQ ID NO: 99279 - protein, 95 aa, Homo sapiens
  Payload ID: 19800
  Gene Name: zinc finger protein 207
  ENSP ID: ENSP00000462193
MQVHKETIDAVPNAIPGRTDIELEIYGMEGIPEKDMDERRRLLEQKTQESQKKKQQDDSDEYDDDDSAASTSFQPQPVQPQQGYIPPMAQPGLPP

SEQ ID NO: 99280 - protein, 341 aa, Homo sapiens
  Payload ID: 19800
  Gene Name: zinc finger protein 207
  ENSP ID: ENSP00000462284
  MOD_RES (1)..(1): Any amino acid
XGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 99281 - protein, 74 aa, Homo sapiens
  Payload ID: 19800
  Gene Name: zinc finger protein 207
  ENSP ID: ENSP00000463040
MQVHKETIDAVPNAIPGRTDIELEIYGMEGIPEKDMDERRRLLEQKTQESQKKKQQDDSDEYDDDDSAASTSFQ

SEQ ID NO: 99282 - protein, 493 aa, Homo sapiens
  Payload ID: 19800
  Gene Name: zinc finger protein 207
  ENSP ID: ENSP00000464366
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQALP

SEQ ID NO: 99283 - protein, 46 aa, Homo sapiens
  Payload ID: 19800
  Gene Name: zinc finger protein 207
  ENSP ID: ENSP00000464495
MQVHKETIDAVPNAIPGRTDIELEIYGMEGIPEKDMDERRRLLEQK

SEQ ID NO: 99284 - protein, 1280 aa, Homo sapiens
  Payload ID: 19801
  Gene Name: zinc finger protein 208
  Uniprot ID: O43345
  ENSP ID: ENSP00000380315
MGSLTFRDVAIEFSLEEWQCLDTAQQNLYRNVMLENYRNLVFLGIAAFKPDLIIFLEEGKESWNMKRHEMVEESPVICSHFAQDLWPEQGIEDSFQKVILRRYEKCGHENLHLKIGYTNVDECKVHKEGYNKLNQSLTTTQSKVFQRGKYANVFHKCSNSNRHKIRHTGKKHLQCKEYVRSFCMLSHLSQHKRIYTRENSYKCEEGGKAFNWSSTLTYYKSAHTGEKPYRCKECGKAFSKFSILTKHKVIHTGEKSYKCEECGKAFNQSAILTKHKIIHTGEKPNKCEECGKAFSKVSTLTTHKAIHAGEKPYKCKECGKAFSKVSTLITHKAIHAGEKPYKCKECGKAFSKFSILTKHKVIHTGEKPYKCEECGKAYKWPSTLSYHKKIHTGEKPYKCEECGKGFSMFSILTKHEVIHTGEKPYKCEECGKAFNWSSNLMEHKKIHTGETPYKCEECGKGFSMFSILTKHKVIHNGEKPYKCEECDKATHAGEKPYKCEECGKAFNWSSNLMEHKRIHTGEKPYKCEECGKSFSTFSILTKHKVIHTGEKPYKCEECGKAYKWSSTLSYHKKIHTVEKPYKCEECGKAFNQSAILIKHKRIHTGEKPYKCEECGKTFSKVSTLTTHKAIHAGEKPYKCKECGKTFIKVSTLTTHKAIHAGEKPYKCKECGKAFSKFSILTKHKVIHTGEKPYKCEECGKAFNWSSNLMEHKRIHTGEKPYKCEECGKSFSTFSVLTKHKVIHTGEKPYKCEECGKAYKWSSTLSYHKKIHTVEKPYKCEECGKAFNRSAILIKHKRIHTDEKPYKCEECGKTFSKVSTLTTHKAIHAGEKPYKCKECGKAFSKFSILTKHKVIHTGEKPYKCEECGKAYKWPSTLSYHKKIHTGEKPYKCEECGKGFSMFSILTKHEVIHTGEKPYKCEECGKAFSWLSVFSKHKKTHAGEKFYKCEACGKAYKSSSTLSYHKKIHTEEKPYKYEECGKGFSTFSILTKHKVIHTGEKPYKCEECGKAFNWSSNLMEHKKIHTGETPYKCEECDKAFSWPSSLTEHKATHAGEKPYKCEECGKAFSWPSRLTEHKATHAGEEPYKCEECGKAFNWSSNLMEHKRIHTGEKPYKCEECGKSFSTFSILTKHKVIHTGEKPYKCEECGKAYKWSSTLSYHKKIHTVEKPYKCEECGKGFVMFSILAKHKVIHTGEKLYKCEECGKAYKWPSTLRYHKKIHTGEKPYKCEECGKAFSTFSILTKHKVIHTGEKPYKCEECGKAFSWLSVFSKHKKIHTGEKL

SEQ ID NO: 99285 - protein, 127 aa, Homo sapiens
  Payload ID: 19801
  Gene Name: zinc finger protein 208
  ENSP ID: ENSP00000469254
MGSLTFRDVAIEFSLEEWQCLDTAQQNLYRNVMLENYRNLVFLGIAAFKPDLIIFLEEGKESWNMKRHEMVEESPVICSHFAQDLWPEQGIEDSFQKVILRRYKIHHHACELGPIMNHHPTCGQMHI

SEQ ID NO: 99286 - protein, 112 aa, Homo sapiens
  Payload ID: 19801
  Gene Name: zinc finger protein 208
  ENSP ID: ENSP00000469887
MGSLTFRDVAIEFSLEEWQCLDTAQQNLYRNVMLENYRNLVFLGIAAFKPDLIIFLEEGKESWNMKRHEMVEESPGMVGSSGPESSAPYHVHCCPFVLSLRLVSETHQLFLS

SEQ ID NO: 99287 - protein, 38 aa, Homo sapiens
  Payload ID: 19801
  Gene Name: zinc finger protein 208
  ENSP ID: ENSP00000471831
MPGTQLILYDGSLTFRDVAIEFSLEEWQCLDTAQQNLY

SEQ ID NO: 99288 - protein, 51 aa, Homo sapiens
  Payload ID: 19801
  Gene Name: zinc finger protein 208
  ENSP ID: ENSP00000472406
MLENYRNLVFLGIAAFKPDLIIFLEEGKESWNMKRHEMVEESPGASSVLHF

SEQ ID NO: 99289 - protein, 76 aa, Homo sapiens
  Payload ID: 19801
  Gene Name: zinc finger protein 208
  ENSP ID: ENSP00000473026
  MOD_RES (1)..(1): Any amino acid
XSLTFRDVAIEFSLEEWQCLDTAQQNLYRNVMLENYRNLVFLGIAAFKPDLIIFLEEGKESWNMKRHEMVEESPGR

SEQ ID NO: 99290 - protein, 1167 aa, Homo sapiens [sequence omitted]

SEQ ID NO: 99291 - protein, 577 aa, Homo sapiens
  Payload ID: 19802
  Gene Name: zinc finger protein 211
  Uniprot ID: Q13398
  ENSP ID: ENSP00000240731
MLGFPPGRPQLPVQLRPQTRMATALRDPASVPIATEVLFKLTQGSVTFEDVAVYFSWEEWDLLDEAQKHLYFDVMLENFALTSSLGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 99292 - protein, 555 aa, Homo sapiens
  Payload ID: 19802
  Gene Name: zinc finger protein 211
  Uniprot ID: Q13398
  ENSP ID: ENSP00000254182
MLENFALTSSLGLISSWSHVVAQLGLGEVPSVLHRMFMTPASARWDQRGPGLHEWHLGKGMSSGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 99293 - protein, 629 aa, Homo sapiens
  Payload ID: 19802
  Gene Name: zinc finger protein 211
  Uniprot ID: Q13398
  ENSP ID: ENSP00000299871
MLGFPPGRPQLPVQLRPQTRMATALRDPASVPIATEVLFKLTQGSVTFEDVAVYFSWEEWDLLDEAQKHLYFDVMLENFALTSSLGLISSWSHVVAQLGLGEVPSVLHRMFMTPASARWDQRGPGLHEWHLGKGMSSGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 99294 - protein, 564 aa, Homo sapiens
  Payload ID: 19802
  Gene Name: zinc finger protein 211
  Uniprot ID: Q13398
  ENSP ID: ENSP00000339562
MLGFPPGRPQLPVQLRPQTRMATALRDPASGSVTFEDVAVYFSWEEWDLLDEAQKHLYFDVMLENFALTSSLGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 99295 - protein, 503 aa, Homo sapiens
  Payload ID: 19802
  Gene Name: zinc finger protein 211
  Uniprot ID: Q13398
  ENSP ID: ENSP00000375584
MLENFALTSSLGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 99296 - protein, 568 aa, Homo sapiens
  Payload ID: 19802
  Gene Name: zinc finger protein 211
  ENSP ID: ENSP00000384436
  MOD_RES (1)..(1): Any amino acid
XISAYCNLHLLGSSDSPASASQVAGTTGMRHHAQGSVTFEDVAVYFSWEEWDLLDEAQKHLYFDVMLENFALTSSLGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 99297 - protein, 38 aa, Homo sapiens
  Payload ID: 19802
  Gene Name: zinc finger protein 211
  ENSP ID: ENSP00000440793
MLGFPPGRPQLPVQLRPQTRMATALRDPASAVQWKKRL

SEQ ID NO: 99298 - protein, 616 aa, Homo sapiens
  Payload ID: 19802
  Gene Name: zinc finger protein 211
  ENSP ID: ENSP00000442601
MLGFPPGRPQLPVQLRPQTRMATALRDPASGSVTFEDVAVYFSWEEWDLLDEAQKHLYFDVMLENFALTSSLGLISSWSHVVAQLGLGEVPSVLHRMFMTPASARWDQRGPGLHEWHLGKGMSSGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 99299 - protein, 45 aa, Homo sapiens
  Payload ID: 19802
  Gene Name: zinc finger protein 211
  ENSP ID: ENSP00000442740
MLGFPPGRPQLPVQLRPQTRMATALRDPASGRGSHRELAQTRDTI

SEQ ID NO: 99300 - protein, 495 aa, Homo sapiens
  Payload ID: 19803
  Gene Name: zinc finger protein 212
  Uniprot ID: Q9UDV6
  ENSP ID: ENSP00000338572
MAESAPARHRRKRRSTPLTSSTLPSQATEKSSYFQTTEISLWTVVAAIQAVEKKMESQAARLQSLEGRTGTAEKKLADCEKMAVEFGNQLEGKWAVLGTLLQEYGLLQRRLENVENLLRNRNFWILRLPPGSKGEAPKVSRSLENDGVCFTEQEWENLEDWQKELYRNVMESNYETLVSLKVLGQTEGEAELGTEMLGDLEEEGPGGAHPAGGVMIKQELQYTQEGPADLPGEFSCIAEEQAFLSPEQTELWGGQGSSVLLETGPGDSTLEEPVGSRVPSSSRTVGCPKQKSHRQVQLDQECGQGLKLKKDTSRPYECSECEITFRYKQQLATHLRSHSGWGSCTPEEPEESLRPRPRLKPQTKKAKLHQCDVCLRSFSCKVSLVTHQRCHLQEGPSAGQHVQERFSPNSLVALPGHIPWRKSRSSLICGYCGKSFSHPSDLVRHQRIHTGERPYSCTECEKSFVQKQHLLQHQKIHQRERGGLALEPGRPNGLL

SEQ ID NO: 99301 - protein, 50 aa, Homo sapiens
  Payload ID: 19803
  Gene Name: zinc finger protein 212
  ENSP ID: ENSP00000418167
MAESAPARVKRHRRAGSRARWGWRSPLPGAGLRGLDAAGVLVSRGCRWRG

SEQ ID NO: 99302 - protein, 50 aa, Homo sapiens; identical to SEQ ID NO: 99301
  Payload ID: 19803
  Gene Name: zinc finger protein 212
  ENSP ID: ENSP00000418281

SEQ ID NO: 99303 - protein, 69 aa, Homo sapiens
  Payload ID: 19803
  Gene Name: zinc finger protein 212
  ENSP ID: ENSP00000419261
  MOD_RES (1)..(1): Any amino acid
XCFTEQEWENLEDWQKELYRNVMESNYETLVSLKSCSIAQAGVQWHNLGSLQPLPHRFKRFSCLSLSSS

SEQ ID NO: 99304 - protein, 194 aa, Homo sapiens
  Payload ID: 19803
  Gene Name: zinc finger protein 212
  ENSP ID: ENSP00000419419
  MOD_RES (1)..(1): Any amino acid
XYGLLQRRLENVENLLRNRNFWILRLPPGSKGEAPKVSRSLENDGVCFTEQEWENLEDWQKELYRNVMESNYETLVSLSSSDSPASASRVAEITEVLGQTEGEAELGTEMLGDLEEEGPGGAHPAGGVMIKQELQYTQEGPADLPGEFSCIAEEQAFLSPEQTELWGGQGSSVLLETGPGDSTLEEPVGSRVPS

SEQ ID NO: 99305 - protein, 459 aa, Homo sapiens
  Payload ID: 19804
  Gene Name: zinc finger protein 213
  Uniprot ID: O14771
  ENSP ID: ENSP00000380087
MAAPLEAQDQAPGEGEGLLIVKVEDSSWEQESAQHEDGRDSEACRQRFRQFCYGDVHGPHEAFSQLWELCCRWLRPELRTKEQILELLVLEQFLTVLPGEIQGWVREQHPGSGEEAVALVEDLQKQPVKAWRQDVPSEEAEPEAAGRGSQATGPPPTVGARRRPSVPQEQHSHSAQPPALLKEGRPGETTDTCFVSGVHGPVALGDIPFYFSREEWGTLDPAQRDLFWDIKRENSRNTTLGFGLKGQSEKSLLQEMVPVVPGQTGSDVTVSWSPEEAEAWESENRPRAALGPVVGARRGRPPTRRRQFRDLAAEKPHSCGQCGKRFRWGSDLARHQRTHTGEKPHKCPECDKSFRSSSDLVRHQGVHTGEKPFSCSECGKSFSRSAYLADHQRIHTGEKPFGCSDCGKSFSLRSYLLDHRRVHTGERPFGCGECDKSFKQRAHLIAHQSLHAKMAQPVG

SEQ ID NO: 99306 - protein, 459 aa, Homo sapiens; identical to SEQ ID NO: 99305
  Payload ID: 19804
  Gene Name: zinc finger protein 213
  Uniprot ID: O14771
  ENSP ID: ENSP00000403892

SEQ ID NO: 99307 - protein, 459 aa, Homo sapiens; identical to SEQ ID NO: 99305
  Payload ID: 19804
  Gene Name: zinc finger protein 213
  Uniprot ID: O14771
  ENSP ID: ENSP00000459177

SEQ ID NO: 99308 - protein, 182 aa, Homo sapiens
  Payload ID: 19804
  Gene Name: zinc finger protein 213
  ENSP ID: ENSP00000459233
EACRQRFRQFCYGDVHGPHEAFSQLWELCCRWLRPELRTKEQILELLVLEQFLTVLPGEIQGWVREQHPGSGEEAVALVEDLQKQPVKAWRQDVPSEEAEPEAAGRGSQATGPPPTVGARRRPSVPQEQHSHSGTCGIGRHPILFLPGRMGHPGPCSAGSLLGHKAGELPEHHPGFWAQRPK

SEQ ID NO: 99309 - protein, 270 aa, Homo sapiens
  Payload ID: 19804
  Gene Name: zinc finger protein 213
  ENSP ID: ENSP00000459293
QKQPVKAWRQDVPSEEAEPEAAGRGSQATGPPPTVGARRRPSVPQEQHSHSGFGLKGQSEKSLLQEMVPVVPGQTGSDVTVSWSPEEAEAWESENRPRAALGPVVGARRGRPPTRRRQFRDLAAEKPHSCGQCGKRFRWGSDLARHQRTHTGEKPHKCPECDKSFRSSSDLVRHQGVHTGEKPFSCSECGKSFSRSAYLADHQRIHTGEKPFGCSDCGKSFSLRSYLLDHRRVHTGERPFGCGECDKSFKQRAHLIAHQSLHAKMAQPVG

SEQ ID NO: 99310 - protein, 51 aa, Homo sapiens
  Payload ID: 19804
  Gene Name: zinc finger protein 213
  ENSP ID: ENSP00000459967
MAAPLEAQDQAPGEGEGLLIVKVEDSSWEQESAQHEDGRDSEACRQRFRQF

SEQ ID NO: 99311 - protein, 459 aa, Homo sapiens; identical to SEQ ID NO: 99305
  Payload ID: 19804
  Gene Name: zinc finger protein 213
  Uniprot ID: O14771
  ENSP ID: ENSP00000460157

SEQ ID NO: 99312 - protein, 145 aa, Homo sapiens
  Payload ID: 19804
  Gene Name: zinc finger protein 213
  ENSP ID: ENSP00000461024
MAAPLEAQDQAPGEGEGLLIVKVEDSSWEQESAQHEDGRDSEACRQRFRQFCYGDVHGPHEAFSQLWELCCRWLRPELRTKEQILELLVLEQFLTVLPGEIQGWVREQHPGSGEEAVALVEDLQKQPVKAWRQGVNSVSPGLVSG

SEQ ID NO: 99313 - protein, 606 aa, Homo sapiens
  Payload ID: 19805
  Gene Name: zinc finger protein 214
  Uniprot ID: Q9UL59
  ENSP ID: ENSP00000278314
MAVTFEDVTIIFTWEEWKFLDSSQKRLYREVMWENYTNVMSVENWNESYKSQEEKFRYLEYENFSYWQGWWNAGAQMYENQNYGETVQGTDSKDLTQQDRSQCQEWLILSTQVPGYGNYELTFESKSLRNLKYKNFMPWQSLETKTTQDYGREIYMSGSHGFQGGRYRLGISRKNLSMEKEQKLIVQHSYIPVEEALPQYVGVICQEDLLRDSMEEKYCGCNKCKGIYYWNSRCVFHKRNQPGENLCQCSICKACFSQRSDLYRHPRNHIGKKLYGCDEVDGNFHQSSGVHFHQRVHIGEVPYSCNACGKSFSQISSLHNHQRVHTEEKFYKIECDKDLSRNSLLHIHQRLHIGEKPFKCNQCGKSFNRSSVLHVHQRVHTGEKPYKCDECGKGFSQSSNLRIHQLVHTGEKSYKCEDCGKGFTQRSNLQIHQRVHTGEKPYKCDDCGKDFSHSSDLRIHQRVHTGEKPYTCPECGKGFSKSSKLHTHQRVHTGEKPYKCEECGKGFSQRSHLLIHQRVHTGEKPYKCHDCGKGFSHSSNLHIHQRVHTGEKPYQCAKCGKGFSHSSALRIHQRVHAGEKPYKCREYYKGFDHNSHLHNNHRRGNL

SEQ ID NO: 99314 - protein, 606 aa, Homo sapiens; identical to SEQ ID NO: 99313
  Payload ID: 19805
  Gene Name: zinc finger protein 214
  Uniprot ID: Q9UL59
  ENSP ID: ENSP00000445373

SEQ ID NO: 99315 - protein, 517 aa, Homo sapiens
  Payload ID: 19806
  Gene Name: zinc finger protein 215
  Uniprot ID: Q9UL58
  ENSP ID: ENSP00000278319
MQPLSKLMAISKPRNLSLREQREVLRADMSWQQETNPVVETHDSEASRQKFRHFQYLKVSGPHEALSQLWELCLQWLRPEIHTKKQIIELLVLEQFLAILPEEVRTWVNLQHPNNSKDMVTLIEDVIEMLEDEDMPCKDSALQMGSIKEKMKAGSRTGKPQEPVTFKDVVVEFSKEEWGQLDSAVKNLYRNVMLENFRNLNSLRKAHLLSKPFESLKLESKKKRWIMEKEIPRKTIFDMKSISGEESSHGVIMTRLTESGHPSSDAWKGENWLYRNQKKWDINLPQEAFIPETIYTEEEDFECSENKKSFDINSVSSICAIQVGIPSRKGSPKCDKFKTYFKFNLDSVGKQHSEYEYGNDLSLSTDIRHQKSHTTMNSYECYQCGKAFCRSSSLIRHQIIHTGEKPYKCSECGRFFNRRTNLTKHQKLHAEAKACTSNKCGKAFSKSEDSNNPTLHFGNNFYQCVNCGKSFNRSSSLIRHQMIHTGEKPFKCKECSKAFNRSSNLVKHQKLHTRDKS

SEQ ID NO: 99316 - protein, 517 aa, Homo sapiens; identical to SEQ ID NO: 99315
  Payload ID: 19806
  Gene Name: zinc finger protein 215
  Uniprot ID: Q9UL58
  ENSP ID: ENSP00000393202

SEQ ID NO: 99317 - protein, 304 aa, Homo sapiens
  Payload ID: 19806
  Gene Name: zinc finger protein 215
  Uniprot ID: Q9UL58
  ENSP ID: ENSP00000432306
MQPLSKLMAISKPRNLSLREQREVLRADMSWQQETNPVVETHDSEASRQKFRHFQYLKVSGPHEALSQLWELCLQWLRPEIHTKKQIIELLVLEQFLAILPEEVRTWVNLQHPNNSKDMVTLIEDVIEMLEDEDMPCKDSALQMGSIKEKMKAGSRTGKPQEPVTFKDVVVEFSKEEWGQLDSAVKNLYRNVMLENFRNLNSLRKAHLLSKPFESLKLESKKKRWIMEKEIPRKTIFDMKSISGEESSHGVIMTRLTESGHPSSDAWKDGVSLLLPRLEYNDAVSAHCNLHLWVQVILLPQPPE

SEQ ID NO: 99318 - protein, 304 aa, Homo sapiens; identical to SEQ ID NO: 99317
  Payload ID: 19806
  Gene Name: zinc finger protein 215
  Uniprot ID: Q9UL58
  ENSP ID: ENSP00000484674

SEQ ID NO: 99319 - protein, 1048 aa, Homo sapiens
  Payload ID: 19807
  Gene Name: zinc finger protein 217
  Uniprot ID: O75362
  ENSP ID: ENSP00000304308
MQSKVTGNMPTQSLLMYMDGPEVIGSSLGSPMEMEDALSMKGTAVVPFRATQEKNVIQIEGYMPLDCMFCSQTFTHSEDLNKHVLMQHRPTLCEPAVLRVEAEYLSPLDKSQVRTEPPKEKNCKENEFSCEVCGQTFRVAFDVEIHMRTHKDSFTYGCNMCGRRFKEPWFLKNHMRTHNGKSGARSKLQQGLESSPATINEVVQVHAAESISSPYKICMVCGFLFPNKESLIEHRKVHTKKTAFGTSSAQTDSPQGGMPSSREDFLQLFNLRPKSHPETGKKPVRCIPQLDPFTTFQAWQLATKGKVAICQEVKESGQEGSTDNDDSSSEKELGETNKGSCAGLSQEKEKCKHSHGEAPSVDADPKLPSSKEKPTHCSECGKAFRTYHQLVLHSRVHKKDRRAGAESPTMSVDGRQPGTCSPDLAAPLDENGAVDRGEGGSEDGSEDGLPEGIHLDKNDDGGKIKHLTSSRECSYCGKFFRSNYYLNIHLRTHTGEKPYKCEFCEYAAAQKTSLRYHLERHHKEKQTDVAAEVKNDGKNQDTEDALLTADSAQTKNLKRFFDGAKDVTGSPPAKQLKEMPSVFQNVLGSAVLSPAHKDTQDFHKNAADDSADKVNKNPTPAYLDLLKKRSAVETQANNLICRTKADVTPPPDGSTTHNLEVSPKEKQTETAADCRYRPSVDCHEKPLNLSVGALHNCPAISLSKSLIPSITCPFCTFKTFYPEVLMMHQRLEHKYNPDVHKNCRNKSLLRSRRTGCPPALLGKDVPPLSSFCKPKPKSAFPAQSKSLPSAKGKQSPPGPGKAPLTSGIDSSTLAPSNLKSHRPQQNVGVQGAATRQQQSEMFPKTSVSPAPDKTKRPETKLKPLPVAPSQPTLGSSNINGSIDYPAKNDSPWAPPGRDYFCNRSASNTAAEFGEPLPKRLKSSVVALDVDQPGANYRRGYDLPKYHMVRGITSLLPQDCVYPSQALPPKPRFLSSSEVDSPNVLTVQKPYGGSGPLYTCVPAGSPASSSTLEGKRPVSYQHLSNSMAQKRNYENFIGNAHYRPNDKKT

SEQ ID NO: 99320 - protein, 1048 aa, Homo sapiens; identical to SEQ ID NO: 99319
  Payload ID: 19807
  Gene Name: zinc finger protein 217
  Uniprot ID: O75362
  ENSP ID: ENSP00000360526

SEQ ID NO: 99321 - protein, 149 aa, Homo sapiens
  Payload ID: 19807
  Gene Name: zinc finger protein 217
  ENSP ID: ENSP00000394010
GEPLPKRLKSSVVALDVDQPGANYRRGYDLPKYHMVRGITSLLPQDCVYPSQALPPKPRFLSSSEVDSPNVLTVQKPYGGSGPLYTCVPAGSPASSSTLEGLGGCQCLLPMKLNFTSSFEKRMVKATEISCDCTVHKTYEESARNTTVV

SEQ ID NO: 99322 - protein, 95 aa, Homo sapiens
  Payload ID: 19807
  Gene Name: zinc finger protein 217
  ENSP ID: ENSP00000399672
MQSKVTGNMPTQSLLMYMDGPEVIGSSLGSPMEMEDALSMKGTAVVPFRATQEKNVIQIEGYMPLDCMFCSQTFTHSEDLNKHVLMQHRPTLCEP

SEQ ID NO: 99323 - protein, 722 aa, Homo sapiens
  Payload ID: 19808
  Gene Name: zinc finger protein 219
  Uniprot ID: Q9P2Y4
  ENSP ID: ENSP00000354206
MEGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTHQPERPRSPAARLLLELEERALLREARLGRARSSGGMQATPATEGLARPQAPSSSAFRCPYCKGKFRTSAERERHLHILHRPWKCGLCSFGSSQEEELLHHSLTAHGAPERPLAATSAAPPPQPQPQPPPQPEPRSVPQPEPEPEPEREATPTPAPAAPEEPPAPPEFRCQVCGQSFTQSWFLKGHMRKHKASFDHACPVCGRCFKEPWFLKNHMKVHASKLGPLRAPGPASGPARAPQPPDLGLLAYEPLGPALLLAPAPTPAERREPPSLLGYLSLRAGEGRPNGEGAEPGPGRSFGGFRPLSSALPARARRHRAEEPEEEEEVVEAEEETWARGRSLGSLASLHPRPGEGPGHSASAAGAQARSTATQEENGLLVGGTRPEGGRGATGKDCPFCGKSFRSAHHLKVHLRVHTGERPYKCPHCDYAGTQSGSLKYHLQRHHREQRSGAGPGPPPEPPPPSQRGSAPQSGAKPSPQPATWVEGASSPRPPSSGAGPGSRRKPASPGRTLRNGRGGEAEPLDLSLRAGPGGEAGPGGALHRCLFCPFATGAPELMALHLQVHHSRRARGRRPPQADASPPYARVPSGETPPSPSQEGEEGSGLSRPGEAGLGGQER

SEQ ID NO: 99324 - protein, 722 aa, Homo sapiens; identical to SEQ ID NO: 99323
  Payload ID: 19808
  Gene Name: zinc finger protein 219
  Uniprot ID: Q9P2Y4
  ENSP ID: ENSP00000388558

SEQ ID NO: 99325 - protein, 722 aa, Homo sapiens; identical to SEQ ID NO: 99323
  Payload ID: 19808
  Gene Name: zinc finger protein 219
  Uniprot ID: Q9P2Y4
  ENSP ID: ENSP00000392401

SEQ ID NO: 99326 - protein, 111 aa, Homo sapiens
  Payload ID: 19808
  Gene Name: zinc finger protein 219
  ENSP ID: ENSP00000450609
MEGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTHQPER

SEQ ID NO: 99327 - protein, 211 aa, Homo sapiens
  Payload ID: 19808
  Gene Name: zinc finger protein 219
  ENSP ID: ENSP00000450803
MEGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTHQPERPRSPAARLLLELEERALLREARLGRARSSGGMQATPATEGLARPQAPSSSAFRCPYCKGKFRTSAERERHLHILHRPWKCGLCSFGSSQEEELLHHSLTA

SEQ ID NO: 99328 - protein, 107 aa, Homo sapiens
  Payload ID: 19808
  Gene Name: zinc finger protein 219
  ENSP ID: ENSP00000450900
MEGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTH

SEQ ID NO: 99329 - protein, 158 aa, Homo sapiens
  Payload ID: 19808
  Gene Name: zinc finger protein 219
  ENSP ID: ENSP00000451212
MLGQKERQSQLLPCSTAPVAFISSFSSSSLHFPEPKNVKGVHGDLSPQGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTHQPERP

SEQ ID NO: 99330 - protein, 31 aa, Homo sapiens
  Payload ID: 19808
  Gene Name: zinc finger protein 219
  ENSP ID: ENSP00000451595
MEGSRPRAPSGHLAPSPPAFDGELDLQRYSN

SEQ ID NO: 99331 - protein, 145 aa, Homo sapiens
  Payload ID: 19808
  Gene Name: zinc finger protein 219
  ENSP ID: ENSP00000451890
MNPIRSTAPVAFISSFSSSSLHFPEPKNVKGVHGDLSPQGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTHQ

SEQ ID NO: 99332 - protein, 57 aa, Homo sapiens
  Payload ID: 19808
  Gene Name: zinc finger protein 219
  ENSP ID: ENSP00000451969
MGAVSWSESRAGERRFPCPVCGKRFRFNSILALHLRAHPGAQAFQCPHCGHRAAQRA

SEQ ID NO: 99333 - protein, 224 aa, Homo sapiens
  Payload ID: 19809
  Gene Name: zinc finger protein 22
  Uniprot ID: P17026
  ENSP ID: ENSP00000298299
MRLAKPKAGISRSSSQGKAYENKRKTGRQRQKWGMTIRFDSSFSRLRRSLDDKPYKCTECEKSFSQSSTLFQHQKIHTGKKSHKCADCGKSFFQSSNLIQHRRIHTGEKPYKCDECGESFKQSSNLIQHQRIHTGEKPYQCDECGRCFSQSSHLIQHQRTHTGEKPYQCSECGKCFSQSSHLRQHMKVHKEEKPRKTRGKNIRVKTHLPSWKAGTGRKSVAGLR

SEQ ID NO: 99334 - protein, 617 aa, Homo sapiens
  Payload ID: 19810
  Gene Name: zinc finger protein 221
  ENSP ID: ENSP00000251269
MISPSLELLHSGLCKFPEVEGKMTTFKEAVTFKDVAVVFTEEELGLLDPAQRKLYRDVMLENFRNLLSVGNQPFHQDTFHFLGKEKFWKMKTTSQREGNSGGKIQIEMETVPEAGPHEEWSCQQIWEQIASDLTRSQNSIRNSSQFFKEGDVPCQIEARLSISHVQQKPYRCNECKQSFSDVSVFDLHQQSHSGEKSHTCGECGKSFCYSPALHIHQRVHMGEKCYKCDVCGKEFNQSSHLQTHQRVHTGEKPFKCGQCGKGFHSRSALNVHCKLHTGEKPYNCEECGKAFIHDSQLQEHQRIHTGEKPFKCDICGKSFRVRSRLNRHSMVHTGEKPFRCDTCGKNFRQRSALNSHSMVHIEEKPYKCEQCGKGFICRRDFCKHQMVHTGEKPYNCKECGKTFRWSSCLLNHQQVHSGQKSFKCEECGKGFYTNSRRSSHQRSHNGEKPYNCEECGKDYKRRLDLEFHQRVHTGERPYNCKECGKSFGWASCLLKHQRLHSGEKPFKCEECGKRFTQSSQLHSHQTCHTGEKLYKCEQCEKGYNSKFNLDMHQRVHGGERPYNCKECGKSFGWASCLLKHQRLHSGEKPLKSGVWEEIYSEFTASFTSVSLCGRKAI

SEQ ID NO: 99335 - protein, 130 aa, Homo sapiens
  Payload ID: 19810
  Gene Name: zinc finger protein 221
  ENSP ID: ENSP00000464885
MISPSLELLHSGLCKFPEVEGKMTTFKEAVTFKDVAVVFTEEELGLLDPAQRKLYRDVMLENFRNLLSVGNQPFHQDTFHFLGKEKFWKMKTTSQREGNSGGKIQIEMETVPEAGPHEEWSCQQIWEQIA

SEQ ID NO: 99336 - protein, 617 aa, Homo sapiens; identical to SEQ ID NO: 99334
  Payload ID: 19810
  Gene Name: zinc finger protein 221
  ENSP ID: ENSP00000467367

SEQ ID NO: 99337 - protein, 617 aa, Homo sapiens; identical to SEQ ID NO: 99334
  Payload ID: 19810
  Gene Name: zinc finger protein 221
  ENSP ID: ENSP00000467446

SEQ ID NO: 99338 - protein, 617 aa, Homo sapiens; identical to SEQ ID NO: 99334
  Payload ID: 19810
  Gene Name: zinc finger protein 221
  ENSP ID: ENSP00000477876

SEQ ID NO: 99339 - protein, 451 aa, Homo sapiens
  Payload ID: 19811
  Gene Name: zinc finger protein 222
  Uniprot ID: Q9UK12
  ENSP ID: ENSP00000187879
MAKLYEAVTFKDVAVIFTEEELGLLDPAQRKLYRDVMLENFRNLLSVGGKIQTEMETVPEAGTHEEFSCKQIWEQIASDLTRSQDTTISNSQLFEQDDNPSQIKARLSTVHTREKPFQGENCKQFFSDVSFFDLPQQLYSGEKSHTCDECGKSFCYISALHIHQRVHMGVKCYKCDVCGKEFSQSSRLQTHQRVHTGEKPFKCEQCGKGFRCRSALKVHCKLHMREKPYNCEKCGKAFMHNFQLQKHHRIHTGEKPFKCEICGKSFCLRSSLNRHCMVHTAEKLYKSEKYGRGFIDRLDLHKHQMIHMGQKPYNCKECGKSFKWSSYLLVHQRVHTGEKPYKCEECGKGYISKSGLDFHHRTHTGERSYNCDNCGKSFRHASSILNHKKLHCQRKPLKCEDCGKRLVCRSYCKDQQRDHSGENPSKCEDCGKRYKRRLNLDIILSLFLNDI

SEQ ID NO: 99340 - protein, 491 aa, Homo sapiens
  Payload ID: 19811
  Gene Name: zinc finger protein 222
  Uniprot ID: Q9UK12
  ENSP ID: ENSP00000375822
MIDSGEKKPGRRAEEAVTFKDVAVIFTEEELGLLDPAQRKLYRDVMLENFRNLLSVGHQPFHGDTFHFLREEKFWVMGTTSQREGNLGGKIQTEMETVPEAGTHEEFSCKQIWEQIASDLTRSQDTTISNSQLFEQDDNPSQIKARLSTVHTREKPFQGENCKQFFSDVSFFDLPQQLYSGEKSHTCDECGKSFCYISALHIHQRVHMGVKCYKCDVCGKEFSQSSRLQTHQRVHTGEKPFKCEQCGKGFRCRSALKVHCKLHMREKPYNCEKCGKAFMHNFQLQKHHRIHTGEKPFKCEICGKSFCLRSSLNRHCMVHTAEKLYKSEKYGRGFIDRLDLHKHQMIHMGQKPYNCKECGKSFKWSSYLLVHQRVHTGEKPYKCEECGKGYISKSGLDFHHRTHTGERSYNCDNCGKSFRHASSILNHKKLHCQRKPLKCEDCGKRLVCRSYCKDQQRDHSGENPSKCEDCGKRYKRRLNLDIILSLFLNDI

SEQ ID NO: 99341 - protein, 90 aa, Homo sapiens
  Payload ID: 19811
  Gene Name: zinc finger protein 222
  ENSP ID: ENSP00000466778
MIDSGEKKPGRRAEEAVTFKDVAVIFTEEELGLLDPAQRKLYRDVMLENFRNLLSVGHQPFHGDTFHFLREEKFWVMGTTSQREGNLGPL

SEQ ID NO: 99342 - protein, 482 aa, Homo sapiens
  Payload ID: 19812
  Gene Name: zinc finger protein 223
  Uniprot ID: Q9UK11
  ENSP ID: ENSP00000401947
MTMSKEAVTFKDVAVVFTEEELGLLDLAQRKLYRDVMLENFRNLLSVGHQPFHRDTFHFLREEKFWMMDIATQREGNSGGKIQPEMKTFPEAGPHEGWSCQQIWEEIASDLTRPQDSTIKSSQFFEQGDAHSQVEEGLSIMHTGQKPSNCGKCKQSFSDMSIFDLPQQIRSAEKSHSCDECGKSFCYISALHIHQRVHLGEKLFKCDVCGKEFSQSLHLQTHQRVHTGEKPFKCEQCGRGFRCRSALTVHCKLHMGEKHYNCEACGRAFIHDFQLQKHQRIHTGEKPFKCEICSVSFRLRSSLNRHCVVHTGKKPNSTGEYGKGFIRRLDLCKHQTIHTGEKPYNCKECGKSFRRSSYLLIHQRVHTGEKPYKCDKCGKSYITKSGLDLHHRAHTGERPYNCDDCGKSFRQASSILNHKRLHCRKKPFKCEDCGKKLVYRSYRKDQQKNHSGENPSKCEDCGKRYKRRLNLDIILSLFLNDT

SEQ ID NO: 99343 - protein, 89 aa, Homo sapiens
  Payload ID: 19812
  Gene Name: zinc finger protein 223
  ENSP ID: ENSP00000467561
MTMSKEAVTFKDVAVVFTEEELGLLDLAQRKLYRDVMLENFRNLLSVGHQPFHRDTFHFLREEKFWMMDIATQREGNSGKKHATVCPCL

SEQ ID NO: 99344 - protein, 222 aa, Homo sapiens
  Payload ID: 19812
  Gene Name: zinc finger protein 223
  ENSP ID: ENSP00000467647
MLENFRNLLSVGHQPFHRDTFHFLREEKFWMMDIATQREGNSGGKIQPEMKTFPEAGPHEGWSCQQIWEEIASDLTRPQDSTIKSSQFFEQGDAHSQVEEGLSIMHTGQKPSNCGKCKQSFSDMSIFDLPQQIRSAEKSHSCDECGKSFCYISALHIHQRVHLGEKLFKCDVCGKEFSQSLHLQTHQRVHTGEKPFKCEQCGRGFRCRSALTVHCKLHMGEK

SEQ ID NO: 99345 - protein, 92 aa, Homo sapiens
  Payload ID: 19812
  Gene Name: zinc finger protein 223
  ENSP ID: ENSP00000468129
MTMSKEAVTFKDVAVVFTEEELGLLDLAQRKLYRDVMLENFRNLLSVGHQPFHRDTFHFLREEKFWMMDIATQREGNSGGSVQASKCRNRSK

SEQ ID NO: 99346 - protein, 707 aa, Homo sapiens
  Payload ID: 19813
  Gene Name: zinc finger protein 224
  Uniprot ID: Q9NZL3
  ENSP ID: ENSP00000337368
MTTFKEAMTFKDVAVVFTEEELGLLDLAQRKLYRDVMLENFRNLLSVGHQAFHRDTFHFLREEKIWMMKTAIQREGNSGDKIQTEMETVSEAGTHQEWSFQQIWEKIASDLTRSQDLMINSSQFSKEGDFPCQTEAGLSVIHTRQKSSQGNGYKPSFSDVSHFDFHQQLHSGEKSHTCDECGKNFCYISALRIHQRVHMGEKCYKCDVCGKEFSQSSHLQTHQRVHTGEKPFKCVECGKGFSRRSALNVHHKLHTGEKPYNCEECGKAFIHDSQLQEHQRIHTGEKPFKCDICGKSFCGRSRLNRHSMVHTAEKPFRCDTCDKSFRQRSALNSHRMIHTGEKPYKCEECGKGFICRRDLYTHHMVHTGEKPYNCKECGKSFRWASCLLKHQRVHSGEKPFKCEECGKGFYTNSQCYSHQRSHSGEKPYKCVECGKGYKRRLDLDFHQRVHTGEKLYNCKECGKSFSRAPCLLKHERLHSGEKPFQCEECGKRFTQNSHLHSHQRVHTGEKPYKCEKCGKGYNSKFNLDMHQKVHTGERPYNCKECGKSFGWASCLLKHQRLHSGEKPFKCEECGKRFTQNSQLHSHQRVHTGEKPYKCDECGKGFSWSSTRLTHQRRHSRETPLKCEQHGKNIVQNSFSKVQEKVHSVEKPYKCEDCGKGYNRRLNLDMHQRVHMGEKTWKCRECDMCFSQASSLRLHQNVHVGEKP

SEQ ID NO: 99347 - protein, 66 aa, Homo sapiens
  Payload ID: 19813
  Gene Name: zinc finger protein 224
  ENSP ID: ENSP00000465000
MTTFKEAMTFKDVAVVFTEEELGLLDLAQRKLYRDVMLENFRNLLSVGHQAFHRDTFHFLREEKIW

SEQ ID NO: 99348 - protein, 53 aa, Homo sapiens
  Payload ID: 19813
  Gene Name: zinc finger protein 224
  ENSP ID: ENSP00000465886
MTTFKEAMTFKDVAVVFTEEELGLLDLAQRKLYRDVMLENFRNLLSVGHQAFH

SEQ ID NO: 99349 - protein, 124 aa, Homo sapiens
  Payload ID: 19813
  Gene Name: zinc finger protein 224
  ENSP ID: ENSP00000466961
MTTFKEAMTFKDVAVVFTEEELGLLDLAQRKLYRDVMLENFRNLLSVGHQAFHRDTFHFLREEKIWMMKTAIQREGNSGDKIQTEMETVSEAGTHQEWSFQQIWEKIASDLTRSQDLMINSSQF

SEQ ID NO: 99350 - protein, 706 aa, Homo sapiens
  Payload ID: 19814
  Gene Name: zinc finger protein 225
  Uniprot ID: Q9UK10
  ENSP ID: ENSP00000262894
MTTLKEAVTFKDVAVVFTEEELRLLDLAQRKLYREVMLENFRNLLSVGHQSLHRDTFHFLKEEKFWMMETATQREGNLGGKIQMEMETVSESGTHEGLFSHQTWEQISSDLTRFQDSMVNSFQFSKQDDMPCQVDAGLSIIHVRQKPSEGRTCKKSFSDVSVLDLHQQLQSREKSHTCDECGKSFCYSSALRIHQRVHMGEKLYNCDVCGKEFNQSSHLQIHQRIHTGEKPFKCEQCGKGFSRRSGLYVHRKLHTGVKPHICEKCGKAFIHDSQLQEHQRIHTGEKPFKCDICCKSFRSRANLNRHSMVHMREKPFRCDTCGKSFGLKSALNSHRMVHTGEKRYKCEECGKRFIYRQDLYKHQIDHTGEKPYNCKECGKSFRWASGLSRHVRVHSGETTFKCEECGKGFYTNSQRYSHQRAHSGEKPYRCEECGKGYKRRLDLDFHQRVHRGEKPYNCKECGKSFGWASCLLNHQRIHSGEKPFKCEECGKRFTQNSQLYTHRRVHSGEKPFKCEECGKRFTQNSQLYSHRRVHTGVKPYKCEECGKGFNSKFNLDMHQRVHTGERPYNCKECGKSFSRASSILNHKRLHGDEKPFKCEECGKRFTENSQLHSHQRVHTGEKPYKCEKCGKSFRWASTHLTHQRLHSREKLLQCEDCGKSIVHSSCLKDQQRDQSGEKTSKCEDCGKRYKRRLNLDTLLSLFLNDT

SEQ ID NO: 99351 - protein, 122 aa, Homo sapiens
  Payload ID: 19814
  Gene Name: zinc finger protein 225
  ENSP ID: ENSP00000466853
MTTLKEAVTFKDVAVVFTEEELRLLDLAQRKLYREVMLENFRNLLSVGHQSLHRDTFHFLKEEKFWMMETATQREGNLGGKIQMEMETVSESGTHEGLFSHQTWEQISSDLTRFQDSMVNSF

SEQ ID NO: 99352 - protein, 91 aa, Homo sapiens
  Payload ID: 19814
  Gene Name: zinc finger protein 225
  ENSP ID: ENSP00000466889
MTTLKEAVTFKDVAVVFTEEELRLLDLAQRKLYREVMLENFRNLLSVGHQSLHRDTFHFLKEEKFWMMETATQREGNLGPAFQIPIKTEGF

SEQ ID NO: 99353 - protein, 51 aa, Homo sapiens
  Payload ID: 19814
  Gene Name: zinc finger protein 225
  ENSP ID: ENSP00000468414
MTTLKEAVTFKDVAVVFTEEELRLLDLAQRKLYREVMLENFRNLLSVGHQS

SEQ ID NO: 99354 - protein, 706 aa, Homo sapiens; identical to SEQ ID NO: 99350
  Payload ID: 19814
  Gene Name: zinc finger protein 225
  Uniprot ID: Q9UK10
  ENSP ID: ENSP00000468686

SEQ ID NO: 99355 - protein, 94 aa, Homo sapiens
  Payload ID: 19815
  Gene Name: zinc finger protein 226
  Uniprot ID: Q9NYT6
  ENSP ID: ENSP00000300823
MNMFKEAVTFKDVAVAFTEEELGLLGPAQRKLYRDVMVENFRNLLSVGHPPFKQDVSPIERNEQLWIMTTATRRQGNLDTLLVKALLLYDLAQT

SEQ ID NO: 99356 - protein, 803 aa, Homo sapiens
  Payload ID: 19815
  Gene Name: zinc finger protein 226
  Uniprot ID: Q9NYT6
  ENSP ID: ENSP00000336719
MNMFKEAVTFKDVAVAFTEEELGLLGPAQRKLYRDVMVENFRNLLSVGHPPFKQDVSPIERNEQLWIMTTATRRQGNLGEKNQSKLITVQDRESEEELSCWQIWQQIANDLTRCQDSMINNSQCHKQGDFPYQVGTELSIQISEDENYIVNKADGPNNTGNPEFPILRTQDSWRKTFLTESQRLNRDQQISIKNKLCQCKKGVDPIGWISHHDGHRVHKSEKSYRPNDYEKDNMKILTFDHNSMIHTGQKSYQCNECKKPFSDLSSFDLHQQLQSGEKSLTCVERGKGFCYSPVLPVHQKVHVGEKLKCDECGKEFSQGAHLQTHQKVHVIEKPYKCKQCGKGFSRRSALNVHCKVHTAEKPYNCEECGRAFSQASHLQDHQRLHTGEKPFKCDACGKSFSRNSHLQSHQRVHTGEKPYKCEECGKGFICSSNLYIHQRVHTGEKPYKCEECGKGFSRPSSLQAHQGVHTGEKSYICTVCGKGFTLSSNLQAHQRVHTGEKPYKCNECGKSFRRNSHYQVHLVVHTGEKPYKCEICGKGFSQSSYLQIHQKAHSIEKPFKCEECGQGFNQSSRLQIHQLIHTGEKPYKCEECGKGFSRRADLKIHCRIHTGEKPYNCEECGKVFRQASNLLAHQRVHSGEKPFKCEECGKSFGRSAHLQAHQKVHTGDKPYKCDECGKGFKWSLNLDMHQRVHTGEKPYKCGECGKYFSQASSLQLHQSVHTGEKPYKCDVCGKVFSRSSQLQSHQRVHTGEKPYKCEICGKSFSWRSNLTVHHRIHVGDKSYKSNRGGKNIRESTQEKKSIK

SEQ ID NO: 99357 - protein, 803 aa, Homo sapiens; identical to SEQ ID NO: 99356
  Payload ID: 19815
  Gene Name: zinc finger protein 226
  Uniprot ID: Q9NYT6
  ENSP ID: ENSP00000393265

SEQ ID NO: 99358 - protein, 94 aa, Homo sapiens; identical to SEQ ID NO: 99355
  Payload ID: 19815
  Gene Name: zinc finger protein 226
  Uniprot ID: Q9NYT6
  ENSP ID: ENSP00000407474

SEQ ID NO: 99359 - protein, 89 aa, Homo sapiens
  Payload ID: 19815
  Gene Name: zinc finger protein 226
  ENSP ID: ENSP00000464735
MNMFKEAVTFKDVAVAFTEEELGLLGPAQRKLYRDVMVENFRNLLSVGHPPFKQDVSPIERNEQLWIMTTATRRQGNLGKNQTVMSSYS

SEQ ID NO: 99360 - protein, 114 aa, Homo sapiens
  Payload ID: 19815
  Gene Name: zinc finger protein 226
  ENSP ID: ENSP00000465043
MVENFRNLLSVGHPPFKQDVSPIERNEQLWIMTTATRRQGNLGEKNQSKLITVQDRESEEELSCWQIWQQIANDLTRCQDSMINNSQCHKQGDFPYQVGTELSIQISEDENYIV

SEQ ID NO: 99361 - protein, 803 aa, Homo sapiens; identical to SEQ ID NO: 99356
  Payload ID: 19815
  Gene Name: zinc finger protein 226
  Uniprot ID: Q9NYT6
  ENSP ID: ENSP00000465121

SEQ ID NO: 99362 - protein, 89 aa, Homo sapiens; identical to SEQ ID NO: 99359
  Payload ID: 19815
  Gene Name: zinc finger protein 226
  ENSP ID: ENSP00000465401

SEQ ID NO: 99363 - protein, 72 aa, Homo sapiens
  Payload ID: 19815
  Gene Name: zinc finger protein 226
  ENSP ID: ENSP00000465730
MNMFKEAVTFKDVAVAFTEEELGLLGPAQRKLYRDVMVENFRNLLSVGHPPFKQDVSPIERNEQLWIMTTAT

SEQ ID NO: 99364 - protein, 66 aa, Homo sapiens
  Payload ID: 19815
  Gene Name: zinc finger protein 226
  ENSP ID: ENSP00000465951
MNMFKEAVTFKDVAVAFTEEELGLLGPAQRKLYRDVMVENFRNLLSVGHPPFKQDVSPIERNEQLW

SEQ ID NO: 99365 - protein, 89 aa, Homo sapiens
  Payload ID: 19815
  Gene Name: zinc finger protein 226
  ENSP ID: ENSP00000465984
MNMFKEAVTFKDVAVAFTEEELGLLGPAQRKLYRDVMVENFRNLLSVGHPPFKQDVSPIERNEQLWIMTTATRRQGNLGEKNQSKLITV

SEQ ID NO: 99366 - protein, 139 aa, Homo sapiens
  Payload ID: 19815
  Gene Name: zinc finger protein 226
  ENSP ID: ENSP00000466141
MNMFKEAVTFKDVAVAFTEEELGLLGPAQRKLYRDVMVENFRNLLSVGHPPFKQDVSPIERNEQLWIMTTATRRQGNLGEKNQSKLITVQDRESEEELSCWQIWQQIANDLTRCQDSMINNSQCHKQGDFPYQVGTELS

SEQ ID NO: 99367 - protein, 94 aa, Homo sapiens; identical to SEQ ID NO: 99355
  Payload ID: 19815
  Gene Name: zinc finger protein 226
  Uniprot ID: Q9NYT6
  ENSP ID: ENSP00000467003

SEQ ID NO: 99368 - protein, 60 aa, Homo sapiens
  Payload ID: 19815
  Gene Name: zinc finger protein 226
  ENSP ID: ENSP00000467539
MNMFKEAVTFKDVAVAFTEEELGLLGPAQRKLYRDVMVENFRNLLSVGHPPFKQDVSPIE

SEQ ID NO: 99369 - protein, 89 aa, Homo sapiens; identical to SEQ ID NO: 99359
  Payload ID: 19815
  Gene Name: zinc finger protein 226
  ENSP ID: ENSP00000467748

SEQ ID NO: 99370 - protein, 153 aa, Homo sapiens
  Payload ID: 19815
  Gene Name: zinc finger protein 226
  ENSP ID: ENSP00000467766
MNMFKEAVTFKDVAVAFTEEELGLLGPAQRKLYRDVMVENFRNLLSVGHPPFKQDVSPIERNEQLWIMTTATRRQGNLGEKNQSKLITVQDRESEEELSCWQIWQQIANDLTRCQDSMINNSQCHKQGDFPYQVGTELSIQISEDENYIVNKA

SEQ ID NO: 99371 - protein, 27 aa, Homo sapiens
  Payload ID: 19815
  Gene Name: zinc finger protein 226
  ENSP ID: ENSP00000468462
MNMFKEAVTFKDVAVAFTEEELGLLGP

SEQ ID NO: 99372 - protein, 127 aa, Homo sapiens
  Payload ID: 19815
  Gene Name: zinc finger protein 226
  ENSP ID: ENSP00000468779
MNMFKEAVTFKDVAVAFTEEELGLLGPAQRKLYRDVMVENFRNLLSVGHPPFKQDVSPIERNEQLWIMTTATRRQGNLGEKNQSKLITVQDRESEEELSCWQIWQQIANDLTRCQDSMINNSQCHKQ

SEQ ID NO: 99373 - protein, 799 aa, Homo sapiens
  Payload ID: 19816
  Gene Name: zinc finger protein 227
  Uniprot ID: Q86WZ6
  ENSP ID: ENSP00000321049
MPSQNYDLPQKKQEKMTKFQEAVTFKDVAVVFSREELRLLDLTQRKLYRDVMVENFKNLVAVGHLPFQPDMVSQLEAEEKLWMMETETQRSSKHQNKMETLQKFALKYLSNQELSCWQIWKQVASELTRCLQGKSSQLLQGDSIQVSENENNIMNPKGDSSIYIENQEFPFWRTQHSCGNTYLSESQIQSRGKQIDVKNNLQIHEDFMKKSPFHEHIKTDTEPKPCKGNEYGKIISDGSNQKLPLGEKPHPCGECGRGFSYSPRLPLHPNVHTGEKCFSQSSHLRTHQRIHPGEKLNRCHESGDCFNKSSFHSYQSNHTGEKSYRCDSCGKGFSSSTGLIIHYRTHTGEKPYKCEECGKCFSQSSNFQCHQRVHTEEKPYKCEECGKGFGWSVNLRVHQRVHRGEKPYKCEECGKGFTQAAHFHIHQRVHTGEKPYKCDVCGKGFSHNSPLICHRRVHTGEKPYKCEACGKGFTRNTDLHIHFRVHTGEKPYKCKECGKGFSQASNLQVHQNVHTGEKRFKCETCGKGFSQSSKLQTHQRVHTGEKPYRCDVCGKDFSYSSNLKLHQVIHTGEKPYKCEECGKGFSWRSNLHAHQRVHSGEKPYKCEQCDKSFSQAIDFRVHQRVHTGEKPYKCGVCGKGFSQSSGLQSHQRVHTGEKPYKCDVCGKGFRYSSQFIYHQRGHTGEKPYKCEECGKGFGRSLNLRHHQRVHTGEKPHICEECGKAFSLPSNLRVHLGVHTREKLFKCEECGKGFSQSARLEAHQRVHTGEKPYKCDICDKDFRHRSRLTYHQKVHTGKKL

SEQ ID NO: 99374 - protein, 748 aa, Homo sapiens
  Payload ID: 19816
  Gene Name: zinc finger protein 227
  Uniprot ID: Q86WZ6
  ENSP ID: ENSP00000375823
MVENFKNLVAVGHLPFQPDMVSQLEAEEKLWMMETETQRSSKHQNKMETLQKFALKYLSNQELSCWQIWKQVASELTRCLQGKSSQLLQGDSIQVSENENNIMNPKGDSSIYIENQEFPFWRTQHSCGNTYLSESQIQSRGKQIDVKNNLQIHEDFMKKSPFHEHIKTDTEPKPCKGNEYGKIISDGSNQKLPLGEKPHPCGECGRGFSYSPRLPLHPNVHTGEKCFSQSSHLRTHQRIHPGEKLNRCHESGDCFNKSSFHSYQSNHTGEKSYRCDSCGKGFSSSTGLIIHYRTHTGEKPYKCEECGKCFSQSSNFQCHQRVHTEEKPYKCEECGKGFGWSVNLRVHQRVHRGEKPYKCEECGKGFTQAAHFHIHQRVHTGEKPYKCDVCGKGFSHNSPLICHRRVHTGEKPYKCEACGKGFTRNTDLHIHFRVHTGEKPYKCKECGKGFSQASNLQVHQNVHTGEKRFKCETCGKGFSQSSKLQTHQRVHTGEKPYRCDVCGKDFSYSSNLKLHQVIHTGEKPYKCEECGKGFSWRSNLHAHQRVHSGEKPYKCEQCDKSFSQAIDFRVHQRVHTGEKPYKCGVCGKGFSQSSGLQSHQRVHTGEKPYKCDVCGKGFRYSSQFIYHQRGHTGEKPYKCEECGKGFGRSLNLRHHQRVHTGEKPHICEECGKAFSLPSNLRVHLGVHTREKLFKCEECGKGFSQSARLEAHQRVHTGEKPYKCDICDKDFRHRSRLTYHQKVHTGKKL

SEQ ID NO: 99375 - protein, 82 aa, Homo sapiens
  Payload ID: 19816
  Gene Name: zinc finger protein 227
  ENSP ID: ENSP00000464800
MPSQNYDLPQKKQEKMTKFQEAVTFKDVAVVFSREELRLLDLTQRKLYRDVMVENFKNLVAVGHLPFQPDMVSQLEAEEKLW

SEQ ID NO: 99376 - protein, 96 aa, Homo sapiens
  Payload ID: 19816
  Gene Name: zinc finger protein 227
  ENSP ID: ENSP00000464866
MVENFKNLVAVGSKHQNKMETLQKFALKYLSNQELSCWQIWKQVASELTRCLQGKSSQLLQGDSIQVSENENNIMNPKGDSSIYIENQEFPFWRTQ

SEQ ID NO: 99377 - protein, 37 aa, Homo sapiens
  Payload ID: 19816
  Gene Name: zinc finger protein 227
  ENSP ID: ENSP00000465071
MVENFKNLVAVGEDRHSLTLNFSSLENLFALRQQASK

SEQ ID NO: 99378 - protein, 215 aa, Homo sapiens
  Payload ID: 19816
  Gene Name: zinc finger protein 227
  ENSP ID: ENSP00000466197
MPSQNYDLPQKKQEKMTKFQEAVTFKDVAVVFSREELRLLDLTQRKLYRDVMVENFKNLVAVGSKHQNKMETLQKFALKYLSNQELSCWQIWKQVASELTRCLQGKSSQLLQGDSIQVSENENNIMNPKGDSSIYIENQEFPFWRTQHSCGNTYLSESQIQSRGKQIDVKNNLQIHEDFMKKSPFHEHIKTDTEPKPCKGNEYGKIISDGSNQKL

SEQ ID NO: 99379 - protein, 82 aa, Homo sapiens
  Payload ID: 19816
  Gene Name: zinc finger protein 227
  ENSP ID: ENSP00000467496
MPSQNYDLPQKKQEKMTKFQGGTATARSYPEEAVPRCHGGELQEPGCSGASSLPTRYGIPIGSRRKALDDGNRNPKKQQASK

SEQ ID NO: 99380 - protein, 748 aa, Homo sapiens; identical to SEQ ID NO: 99374
  Payload ID: 19816
  Gene Name: zinc finger protein 227
  Uniprot ID: Q86WZ6
  ENSP ID: ENSP00000467577

SEQ ID NO: 99381 - protein, 799 aa, Homo sapiens; identical to SEQ ID NO: 99373
  Payload ID: 19816
  Gene Name: zinc finger protein 227
  Uniprot ID: Q86WZ6
  ENSP ID: ENSP00000482749

SEQ ID NO: 99382 - protein, 12 aa, Homo sapiens
  Payload ID: 19817
  Gene Name: zinc finger protein 229
  ENSP ID: ENSP00000464902
MSQEPLSFKDVA

SEQ ID NO: 99383 - protein, 819 aa, Homo sapiens
  Payload ID: 19817
  Gene Name: zinc finger protein 229
  ENSP ID: ENSP00000479807
METLTSRHEKRALHSQASAISQDREEKIMSQEPLSFKDVAVVFTEEELELLDSTQRQLYQDVMQENFRNLLSVGDKNGKDTEYIQDEELRFFSHKELSSCKIWEEVAGELPGSQDCRVNLQGKDFQFSEDAAPHQGWEGASTPCFPIENFLDSLQGDGLIGLENQQFPAWRAIRPIPIQGSWAKAFVNQLGDVQERCKNLDTEDTVYKCNWDDDSFCWISCHVDHRFPEIDKPCGCNKCRKDCIKNSVLHRINPGENGLKSNEYRNGFRDDADLPPHPRVPLKEKLCQYDEFSEGLRHSAHLNRHQRVPTGEKSVKSLERGRGVRQNTHIRNHPRAPVGDMPYRCDVCGKGFRYKSVLLIHQGVHTGRRPYKCEECGKAFGRSSNLLVHQRVHTGEKPYKCSECGKGFSYSSVLQVHQRLHTGEKPYTCSECGKGFCAKSALHKHQHIHPGEKPYSCGECGKGFSCSSHLSSHQKTHTGERPYQCDKCGKGFSHNSYLQAHQRVHMGQHLYKCNVCGKSFSYSSGLLMHQRLHTGEKPYKCECGKSFGRSSDLHIHQRVHTGEKPYKCSECGKGFRRNSDLHSHQRVHTGERPYVCDVCGKGFIYSSDLLIHQRVHTGEKPYKCAECGKGFSYSSGLLIHQRVHTGEKPYRCQECGKGFRCTSSLHKHQRVHTGKKPYTCDQCGKGFSYGSNLRTHQRLHTGEKPYTCCECGKGFRYGSGLLSHKRVHTGEKPYRCHVCGKGYSQSSHLQGHQRVHTGEKPYKCEECGKGFGRNSCLHVHQRVHTGEKPYTCGVCGKGFSYTSGLRNHQRVHLGENPYK

SEQ ID NO: 99384 - protein, 825 aa, Homo sapiens
  Payload ID: 19817
  Gene Name: zinc finger protein 229
  Uniprot ID: Q9UJW7
  ENSP ID: ENSP00000479884
METLTSRHEKRALHSQASAISQDREEKIMSQEPLSFKDVAVVFTEEELELLDSTQRQLYQDVMQENFRNLLSVGERNPLGDKNGKDTEYIQDEELRFFSHKELSSCKIWEEVAGELPGSQDCRVNLQGKDFQFSEDAAPHQGWEGASTPCFPIENFLDSLQGDGLIGLENQQFPAWRAIRPIPIQGSWAKAFVNQLGDVQERCKNLDTEDTVYKCNWDDDSFCWISCHVDHRFPEIDKPCGCNKCRKDCIKNSVLHRINPGENGLKSNEYRNGFRDDADLPPHPRVPLKEKLCQYDEFSEGLRHSAHLNRHQRVPTGEKSVKSLERGRGVRQNTHIRNHPRAPVGDMPYRCDVCGKGFRYKSVLLIHQGVHTGRRPYKCEECGKAFGRSSNLLVHQRVHTGEKPYKCSECGKGFSYSSVLQVHQRLHTGEKPYTCSECGKGFCAKSALHKHQHIHPGEKPYSCGECGKGFSCSSHLSSHQKTHTGERPYQCDKCGKGFSHNSYLQAHQRVHMGQHLYKCNVCGKSFSYSSGLLMHQRLHTGEKPYKCECGKSFGRSSDLHIHQRVHTGEKPYKCSECGKGFRRNSDLHSHQRVHTGERPYVCDVCGKGFIYSSDLLIHQRVHTGEKPYKCAECGKGFSYSSGLLIHQRVHTGEKPYRCQECGKGFRCTSSLHKHQRVHTGKKPYTCDQCGKGFSYGSNLRTHQRLHTGEKPYTCCECGKGFRYGSGLLSHKRVHTGEKPYRCHVCGKGYSQSSHLQGHQRVHTGEKPYKCEECGKGFGRNSCLHVHQRVHTGEKPYTCGVCGKGFSYTSGLRNHQRVHLGENPYK

SEQ ID NO: 99385 - protein, 83 aa, Homo sapiens
  Payload ID: 19817
  Gene Name: zinc finger protein 229
  ENSP ID: ENSP00000483138
METLTSRHEKRALHSQASAISQDREEKIMSQEPLSFKDVAVVFTEEELELLDSTQRQLYQDVMQENFRNLLSVGERNPLGNWN

SEQ ID NO: 99386 - protein, 643 aa, Homo sapiens
  Payload ID: 19818
  Gene Name: zinc finger protein 23
  Uniprot ID: P17027
  ENSP ID: ENSP00000349796
MLENYGNVASLGFPLLKPAVISQLEGGSELGGSSPLAAGTGLQGLQTDIQTDNDLTKEMYEGKENVSFELQRDFSQETDFSEASLLEKQQEVHSAGNIKKEKSNTIDGTVKDETSPVEECFFSQSSNSYQCHTITGEQPSGCTGLGKSISFDTKLVKHEIINSEERPFKCEELVEPFRCDSQLIQHQENNTEEKPYQCSECGKAFSINEKLIWHQRLHSGEKPFKCVECGKSFSYSSHYITHQTIHSGEKPYQCKMCGKAFSVNGSLSRHQRIHTGEKPYQCKECGNGFSCSSAYITHQRVHTGEKPYECNDCGKAFNVNAKLIQHQRIHTGEKPYECNECGKGFRCSSQLRQHQSIHTGEKPYQCKECGKGFNNNTKLIQHQRIHTGEKPYECTECGKAFSVKGKLIQHQRIHTGEKPYECNECGKAFRCNSQFRQHLRIHTGEKPYECNECGKAFSVNGKLMRHQRIHTGEKPFECNECGRCFTSKRNLLDHHRIHTGEKPYQCKECGKAFSINAKLTRHQRIHTGEKPFKCMECEKAFSCSSNYIVHQRIHTGEKPFQCKECGKAFHVNAHLIRHQRSHTGEKPFRCVECGKGFSFSSDYIIHQTVHTWKKPYMCSVCGKAFRFSFQLSQHQSVHSEGKS

SEQ ID NO: 99387 - protein, 83 aa, Homo sapiens
  Payload ID: 19818
  Gene Name: zinc finger protein 23
  ENSP ID: ENSP00000351535
MLENYGNVASLGFPLLKPAVISQLEGGSELGGSSPLAAGTGLQGLQTDGVSLCRPNWSAVARTWLTATSVSRVRAILLPHPPE

SEQ ID NO: 99388 - protein, 643 aa, Homo sapiens; identical to SEQ ID NO: 99386
  Payload ID: 19818
  Gene Name: zinc finger protein 23
  Uniprot ID: P17027
  ENSP ID: ENSP00000377171

SEQ ID NO: 99389 - protein, 643 aa, Homo sapiens; identical to SEQ ID NO: 99386
  Payload ID: 19818
  Gene Name: zinc finger protein 23
  Uniprot ID: P17027
  ENSP ID: ENSP00000387673

SEQ ID NO: 99390 - protein, 103 aa, Homo sapiens
  Payload ID: 19818
  Gene Name: zinc finger protein 23
  ENSP ID: ENSP00000454326
MLENYGNVASLGFPLLKPAVISQLEGGIDIQTDNDLTKEMYEGKENVSFELQRDFSQETDFSEASLLEKQQEVHSAGNIKKEKSNTIDGTVKDETSPVEECFF

SEQ ID NO: 99391 - protein, 27 aa, Homo sapiens
  Payload ID: 19818
  Gene Name: zinc finger protein 23
  ENSP ID: ENSP00000455280
MLENYGNVASLGFPLLKPAVISQLEGG

SEQ ID NO: 99392 - protein, 83 aa, Homo sapiens; identical to SEQ ID NO: 99387
  Payload ID: 19818
  Gene Name: zinc finger protein 23
  ENSP ID: ENSP00000456683

SEQ ID NO: 99393 - protein, 585 aa, Homo sapiens
  Payload ID: 19818
  Gene Name: zinc finger protein 23
  Uniprot ID: P17027
  ENSP ID: ENSP00000462429
MYEGKENVSFELQRDFSQETDFSEASLLEKQQEVHSAGNIKKEKSNTIDGTVKDETSPVEECFFSQSSNSYQCHTITGEQPSGCTGLGKSISFDTKLVKHEIINSEERPFKCEELVEPFRCDSQLIQHQENNTEEKPYQCSECGKAFSINEKLIWHQRLHSGEKPFKCVECGKSFSYSSHYITHQTIHSGEKPYQCKMCGKAFSVNGSLSRHQRIHTGEKPYQCKECGNGFSCSSAYITHQRVHTGEKPYECNDCGKAFNVNAKLIQHQRIHTGEKPYECNECGKGFRCSSQLRQHQSIHTGEKPYQCKECGKGFNNNTKLIQHQRIHTGEKPYECTECGKAFSVKGKLIQHQRIHTGEKPYECNECGKAFRCNSQFRQHLRIHTGEKPYECNECGKAFSVNGKLMRHQRIHTGEKPFECNECGRCFTSKRNLLDHHRIHTGEKPYQCKECGKAFSINAKLTRHQRIHTGEKPFKCMECEKAFSCSSNYIVHQRIHTGEKPFQCKECGKAFHVNAHLIRHQRSHTGEKPFRCVECGKGFSFSSDYIIHQTVHTWKKPYMCSVCGKAFRFSFQLSQHQSVHSEGKS

SEQ ID NO: 99394 - protein, 474 aa, Homo sapiens
  Payload ID: 19819
  Gene Name: zinc finger protein 230
  Uniprot ID: Q9UIE0
  ENSP ID: ENSP00000409318
MTTFKEAVTFKDVAVFFTEEELGLLDPAQRKLYQDVMLENFTNLLSVGHQPFHPFHFLREEKFWMMETATQREGNSGGKTIAEAGPHEDCPCQQIWEQTASDLTQSQDSIINNSHFFEQGDVPSQVEAGLSIIHTGQKPSQNGKCKQSFSDVAIFDPPQQFHSGEKSHTCNECGKSFCYISALRIHQRVHLREKLSKCDMRGKEFSQSSCLQTRERVHTGEKPFKCEQCGKGFRCRAILQVHCKLHTGEKPYICEKCGRAFIHDFQLQKHQIIHTGEKPFKCEICGKSFCLRSSLNRHCMVHTAEKLYKSEECGKGFTDSLDLHKHQIIHTGQKPYNCKECGKSFRWSSYLLIHQRIHSGEKPYRCEECGKGYISKSGLNLHQRVHTGERPYNCKECGKSFSRASSILNHKKLHCRKKPFKCEDCGKRLVHRSFCKDQQGDHNGENSSKCEDCGKRYKRRLNLDIILSLFLNDM

SEQ ID NO: 99395 - protein, 54 aa, Homo sapiens
  Payload ID: 19819
  Gene Name: zinc finger protein 230
  ENSP ID: ENSP00000465324
MTTFKEAVTFKDVAVFFTEEELGLLDPAQRKLYQDVMLENFTNLLSVGEHRHPL

SEQ ID NO: 99396 - protein, 87 aa, Homo sapiens
  Payload ID: 19819
  Gene Name: zinc finger protein 230
  ENSP ID: ENSP00000465988
MTTFKEAVTFKDVAVFFTEEELGLLDPAQRKLYQDVMLENFTNLLSVGHQPFHPFHFLREEKFWMMETATQREGNSGKKQATVCPCT

SEQ ID NO: 99397 - protein, 73 aa, Homo sapiens
  Payload ID: 19819
  Gene Name: zinc finger protein 230
  ENSP ID: ENSP00000466541
MTTFKEAVTFKDVAVFFTEEELGLLDPAQRKLYQDVMLENFTNLLSVGHQPFHPFHFLREEKFWMMETATQRE

SEQ ID NO: 99398 - protein, 444 aa, Homo sapiens
  Payload ID: 19820
  Gene Name: zinc finger protein 232
  Uniprot ID: Q9UNY5
  ENSP ID: ENSP00000250076
MEPPGPVRGPLQDSSWYEPSAELVQTRMAVSLTAAETLALQGTQGQEKMMMMGPKEEEQSCEYETRLPGNHSTSQEIFRQRFRHLRYQETPGPREALSQLRVLCCEWLRPEKHTKEQILEFLVLEQFLTILPEELQSWVRGHHPKSGEEAVTVLEDLEKGLEPEPQVPGPAHGPAQEEPWEKKESLGAAQEALSIQLQPKETQPFPKSEQVYLHFLSVVTEDGPEPKDKGSLPQPPITEVESQVFSEKLATDTSTFEATSEGTLELQQRNPKAERLRWSPAQEESFRQMVVIHKEIPTGKKDHECSECGKTFIYNSHLVVHQRVHSGEKPYKCSDCGKTFKQSSNLGQHQRIHTGEKPFECNECGKAFRWGAHLVQHQRIHSGEKPYECNECGKAFSQSSYLSQHRRIHSGEKPFICKECGKAYGWCSELIRHRRVHARKEPSH

SEQ ID NO: 99399 - protein, 50 aa, Homo sapiens
  Payload ID: 19820
  Gene Name: zinc finger protein 232
  ENSP ID: ENSP00000458387
MEPPGPVSCKIESNICPQVASLTLAMETNSRASPDKTRNRSSTHPETKHI

SEQ ID NO: 99400 - protein, 50 aa, Homo sapiens; identical to SEQ ID NO: 99399
  Payload ID: 19820
  Gene Name: zinc finger protein 232
  ENSP ID: ENSP00000458589

SEQ ID NO: 99401 - protein, 50 aa, Homo sapiens; identical to SEQ ID NO: 99399
  Payload ID: 19820
  Gene Name: zinc finger protein 232
  ENSP ID: ENSP00000461267

SEQ ID NO: 99402 - protein, 435 aa, Homo sapiens
  Payload ID: 19820
  Gene Name: zinc finger protein 232
  ENSP ID: ENSP00000461305
MEPPGPVRGPLQDSSWYEPSAELVQTRMAVSLTAAETLALQGTQGQEKMMMMGPKEEEQSCEYETRLPGNHSTSQEIFRQRFRHLRYQETPGPREALSQLRVLCCEWLRPEKHTKEQILEFLVLEQFLTILPEELQSWVRGHHPKSGEEAVTVLEDLEKGLEPEPQVPGPAHGPAQEEPWEKKESLGAAQEALSIQLQPKETQPFPKSVVTEDGPEPKDKGSLPQPPITEVESQVFSEKLATDTSTFEATSEGTLELQQRNPKAERLRWSPAQEESFRQMVVIHKEIPTGKKDHECSECGKTFIYNSHLVVHQRVHSGEKPYKCSDCGKTFKQSSNLGQHQRIHTGEKPFECNECGKAFRWGAHLVQHQRIHSGEKPYECNECGKAFSQSSYLSQHRRIHSGEKPFICKECGKAYGWCSELIRHRRVHARKEPSH

SEQ ID NO: 99403 - protein, 670 aa, Homo sapiens
  Payload ID: 19821
  Gene Name: zinc finger protein 233
  Uniprot ID: A6NK53
  ENSP ID: ENSP00000375820
MTKFQEMVTFKDVAVVFTREELGLLDLAQRKLYQDVMLENFRNLLSVGYQPFKLDVILQLGKEDKLRMMETEIQGDGCSGHKNQNEIDTLQEVRLRFLSYEDLICWQIWEQFTSKLTSNQDLIINLQGKRSKLLKQGDSPCQVWTGESSQVSEDENYVIKLQGESSNSIKNQELPLRTTWDFWRKMYLREPQNYQSRCQQIDVKNKLCKCDHCVRQRIAHQHDDHGVHKREKAFSHNNCGKDCVKESSQHSIIQSGEQTSDENGKGLSVGSNLELHQQLHLRDKPHVNVEYGKGIGYSSGLPRHQCFHIGEKCYRNGDSGEGFSQGSHLQPHQRVSTGENLYRCQVYARSSNQNSCLPSHELTHPGEKLCTCGRCGKGFHHSLDFDIHCVDSAGERACKCDVYDKGFSQTSQLQAHQRGHSRDKTYKWEVSDRIFNRNSGLHQRVHTGEKPYKCEVCDKGFSKASNLQAHQRIHTGEKPYKCDVCDKNFSRNSHLQAHQRVHTGEKPYKCDTCGKDFSQISHLQAHQRVHKGEKPYKCETCGKGFSQSSHLQDHQQVHTGENPYKCDVCGKGFSWSSHLQAHQRVHTGEKPYKCEECRKGFIWNSYLHVHQRIHTGEKPYKCGMCGKSFSQTSHLQAHQRVHTGEKPYKCFVCGKGFSKSSLSSDSSESP

SEQ ID NO: 99404 - protein, 116 aa, Homo sapiens
  Payload ID: 19821
  Gene Name: zinc finger protein 233
  ENSP ID: ENSP00000465136
MGLQVGNGSWSHVWFEGLPGAQVPSPSPPSTRSAVFWQYNLVLPSQDPALPQKEQEKMTKFQEMVTFKDVAVVFTREELGLLDLAQRKLYQDVMLENFRNLLSVGYQPFKLDVILQ

SEQ ID NO: 99405 - protein, 83 aa, Homo sapiens
  Payload ID: 19821
  Gene Name: zinc finger protein 233
  ENSP ID: ENSP00000465307
MTKFQEMVTFKDVAVVFTREELGLLDLAQRKLYQDVMLENFRNLLSVGYQPFKLDVILQLGKEDKLRMMETEIQGDGCSGLTL

SEQ ID NO: 99406 - protein, 162 aa, Homo sapiens
  Payload ID: 19821
  Gene Name: zinc finger protein 233
  ENSP ID: ENSP00000466781
MTKFQEMVTFKDVAVVFTREELGLLDLAQRKLYQDVMLENFRNLLSVGYQPFKLDVILQLGKEDKLRMMETEIQGDGCSGHKNQNEIDTLQEVRLRFLSYEDLICWQIWEQFTSKLTSNQDLIINLQGKRSKLLKQGDSPCQVWTGESSQVSEDENYVIKLQ

SEQ ID NO: 99407 - protein, 140 aa, Homo sapiens
  Payload ID: 19821
  Gene Name: zinc finger protein 233
  ENSP ID: ENSP00000468154
MTKFQEMVTFKDVAVVFTREELGLLDLAQRKLYQDVMLENFRNLLSVGYQPFKLDVILQLGKEDKLRMMETEIQGDGCSGENHGALSLCGVQPSPLLLTTSSATSLAQDPRIHRPGLLQQLAHDLPPSTSLQSILHIARS

SEQ ID NO: 99408 - protein, 700 aa, Homo sapiens
  Payload ID: 19822
  Gene Name: zinc finger protein 234
  Uniprot ID: Q14588
  ENSP ID: ENSP00000400878
MTTFKEGLTFKDVAVVFTEEELGLLDPVQRNLYQDVMLENFRNLLSVGHHPFKHDVFLLEKEKKLDIMKTATQRKGKSADKIQSEVETVPEAGRHEELYWGQIWKQIASDLIKYEDSMISISRFPRQGDLSCQVRAGLYTTHTGQKFYQCDEYKKSFTDVFNFDLHQQLHSGEKSHTCDECGKSFCYISALHIHQRVHMGEKCYKCDVCGKEFSQSSHLQTHQRVHTVEKPFKCVECGKGFSRRSTLTVHCKLHSGEKPYNCEECGRAFIHASHLQEHQRIHTGEKPFKCDTCGKNFRRRSALNNHCMVHTGEKPYKCEDCGKCFTCSSNLRIHQRVHTGEKPYKCEECGKCFIQPSQFQAHRRIHTGEKPYVCKVCGKGFIYSSSFQAHQGVHTGEKPYKCNECGKSFRMKIHYQVHLVVHTGEKPYKCEVCGKAFRQSSYLKIHLKAHSVQKPFKCEECGQGFNQSSRLQIHQLIHTGEKPYKCEECGKGFSRRADLKIHCRIHTGEKPYNCEECGKVFSQASHLLTHQRVHSGEKPFKCEECGKSFSRSAHLQAHQKVHTGEKPYKCGECGKGFKWSLNLDMHQRVHTGEKPYTCGECGKHFSQASSLQLHQSVHTGEKPYKCDVCGKVFSRSSQLQYHRRVHTGEKPYKCEICGKRFSWRSNLVSHHKIHAAGTFYENDENSKNIRELSEGGSSTR

SEQ ID NO: 99409 - protein, 700 aa, Homo sapiens; identical to SEQ ID NO: 99408
  Payload ID: 19822
  Gene Name: zinc finger protein 234
  Uniprot ID: Q14588
  ENSP ID: ENSP00000465011

SEQ ID NO: 99410 - protein, 53 aa, Homo sapiens
  Payload ID: 19822
  Gene Name: zinc finger protein 234
  ENSP ID: ENSP00000466129
MTTFKEGLTFKDVAVVFTEEELGLLDPVQRNLYQDVMLENFRNLLSVGPIRLK

SEQ ID NO: 99411 - protein, 738 aa, Homo sapiens
  Payload ID: 19823
  Gene Name: zinc finger protein 235
  Uniprot ID: Q14590
  ENSP ID: ENSP00000291182
MTKFQEAVTFKDVAVAFTEEELGLLDSAQRKLYRDVMLENFRNLVSVGHQSFKPDMISQLEREEKLWMKELQTQRGKHSGDRNQNEMATLHKAGLRCFSLGELSCWQIKRHIASKLARSQDSMINIEGKSSQFPKHHDSPCQVGAGESIQASVDDNCLVNHIGDHSSIIENQEFPTGKVPNSWSKIYLNETQNYQRSCKQTQMKNKLCIFAPYVDIFSCISHHHDDNIVHKRDKVHSNSDCGKDTLKVSPLTQRSIHTGQKTYQGNECEEAFNDSSSLELHKQVHLGKKSPACSTHEKDTSYSSGIPVQQSVRTGKKRYWCHECGKGFSQSSNLQTHQRVHTGEKPYTCHECGKSFNQSSHLYAHLPIHTGEKPYRCDSCGKGFSRSTDLNIHCRVHTGEKPYKCEVCGKGFTQRSHLQAHERIHTGEKPYKCGDCGKRFSCSSNLHTHQRVHTEEKPYKCDECGKCFSLSFNLHSHQRVHTGEKPYKCEECGKGFSSASSFQSHQRVHTGEKPFRCNVCGKGFSQSSYFQAHQRVHTGEKPYKCEVCGKRFNWSLNLHNHQRVHTGEKPYKCEECGKGFSQASNLQAHQSVHTGEKPFKCDACQKRFSQASHLQAHQRVHTGEKPYKCDTCGKAFSQRSNLQVHQIIHTGEKPFKCEECGKEFSWSAGLSAHQRVHTGEKPYTCQQCGKGFSQASHFHTHQRVHTGERPYICDVCCKGFSQRSHLIYHQRVHTGGNL

SEQ ID NO: 99412 - protein, 81 aa, Homo sapiens
  Payload ID: 19823
  Gene Name: zinc finger protein 235
  ENSP ID: ENSP00000465641
MTKFQEAVTFKDVAVAFTEEELGLLDSAQRKLYRDVMLENFRNLVSVGHQSFKPDMISQLEREEKLWMKELQTQRGKHSET

SEQ ID NO: 99413 - protein, 295 aa, Homo sapiens
  Payload ID: 19823
  Gene Name: zinc finger protein 235
  ENSP ID: ENSP00000465880
MNPSLAWGREAAASAGGRGWEAAGVCVPSAEPLAWEAGSRRPSRLRVCCPSRPHAPTSQSCLLLAVKYWVHFPGTLPFPRRRRGKMTKFQEAVTFKDVAVAFTEEELGLLDSAQRKLYRDVMLENFRNLVSVGHQSFKPDMISQLEREEKLWMKELQTQRGKHSGDRNQNEMATLHKAGLRCFSLGELSCWQIKRHIASKLARSQDSMINIEGKSSQFPKHHDSPCQVGAGESIQASVDDNCLVNHIGDHSSIIENQEFPTGKVPNSWSKIYLNETQNYQRSCKQTQMKNKLCIF

SEQ ID NO: 99414 - protein, 87 aa, Homo sapiens
  Payload ID: 19823
  Gene Name: zinc finger protein 235
  ENSP ID: ENSP00000468609
MTKFQEAVTFKDVAVAFTEEELGLLDSAQRKLYRDVMLENFRNLVSVGHQSFKPDMISQLEREEKLWMKELQTQRGKHSGFLCCVFS

SEQ ID NO: 99415 - protein, 83 aa, Homo sapiens
  Payload ID: 19823
  Gene Name: zinc finger protein 235
  ENSP ID: ENSP00000468695
MTKFQEAVTFKDVAVAFTEEELGLLDSAQRKLYRDVMLENFRNLVSVGHQSFKPDMISQLEREEKLWMKELQTQRGKHSVWTL

SEQ ID NO: 99416 - protein, 588 aa, Homo sapiens
  Payload ID: 19823
  Gene Name: zinc finger protein 235
  ENSP ID: ENSP00000484268
SGDRNQNEMATLHKAGLRCFSLGELSCWQIKRHIASKLARSQDSMINIEGKSSQFPKHHDSPCQVGAGESIQASVDDNCLVNHIGDHSSIIENQEFPTGKVPNSWSKIYLNETQNYQRSCKQTQMKNKLCIFAPYVDIFSCISHHHDDNIVHKRDKVHSNSDCGKDTLKVSPLTQRSIHTGQKTYQGNECEEAFNDSSSLELHKQVHLGKKSPACSTHEKDTSYSSGIPVQQSVRTGKKRYWCHECGKGFSQSSNLQTHQRVHTGEKPYTCHECGKSFNQSSHLYAHLPIHTGEKPYRCDSCGKGFSRSTDLNIHCRVHTGEKPYKCEVCGKGFTQRSHLQAHERIHTGEKPYKSQIFIPIRDFNLHSHQRVHTGEKPYKCEECGKGFSSASSFQSHQRVHTGEKPFRCNVCGKGFSQSSYFQAHQRVHTGEKPYKCEVCGKRFNWSLNLHNHQRVHTGEKPYKCEECGKGFSQASNLQAHQSVHTGEKPFKCDACQKRFSQASHLQAHQRVHTGEKPYKCDTCGKAFSQRSNLQVHQIIHTGEKPFKCEECGKEFSWSAGLSAHQRVHTGEKPYTCQQCGKGFSQAS

SEQ ID NO: 99417 - protein, 1845 aa, Homo sapiens
  Payload ID: 19824
  Gene Name: zinc finger protein 236
  Uniprot ID: Q9UL36
  ENSP ID: ENSP00000253159
MGLCGLLERCWLHHDPDGVLTLNAENTNYAYQVPNFHKCEICLLSFPKESQFQRHMRDHERNDKPHRCDQCPQTFNVEFNLTLHKCTHSGEDPTCPVCNKKFSRVASLKAHIMLHEKEENLICSECGDEFTLQSQLAVHMEEHRQELAGTRQHACKACKKEFETSSELKEHMKTHYKIRVSSTRSYNRNIDRSGFTYSCPHCGKTFQKPSQLTRHIRIHTGERPFKCSECGKAFNQKGALQTHMIKHTGEKPHACAFCPAAFSQKGNLQSHVQRVHSEVKNGPTYNCTECSCVFKSLGSLNTHISKMHMGGPQNSTSSTETAHVLTATLFQTLPLQQTEAQATSASSQPSSQAVSDVIQQLLELSEPAPVESGQSPQPGQQLSITVGINQDILQQALENSGLSSIPAAAHPNDSCHAKTSAPHAQNPDVSSVSNEQTDPTDAEQEKEQESPEKLDKKEKKMIKKKSPFLPGSIREENGVRWHVCPYCAKEFRKPSDLVRHIRIHTHEKPFKCPQCFRAFAVKSTLTAHIKTHTGIKAFKCQYCMKSFSTSGSLKVHIRLHTGVRPFACPHCDKKFRTSGHRKTHIASHFKHTELRKMRHQRKPAKVRVGKTNIPVPDIPLQEPILITDLGLIQPIPKNQFFQSYFNNNFVNEADRPYKCFYCHRAYKKSCHLKQHIRSHTGEKPFKCSQCGRGFVSAGVLKAHIRTHTGLKSFKCLICNGAFTTGGSLRRHMGIHNDLRPYMCPYCQKTFKTSLNCKKHMKTHRYELAQQLQQHQQAASIDDSTVDQQSMQASTQMQVEIESDELPQTAEVVAANPEAMLDLEPQHVVGTEEAGLGQQLADQPLEADEDGFVAPQDPLRGHVDQFEEQSPAQQSFEPAGLPQGFTVTDTYHQQPQFPPVQQLQDSSTLESQALSTSFHQQSLLQAPSSDGMNVTTRLIQESSQEELDLQAQGSQFLEDNEDQSRRSYRCDYCNKGFKKSSHLKQHVRSHTGEKPYKCKLCGRGFVSSGVLKSHEKTHTGVKAFSCSVCNASFTTNGSLTRHMATHMSMKPYKCPFCEEGFRTTVHCKKHMKRHQTVPSAVSATGETEGGDICMEEEEEHSDRNASRKSRPEVITFTEEETAQLAKIRPQESATVSEKVLVQSAAEKDRISELRDKQAELQDEPKHANCCTYCPKSFKKPSDLVRHVRIHTGEKPYKCDECGKSFTVKSTLDCHVKTHTGQKLFSCHVCSNAFSTKGSLKVHMRLHTGAKPFKCPHCELRFRTSGRRKTHMQFHYKPDPKKARKPMTRSSSEGLQPVNLLNSSSTDPNVFIMNNSVLTGQFDQNLLQPGLVGQAILPASVSAGGDLTVSLTDGSLATLEGIQLQLAANLVGPNVQISGIDAASINNITLQIDPSILQQTLQQGNLLAQQLTGEPGLAPQNSSLQTSDSTVPASVVIQPISGLSLQPTVTSANLTIGPLSEQDSVLTTNSSGTQDLTQVMTSQGLVSPSGGPHEITLTINNSSLSQVLAQAAGPTATSSSGSPQEITLTISELNTTSGSLPSTTPMSPSAISTQNLVMSSSGVGGDASVTLTLADTQGMLSGGLDTVTLNITSQGQQFPALLTDPSLSGQGGAGSPQVILVSHTPQSASAACEEIAYQVAGVSGNLAPGNQPEKEGRAHQCLECDRAFSSAAVLMHHSKEVHGRERIHGCPVCRKAFKRATHLKEHMQTHQAGPSLSSQKPRVFKCDTCEKAFAKPSQLERHSRIHTGERPFHCTLCEKAFNQKSALQVHMKKHTGERPYKCAYCVMGFTQKSNMKLHMKRAHSYAGALQESAGHPEQDGEELSRTLHLEEVVQEAAGEWQALTHVF

SEQ ID NO: 99418 - protein, 1847 aa, Homo sapiens
  Payload ID: 19824
  Gene Name: zinc finger protein 236
  ENSP ID: ENSP00000322361
MPRGRPPKPRESKARGDSDGVLTLNAENTNYAYQVPNFHKCEICLLSFPKESQFQRHMRDHERNDKPHRCDQCPQTFNVEFNLTLHKCTHSGEDPTCPVCNKKFSRVASLKAHIMLHEKEENLICSECGDEFTLQSQLAVHMEEHRQELAGTRQHACKACKKEFETSSELKEHMKTHYKIRVSSTRSYNRNIDRSGFTYSCPHCGKTFQKPSQLTRHIRIHTGERPFKCSECGKAFNQKGALQTHMIKHTGEKPHACAFCPAAFSQKGNLQSHVQRVHSEVKNGPTYNCTECSCVFKSLGSLNTHISKMHMGGPQNSTSSTETAHVLTATLFQTLPLQQTEAQATSASSQPSSQAVSDVIQQLLELSEPAPVESGQSPQPGQQLSITVGINQDILQQALENSGLSSIPAAAHPNDSCHAKTSAPHAQNPDVSSVSNEQTDPTDAEQEKEQESPEKLDKKEKKMIKKKSPFLPGSIREENGVRWHVCPYCAKEFRKPSDLVRHIRIHTHEKPFKCPQCFRAFAVKSTLTAHIKTHTGIKAFKCQYCMKSFSTSGSLKVHIRLHTGVRPFACPHCDKKFRTSGHRKTHIASHFKHTELRKMRHQRKPAKVRVGKTNIPVPDIPLQEPILITDLGLIQPIPKNQFFQSYFNNNFVNEADRPYKCFYCHRAYKKSCHLKQHIRSHTGEKPFKCSQCGRGFVSAGVLKAHIRTHTGLKSFKCLICNGAFTTGGSLRRHMGIHNDLRPYMCPYCQKTFKTSLNCKKHMKTHRYELAQQLQQHQQAASIDDSTVDQQSMQASTQMQVEIESDELPQTAEVVAANPEAMLDLEPQHVVGTEEAGLGQQLADQPLEADEDGFVAPQDPLRGHVDQFEEQSPAQQSFEPAGLPQGFTVTDTYHQQPQFPPVQQLQDSSTLESQALSTSFHQQSLLQAPSSDGMNVTTRLIQESSQEELDLQAQGSQFLEDNEDQSRRSYRCDYCNKGFKKSSHLKQHVRSHTGEKPYKCKLCGRGFVSSGVLKSHEKTHTGVKAFSCSVCNASFTTNGSLTRHMATHMSMKPYKCPFCEEGFRTTVHCKKHMKRHQTVPSAVSATGETEGGDICMEEEEEHSDRNASRKSRPEVITFTEEETAQLAKIRPQESATVSEKVLVQSAAEKDRISELRDKQAELQDEPKHANCCTYCPKSFKKPSDLVRHVRIHTGEKPYKCDECGKSFTVKSTLDCHVKTHTGQKLFSCHVCSNAFSTKGSLKVHMRLHTGAKPFKCPHCELRFRTSGRRKTHMQFHYKPDPKKARKPMTRSSSEGLQPVNLLNSSSTDPNVFIMNNSVLTGQFDQNLLQPGLVGQAILPASVSAGGDLTVSLTDGSLATLEGIQLQLAANLVGPNVQISGIDAASINNITLQIDPSILQQTLQQGNLLAQQLTGEPGLAPQNSSLQTSDSTVPASVVIQPISGLSLQPTVTSANLTIGPLSEQDSVLTTNSSGTQDLTQVMTSQGLVSPSGGPHEITLTINNSSLSQVLAQAAGPTATSSSGSPQEITLTISELNTTSGSLPSTTPMSPSAISTQNLVMSSSGVGGDASVTLTLADTQGMLSGGLDTVTLNITSQGQQFPALLTDPSLSGQGGAGSPQVILVSHTPQSASAACEEIAYQVAGVSGNLAPGNQPEKEGRAHQCLECDRAFSSAAVLMHHSKEVHGRERIHGCPVCRKAFKRATHLKEHMQTHQAGPSLSSQKPRVFKCDTCEKAFAKPSQLERHSRIHTGERPFHCTLCEKAFNQKSALQVHMKKHTGERPYKCAYCVMGFTQKSNMKLHMKRAHSYAGALQESAGHPEQDGEELSRTLHLEEVVQEAAGEWQALTHVF

SEQ ID NO: 99419 - protein, 1558 aa, Homo sapiens
  Payload ID: 19824
  Gene Name: zinc finger protein 236
  Uniprot ID: Q9UL36
  ENSP ID: ENSP00000444524
MGLCGLLERCWLHHDPDGVLTLNAENTNYAYQVPNFHKCEICLLSFPKESQFQRHMRDHERNDKPHRCDQCPQTFNVEFNLTLHKCTHSGEDPTCPVCNKKFSRVASLKAHIMLHEKEENLICSECGDEFTLQSQLAVHMEEHRQELAGTRQHACKACKKEFETSSELKEHMKTHYKIRVSSTRSYNRNIDRSGFTYSCPHCGKTFQKPSQLTRHIRIHTGERPFKCSECGKAFNQKGALQTHMIKHTGEKPHACAFCPAAFSQKGNLQSHVQRVHSEVKNGPTYNCTECSCVFKSLGSLNTHISKMHMGGPQNSTSSTETAHVLTATLFQTLPLQQTEAQATSASSQPSSQAVSDVIQQLLELSEPAPVESGQSPQPGQQLSITVGINQDILQQALENSGLSSIPAAAHPNDSCHAKTSAPHAQNPDVSSVSNEQTDPTDAEQEKEQESPEKLDKKEKKMIKKKSPFLPGSIREENGVRWHVCPYCAKEFRKPSDLVRHIRIHTHEKPFKCPQCFRAFAVKSTLTAHIKTHTGIKAFKCQYCMKSFSTSGSLKVHIRLHTGVRPFACPHCDKKFRTSGHRKTHIASHFKHTELRKMRHQRKPAKVRVGKTNIPVPDIPLQEPILITDLGLIQPIPKNQFFQSYFNNNFVNEADRPYKCFYCHRAYKKSCHLKQHIRSHTGEKPFKCSQCGRGFVSAGVLKAHIRTHTGLKSFKCLICNGAFTTGGSLRRHMGIHNDLRPYMCPYCQKTFKTSLNCKKHMKTHRYELAQQLQQHQQAASIDDSTVDQQSMQASTQMQVEIESDELPQTAEVVAANPEAMLDLEPQHVVGTEEAGLGQQLADQPLEADEDGFVAPQDPLRGHVDQFEEQSPAQQSFEPAGLPQGFTVTDTYHQQPQFPPVQQLQDSSTLESQALSTSFHQQSLLQAPSSDGMNVTTRLIQESSQEELDLQAQGSQFLEDNEDQSRRSYRCDYCNKGFKKSSHLKQHVRSHTGEKPYKCKLCGRGFVSSGVLKSHEKTHTGVKAFSCSVCNASFTTNGSLTRHMATHMSMKPYKCPFCEEGFRTTVHCKKHMKRHQTVPSAVSATGETEGGDICMEEEEEHSDRNASRKSRPEVITFTEEETAQLAKIRPQESATVSEKVLVQSAAEKDRISELRDKQAELQDEPKHANCCTYCPKSFKKPSDLVRHVRIHTGEKPYKCDECGKSFTVKSTLDCHVKTHTGQKLFSCHVCSNAFSTKGSLKVHMRLHTGAKPFKCPHCELRFRTSGRRKTHMQFHYKPDPKKARKPMTRSSSEGLQPVNLLNSSSTDPNVFIMNNSVLTGQFDQNLLQPGLVGQAILPASVSAGGDLTVSLTDGSLATLEGIQLQLAANLVGPNVQISGIDAASINNITLQIDPSILQQTLQQGNLLAQQLTGEPGLAPQNSSLQTSDSTVPASVVIQPISGLSLQPTVTSANLTIGPLSEQDSVLTTNSSGTQDLTQVMTSQGLVSPSGGPHEITLTINNSSLSQVLAQAAGPTATSSSGSPQEITLTISGSRSVQHSVGPQECGSVEALYLENSSDKT

SEQ ID NO: 99420 - protein, 460 aa, Homo sapiens
  Payload ID: 19824
  Gene Name: zinc finger protein 236
  ENSP ID: ENSP00000463787
MRITTGIYCLYLCNFIDGVLTLNAENTNYAYQVPNFHKCEICLLSFPKESQFQRHMRDHERNDKPHRCDQCPQTFNVEFNLTLHKCTHSGEDPTCPVCNKKFSRVASLKAHIMLHEKEENLICSECGDEFTLQSQLAVHMEEHRQELAGTRQHACKACKKEFETSSELKEHMKTHYKIRVSSTRSYNRNIDRSGFTYSCPHCGKTFQKPSQLTRHIRIHTGERPFKCSECGKAFNQKGALQTHMIKHTGEKPHACAFCPAAFSQKGNLQSHVQRVHSEVKNGPTYNCTECSCVFKSLGSLNTHISKMHMGGPQNSTSSTETAHVLTATLFQTLPLQQTEAQATSASSQPSSQAVSDVIQQLLELSEPAPVESGQSPQPGQQLSITVGINQDILQQALENSGLSSIPAAAHPNDSCHAKTSAPHAQNPDVSSVSNEQTDPTDAEQEKEQESPEKLDKKEKK

SEQ ID NO: 99421 - protein, 458 aa, Homo sapiens
  Payload ID: 19825
  Gene Name: zinc finger protein 239
  Uniprot ID: Q16600
  ENSP ID: ENSP00000307774
MASTITGSQDCIVNHRGEVDGEPELDISPCQQWGEASSPISRNRDSVMTLQSGCFENIESETYLPLKVSSQIDTQDSSVKFCKNEPQDHQESRRLFVMEESTERKVIKGESCSENLQVKLVSDGQELASPLLNGEATCQNGQLKESLDPIDCNCKDIHGWKSQVVSCSQQRAHTEEKPCDHNNCGKILNTSPDGHPYEKIHTAEKQYECSQCGKNFSQSSELLLHQRDHTEEKPYKCEQCGKGFTRSSSLLIHQAVHTDEKPYKCDKCGKGFTRSSSLLIHHAVHTGEKPYKCDKCGKGFSQSSKLHIHQRVHTGEKPYECEECGMSFSQRSNLHIHQRVHTGERPYKCGECGKGFSQSSNLHIHRCIHTGEKPYQCYECGKGFSQSSDLRIHLRVHTGEKPYHCGKCGKGFSQSSKLLIHQRVHTGEKPYECSKCGKGFSQSSNLHIHQRVHKKDPR

SEQ ID NO: 99422 - protein, 458 aa, Homo sapiens; identical to SEQ ID NO: 99421
  Payload ID: 19825
  Gene Name: zinc finger protein 239
  Uniprot ID: Q16600
  ENSP ID: ENSP00000363569

SEQ ID NO: 99423 - protein, 458 aa, Homo sapiens; identical to SEQ ID NO: 99421
  Payload ID: 19825
  Gene Name: zinc finger protein 239
  Uniprot ID: Q16600
  ENSP ID: ENSP00000398202

SEQ ID NO: 99424 - protein, 458 aa, Homo sapiens; identical to SEQ ID NO: 99421
  Payload ID: 19825
  Gene Name: zinc finger protein 239
  Uniprot ID: Q16600
  ENSP ID: ENSP00000443907

SEQ ID NO: 99425 - protein, 368 aa, Homo sapiens
  Payload ID: 19826
  Gene Name: zinc finger protein 24
  Uniprot ID: P17028
  ENSP ID: ENSP00000261332
MSAQSVEEDSILIIPTPDEEEKILRVKLEEDPDGEEGSSIPWNHLPDPEIFRQRFRQFGYQDSPGPREAVSQLRELCRLWLRPETHTKEQILELVVLEQFVAILPKELQTWVRDHHPENGEEAVTVLEDLESELDDPGQPVSLRRRKREVLVEDMVSQEEAQGLPSSELDAVENQLKWASWELHSLRHCDDDGRTENGALAPKQELPSALESHEVPGTLNMGVPQIFKYGETCFPKGRFERKRNPSRKKQHICDECGKHFSQGSALILHQRIHSGEKPYGCVECGKAFSRSSILVQHQRVHTGEKPYKCLECGKAFSQNSGLINHQRIHTGEKPYECVQCGKSYSQSSNLFRHQRRHNAEKLLNVVKV

SEQ ID NO: 99426 - protein, 368 aa, Homo sapiens; identical to SEQ ID NO: 99425
  Payload ID: 19826
  Gene Name: zinc finger protein 24
  Uniprot ID: P17028
  ENSP ID: ENSP00000382015

SEQ ID NO: 99427 - protein, 138 aa, Homo sapiens
  Payload ID: 19826
  Gene Name: zinc finger protein 24
  ENSP ID: ENSP00000467432
MSAQSVEEDSILIIPTPDEEEKILRVKLEEDPDGEEGSSIPWNHLPDPEIFRQRFRQFGYQDSPGPREAVSQLRELCRLWLRPETHTKEQILELVVLEQFVAILPKELQTWVRDHHPENGEEAVTVLEDLESELDDPG

SEQ ID NO: 99428 - protein, 102 aa, Homo sapiens
  Payload ID: 19826
  Gene Name: zinc finger protein 24
  ENSP ID: ENSP00000467608
MSAQSVEEDSILIIPTPDEEEKILRVKLEEDPDGEEGSSIPWNHLPDPEIFRQRFRQFGYQDSPGPREAVSQLRELCRLWLRPETHTKEQILELVVLEQFVA

SEQ ID NO: 99429 - protein, 193 aa, Homo sapiens
  Payload ID: 19826
  Gene Name: zinc finger protein 24
  Uniprot ID: P17028
  ENSP ID: ENSP00000467655
MSAQSVEEDSILIIPTPDEEEKILRVKLEEDPDGEEGSSIPWNHLPDPEIFRQRFRQFGYQDSPGPREAVSQLRELCRLWLRPETHTKEQILELVVLEQFVAILPKELQTWVRDHHPENGEEAVTVLEDLESELDDPGQPVSLRRRKREVLVEDMVSQEEAQGLPSSELDAVENQLKWASWELHSLRHCVIIP

SEQ ID NO: 99430 - protein, 96 aa, Homo sapiens
  Payload ID: 19826
  Gene Name: zinc finger protein 24
  ENSP ID: ENSP00000467924
MSAQSVEEDSILIIPTPDEEEKILRVKLEEDPDGEEGSSIPWNHLPDPEIFRQRFRQFGYQDSPGPREAVSQLRELCRLWLRPETHTKEQILELVV

SEQ ID NO: 99431 - protein, 579 aa, Homo sapiens
  Payload ID: 19827
  Gene Name: zinc finger protein 248
  Uniprot ID: Q8NDW4
  ENSP ID: ENSP00000349882
MNKSQEQVSFKDVCVDFTQEEWYLLDPAQKILYRDVILENYSNLVSVGYCITKPEVIFKIEQGEEPWILEKGFPSQCHPERKWKVDDVLESSQENEDDHFWELLFHNNKTVSVENGDRGSKTFNLGTDPVSLRNYPYKICDSCEMNLKNISGLIISKKNCSRKKPDEFNVCEKLLLDIRHEKIPIGEKSYKYDQKRNAINYHQDLSQPSFGQSFEYSKNGQGFHDEAAFFTNKRSQIGETVCKYNECGRTFIESLKLNISQRPHLEMEPYGCSICGKSFCMNLRFGHQRALTKDNPYEYNEYGEIFCDNSAFIIHQGAYTRKILREYKVSDKTWEKSALLKHQIVHMGGKSYDYNENGSNFSKKSHLTQLRRAHTGEKTFECGECGKTFWEKSNLTQHQRTHTGEKPYECTECGKAFCQKPHLTNHQRTHTGEKPYECKQCGKTFCVKSNLTEHQRTHTGEKPYECNACGKSFCHRSALTVHQRTHTGEKPFICNECGKSFCVKSNLIVHQRTHTGEKPYKCNECGKTFCEKSALTKHQRTHTGEKPYECNACGKTFSQRSVLTKHQRIHTRVKALSTS

SEQ ID NO: 99432 - protein, 119 aa, Homo sapiens
  Payload ID: 19827
  Gene Name: zinc finger protein 248
  Uniprot ID: Q8NDW4
  ENSP ID: ENSP00000363778
MNKSQEQVSFKDVCVDFTQEEWYLLDPAQKILYRDVILENYSNLVSVGYCITKPEVIFKIEQGEEPWILEKGFPSQCHPERKWKVDDVLESSQENEDDHFWELLFHNNKTWNLKLIKVE

SEQ ID NO: 99433 - protein, 579 aa, Homo sapiens; identical to SEQ ID NO: 99431
  Payload ID: 19827
  Gene Name: zinc finger protein 248
  Uniprot ID: Q8NDW4
  ENSP ID: ENSP00000379208

SEQ ID NO: 99434 - protein, 100 aa, Homo sapiens
  Payload ID: 19827
  Gene Name: zinc finger protein 248
  ENSP ID: ENSP00000379214
MNKSQEQVSFKDVCVDFTQEEWYLLDPAQKILYRDVILENYSNLVSVGYCITKPEVIFKIEQGEEPWILEKGFPSQCHPERKWKVDDVLESSQENEDDHF

SEQ ID NO: 99435 - protein, 69 aa, Homo sapiens
  Payload ID: 19827
  Gene Name: zinc finger protein 248
  ENSP ID: ENSP00000379215
MNKSQEQVSFKDVCVDFTQEEWYLLDPAQKILYRDVILENYSNLVSVGYCITKPEVIFKIEQGEEPWIL

SEQ ID NO: 99436 - protein, 111 aa, Homo sapiens
  Payload ID: 19827
  Gene Name: zinc finger protein 248
  ENSP ID: ENSP00000473904
MNKSQEQVSFKDVCVDFTQEEWYLLDPAQKILYRDVILENYSNLVSVGYCITKPEVIFKIEQGEEPWILEKGFPSQCHPERKWKVDDVLESSQENEDDHFWELLFHNNKTH

SEQ ID NO: 99437 - protein, 122 aa, Homo sapiens
  Payload ID: 19827
  Gene Name: zinc finger protein 248
  ENSP ID: ENSP00000477940
MNKSQEQVSFKDVCVDFTQEEWYLLDPAQKILYRDVILENYSNLVSVGYCITKPEVIFKIEQGEEPWILEKGFPSQCHPERKWKVDDVLESSQENEDDHFWELLFHNNKTLRFQLLGRKQFL

SEQ ID NO: 99438 - protein, 119 aa, Homo sapiens; identical to SEQ ID NO: 99432
  Payload ID: 19827
  Gene Name: zinc finger protein 248
  Uniprot ID: Q8NDW4
  ENSP ID: ENSP00000484191

SEQ ID NO: 99439 - protein, 456 aa, Homo sapiens
  Payload ID: 19828
  Gene Name: zinc finger protein 25
  Uniprot ID: P17030
  ENSP ID: ENSP00000302222
MNKFQGPVTLKDVIVEFTKEEWKLLTPAQRTLYKDVMLENYSHLVSVGYHVNKPNAVFKLKQGKEPWILEVEFPHRGFPEDLWSIHDLEARYQESQAGNSRNGELTKHQKTHTTEKACECKECGKFFCQKSALIVHQHTHSKGKSYDCDKCGKSFSKNEDLIRHQKIHTRDKTYECKECKKIFYHLSSLSRHLRTHAGEKPYECNQCEKSFYQKPHLTEHQKTHTGEKPFECTECGKFFYVKAYLMVHQKTHTGEKPYECKECGKAFSQKSHLTVHQRMHTGEKPYKCKECGKFFSRNSHLKTHQRSHTGEKPYECKECRKCFYQKSALTVHQRTHTGEKPFECNKCGKTFYYKSDLTKHQRKHTGEKPYECTECGKSFAVNSVLRLHQRTHTGEKPYACKECGKSFSQKSHFIIHQRKHTGEKPYECQECGETFIQKSQLTAHQKTHTKKRNAEK

SEQ ID NO: 99440 - protein, 560 aa, Homo sapiens
  Payload ID: 19829
  Gene Name: zinc finger protein 250
  Uniprot ID: P15622
  ENSP ID: ENSP00000292579
MAAARLLPVPAGPQPLSFQAKLTFEDVAVLLSQDEWDRLCPAQRGLYRNVMMETYGNVVSLGLPGSKPDIISQLERGEDPWVLDRKGAKKSQGLWSDYSDNLKYDHTTACTQQDSLSCPWECETKGESQNTDLSPKPLISEQTVILGKTPLGRIDQENNETKQSFCLSPNSVDHREVQVLSQSMPLTPHQAVPSGERPYMCVECGKCFGRSSHLLQHQRIHTGEKPYVCSVCGKAFSQSSVLSKHRRIHTGEKPYECNECGKAFRVSSDLAQHHKIHTGEKPHECLECRKAFTQLSHLIQHQRIHTGERPYVCPLCGKAFNHSTVLRSHQRVHTGEKPHRCNECGKTFSVKRTLLQHQRIHTGEKPYTCSECGKAFSDRSVLIQHHNVHTGEKPYECSECGKTFSHRSTLMNHERIHTEEKPYACYECGKAFVQHSHLIQHQRVHTGEKPYVCGECGHAFSARRSLIQHERIHTGEKPFQCTECGKAFSLKATLIVHLRTHTGEKPYECNSCGKAFSQYSVLIQHQRIHTGEKPYECGECGRAFNQHGHLIQHQKVHRKL

SEQ ID NO: 99441 - protein, 555 aa, Homo sapiens
  Payload ID: 19829
  Gene Name: zinc finger protein 250
  Uniprot ID: P15622
  ENSP ID: ENSP00000393442
MAAARLLPVPAGPQAKLTFEDVAVLLSQDEWDRLCPAQRGLYRNVMMETYGNVVSLGLPGSKPDIISQLERGEDPWVLDRKGAKKSQGLWSDYSDNLKYDHTTACTQQDSLSCPWECETKGESQNTDLSPKPLISEQTVILGKTPLGRIDQENNETKQSFCLSPNSVDHREVQVLSQSMPLTPHQAVPSGERPYMCVECGKCFGRSSHLLQHQRIHTGEKPYVCSVCGKAFSQSSVLSKHRRIHTGEKPYECNECGKAFRVSSDLAQHHKIHTGEKPHECLECRKAFTQLSHLIQHQRIHTGERPYVCPLCGKAFNHSTVLRSHQRVHTGEKPHRCNECGKTFSVKRTLLQHQRIHTGEKPYTCSECGKAFSDRSVLIQHHNVHTGEKPYECSECGKTFSHRSTLMNHERIHTEEKPYACYECGKAFVQHSHLIQHQRVHTGEKPYVCGECGHAFSARRSLIQHERIHTGEKPFQCTECGKAFSLKATLIVHLRTHTGEKPYECNSCGKAFSQYSVLIQHQRIHTGEKPYECGECGRAFNQHGHLIQHQKVHRKL

SEQ ID NO: 99442 - protein, 101 aa, Homo sapiens
  Payload ID: 19829
  Gene Name: zinc finger protein 250
  ENSP ID: ENSP00000431551
MAAARLLPVPAGPQAKLTFEDVAVLLSQDEWDRLCPAQRGLYRNVMMETYGNVVSLGLPGSKPDIISQLERGEDPWVLDRKGAKKSQGLWSDYSDPVPQKP

SEQ ID NO: 99443 - protein, 141 aa, Homo sapiens
  Payload ID: 19829
  Gene Name: zinc finger protein 250
  ENSP ID: ENSP00000432450
MAAARLLPVPAGPQAKLTFEDVAVLLSQDEWDRLCPAQRGLYRNVMMETYGNVVSLGLPGSKPDIISQLERGEDPWVLDRKGAKKSQGLWSDYSDNLKYDHTTACTQQDSLSCPWECETKGESQNTDLSPKPLISEQTVIL

SEQ ID NO: 99444 - protein, 122 aa, Homo sapiens
  Payload ID: 19829
  Gene Name: zinc finger protein 250
  ENSP ID: ENSP00000432611
MAAARLLPVPAGPQAKLTFEDVAVLLSQDEWDRLCPAQRGLYRNVMMETYGNVVSLGLPGSKPDIISQLERGEDPWVLDRKGAKKSQGLWSDYSDNLKYDHTTACTQQDSLSCPWDPVPQKP

SEQ ID NO: 99445 - protein, 171 aa, Homo sapiens
  Payload ID: 19829
  Gene Name: zinc finger protein 250
  ENSP ID: ENSP00000432702
MAAARLLPVPAGPQAKLTFEDVAVLLSQDEWDRLCPAQRGLYRNVMMETYGNVVSLGLPGSKPDIISQLERGEDPWVLDRKGAKKSQGLWSDYSECETKGESQNTDLSPKPLISEQTVILGKTPLGRIDQENNETKQSFCLSPNSVDHREVQVLSQSMPLTPHQAVPSGER

SEQ ID NO: 99446 - protein, 176 aa, Homo sapiens
  Payload ID: 19829
  Gene Name: zinc finger protein 250
  ENSP ID: ENSP00000433387
MAAARLLPVPAGPQAKLTFEDVAVLLSQDEWDRLCPAQRGLYRNVMMETYGNVVSLGLPGSKPDIISQLERGEDPWVLDRKGAKKSQGLWSDYSDNLKYDHTTACTQQDSLSCPWECETKGESQNTDLSPKPLISEQTVILGKTPLGRIDQENNETKQSFCLSPNSVDHREVQVLS

SEQ ID NO: 99447 - protein, 45 aa, Homo sapiens
  Payload ID: 19829
  Gene Name: zinc finger protein 250
  ENSP ID: ENSP00000433725
MAAARLLPVPAGPQAKLTFEDVAVLLSQDEWDRLCPAQRGLYRNV

SEQ ID NO: 99448 - protein, 127 aa, Homo sapiens
  Payload ID: 19829
  Gene Name: zinc finger protein 250
  ENSP ID: ENSP00000433920
MAAARLLPVPAGPQPLSFQAKLTFEDVAVLLSQDEWDRLCPAQRGLYRNVMMETYGNVVSLGLPGSKPDIISQLERGEDPWVLDRKGAKKSQGLWSDYSDNLKYDHTTACTQQDSLSCPWDPVPQKP

SEQ ID NO: 99449 - protein, 671 aa, Homo sapiens
  Payload ID: 19830
  Gene Name: zinc finger protein 251
  Uniprot ID: Q9BRH9
  ENSP ID: ENSP00000292562
MAATFQLPGHQEMPLTFQDVAVYFSQAEGRQLGPQQRALYRDVMLENYGNVASLGFPVPKPELISQLEQGKELWVLNLLGAEEPDILKSCQKDSEVGTKKELSILNQKFSEEVKTPEFVSRRLLRDNAQAAEFREAWGREGKLKERVGNSAGQSLNKPNIHKRVLTEATVGRERSLGERTQECSAFDRNLNLDQNVVRLQRNKTGERVFKCDICSKTFKYNSDLSRHQRSHTGEKPYECGRCGRAFTHSSNLVLHHHIHTGNKPFKCDECGKTFGLNSHLRLHRRIHTGEKPFGCGECGKAFSRSSTLIQHRIIHTGEKPYKCNECGRGFSQSPQLTQHQRIHTGEKPHECSHCGKAFSRSSSLIQHERIHTGEKPHKCNQCGKAFSQSSSLFLHHRVHTGEKPYVCNECGRAFGFNSHLTEHVRIHTGEKPYVCNECGKAFRRSSTLVQHRRVHTGEKPYQCVECGKAFSQSSQLTLHQRVHTGEKPYDCGDCGKAFSRRSTLIQHQKVHSGETRKCRKHGPAFVHGSSLTADGQIPTGEKHGRAFNHGANLILRWTVHTGEKSFGCNEYGKAFSPTSRPTEDQIMHAGEKPYKCQECGNAFSGKSTLIQHQVTHTGQKPCHCSVYGKAFSQSSQLTPPQQTRVGEKPALNDGSKRYFIHIKKIFQERHF

SEQ ID NO: 99450 - protein, 147 aa, Homo sapiens
  Payload ID: 19830
  Gene Name: zinc finger protein 251
  ENSP ID: ENSP00000431809
  MOD_RES (1)..(1): Any amino acid
XRFLGGFPGSSKQVSSGRLQARAVSCLLLETTAAHAHRMAATFQLPGHQEMPLTFQDVAVYFSQAEGRQLGPQQRALYRDVMLENYGNVASLGFPVPKPELISQLEQGKELWVLNLLGAEEPDILKSCQKGENGWDANPGSSLPILP

SEQ ID NO: 99451 - protein, 671 aa, Homo sapiens; identical to SEQ ID NO: 99449
  Payload ID: 19830
  Gene Name: zinc finger protein 251
  Uniprot ID: Q9BRH9
  ENSP ID: ENSP00000477765

SEQ ID NO: 99452 - protein, 147 aa, Homo sapiens; identical to SEQ ID NO: 99450
  Payload ID: 19830
  Gene Name: zinc finger protein 251
  ENSP ID: ENSP00000488718
  MOD_RES (1)..(1): Any amino acid

SEQ ID NO: 99453 - protein, 423 aa, Homo sapiens
  Payload ID: 19831
  Gene Name: zinc finger protein 253
  Uniprot ID: O75346
  ENSP ID: ENSP00000347868
MSSHFAQDLWPENIQNSFQIGMLRRYEECRHDNLQLKKGCKSVGEHKVHKGGYNGLNQCLTTTQKEIFQCDKYGKVFHKFSNSNTYKTRHTGINLFKCIICGKAFKRSSTLTTHKKIHTGEKPYRCEECGKAFNQSANLTTHKRIHTGEKPYRCEECGKAFKQSSNLTTHKKIHTGEKPYKCEECGKAFNRSTDLTTHKIVHTGEKPYKCEECGKAFKHPSHVTTHKKIHTRGKPYNCEECGKSFKHCSNLTIHKRIHTGEKPYKCEECGKAFHLSSHLTTHKILHTGEKPYRCRECGKAFNHSTTLFSHEKIHTGEKPYKCDECGKTFTWPSILSKHKRTHTGEKPYKCEECGKSFTASSTLTTHKRIHTGEKPYKCEECGKAFNWSSDLNKHKKIHIERKPYIVKNVTDLLNVPPLLISIR

SEQ ID NO: 99454 - protein, 214 aa, Homo sapiens
  Payload ID: 19831
  Gene Name: zinc finger protein 253
  ENSP ID: ENSP00000467235
MERHEMIAKPPVMSSHFAQDLWPENIQNSFQIGMLRRYEECRHDNLQLKKGCKSVGEHKVHKGGYNGLNQCLTTTQKEIFQCDKYGKVFHKFSNSNTYKTRHTGINLFKCIICGKAFKRSSTLTTHKKIHTGEKPYRCEECGKAFNQSANLTTHKRIHTGEKPYRCEECGKAFKQSSNLTTHKKIHTGEKPYKCEECGKAFNRSTDLTTHKIVH

SEQ ID NO: 99455 - protein, 499 aa, Homo sapiens
  Payload ID: 19831
  Gene Name: zinc finger protein 253
  Uniprot ID: O75346
  ENSP ID: ENSP00000468720
MGPLQFRDVAIEFSLEEWHCLDTAQRNLYRDVMLENYRNLVFLGIVVSKPDLVTCLEQGKKPLTMERHEMIAKPPVMSSHFAQDLWPENIQNSFQIGMLRRYEECRHDNLQLKKGCKSVGEHKVHKGGYNGLNQCLTTTQKEIFQCDKYGKVFHKFSNSNTYKTRHTGINLFKCIICGKAFKRSSTLTTHKKIHTGEKPYRCEECGKAFNQSANLTTHKRIHTGEKPYRCEECGKAFKQSSNLTTHKKIHTGEKPYKCEECGKAFNRSTDLTTHKIVHTGEKPYKCEECGKAFKHPSHVTTHKKIHTRGKPYNCEECGKSFKHCSNLTIHKRIHTGEKPYKCEECGKAFHLSSHLTTHKILHTGEKPYRCRECGKAFNHSTTLFSHEKIHTGEKPYKCDECGKTFTWPSILSKHKRTHTGEKPYKCEECGKSFTASSTLTTHKRIHTGEKPYKCEECGKAFNWSSDLNKHKKIHIERKPYIVKNVTDLLNVPPLLISIR

SEQ ID NO: 99456 - protein, 91 aa, Homo sapiens
  Payload ID: 19832
  Gene Name: zinc finger protein 254
  ENSP ID: ENSP00000341573
MPGPPRSLEMGLLTFRDVAIEFSLEEWQHLDIAQQNLYRNVMLENYRNLAFLGIAVSKPDLITCLEQGKEPWNMKRHEMVDEPPGLDFSLL

SEQ ID NO: 99457 - protein, 659 aa, Homo sapiens
  Payload ID: 19832
  Gene Name: zinc finger protein 254
  Uniprot ID: O75437
  ENSP ID: ENSP00000349494
MPGPPRSLEMGLLTFRDVAIEFSLEEWQHLDIAQQNLYRNVMLENYRNLAFLGIAVSKPDLITCLEQGKEPWNMKRHEMVDEPPGMCPHFAQDLWPEQGMEDSFQKAILRRYGKYGHENLQLRKGCKSVDEYKVNKEGYNGLNQCFTTAQSKVFQCDKYLKVFYKFLNSNRPKIRHTEKKSFKCKKRVKLFCMLSHKTQHKSIYHREKSYKCKECGKTFNWSSTLTNHRKIYTEEKPYKCEEYNKSPKQLSTLTTHEIIHAGEKLYKCEECGEAFNRSSNLTTHKIIHTGEKPYKCEECGKAFIWSSTLTEHKKIHTRKKPYKCEECGKAFIWSSTLTRHKRMHTGEKPYKCEECGKAFSQSSTLTTHKIIHTGEKRYKCLECGKAFKQLSTLTTHKIIHVGEKLYKCEECGKGFNRSSNLTTHKIIHTGEKPYKCEECGKAFIWSSTLTKHKRIHTREKPYKCEECGKAFIWSSTLTRHKRMHTGEKPYKCEECGKSFSQSSTLTTHKIIHTGEKPYKCEECGKAFNWSSTLTKHKIIHTEEKPYKCEKCGKAFKQSSILTNHKRIHTGEKPYKCEECGKSFNRSSTFTKHKVIHTGVKPYKCEECGKAFFWSSTLTKHKRIHTGEQPYKWEKFGKAFNRSSHLTTDKITHWREILQV

SEQ ID NO: 99458 - protein, 574 aa, Homo sapiens
  Payload ID: 19832
  Gene Name: zinc finger protein 254
  ENSP ID: ENSP00000445527
MCPHFAQDLWPEQGMEDSFQKAILRRYGKYGHENLQLRKGCKSVDEYKVNKEGYNGLNQCFTTAQSKVFQCDKYLKVFYKFLNSNRPKIRHTEKKSFKCKKRVKLFCMLSHKTQHKSIYHREKSYKCKECGKTFNWSSTLTNHRKIYTEEKPYKCEEYNKSPKQLSTLTTHEIIHAGEKLYKCEECGEAFNRSSNLTTHKIIHTGEKPYKCEECGKAFIWSSTLTEHKKIHTRKKPYKCEECGKAFIWSSTLTRHKRMHTGEKPYKCEECGKAFSQSSTLTTHKIIHTGEKRYKCLECGKAFKQLSTLTTHKIIHVGEKLYKCEECGKGFNRSSNLTTHKIIHTGEKPYKCEECGKAFIWSSTLTKHKRIHTREKPYKCEECGKAFIWSSTLTRHKRMHTGEKPYKCEECGKSFSQSSTLTTHKIIHTGEKPYKCEECGKAFNWSSTLTKHKIIHTEEKPYKCEKCGKAFKQSSILTNHKRIHTGEKPYKCEECGKSFNRSSTFTKHKVIHTGVKPYKCEECGKAFFWSSTLTKHKRIHTGEQPYKWEKFGKAFNRSSHLTTDKITHWREILQV

SEQ ID NO: 99459 - protein, 53 aa, Homo sapiens
  Payload ID: 19832
  Gene Name: zinc finger protein 254
  ENSP ID: ENSP00000470845
MPGPPRSLEMMESRSVGQAGVQRRNLSSLQALSPGFTPFSASRAAGTTGTVDI

SEQ ID NO: 99460 - protein, 75 aa, Homo sapiens
  Payload ID: 19832
  Gene Name: zinc finger protein 254
  ENSP ID: ENSP00000472863
MPGPPRSLEMMESRSVGQAGVQRRNLSSLQALSPGFTPFSASRAAGTTDGVSLCHPGWSQWHNLGSLQPLPPGFK

SEQ ID NO: 99461 - protein, 618 aa, Homo sapiens
  Payload ID: 19832
  Gene Name: zinc finger protein 254
  ENSP ID: ENSP00000482703
MLENYRNLAFLGIAVSKPDLITCLEQGKEPWNMKRHEMVDEPPGMCPHFAQDLWPEQGMEDSFQKAILRRYGKYGHENLQLRKGCKSVDEYKVNKEGYNGLNQCFTTAQSKVFQCDKYLKVFYKFLNSNRPKIRHTEKKSFKCKKRVKLFCMLSHKTQHKSIYHREKSYKCKECGKTFNWSSTLTNHRKIYTEEKPYKCEEYNKSPKQLSTLTTHEIIHAGEKLYKCEECGEAFNRSSNLTTHKIIHTGEKPYKCEECGKAFIWSSTLTEHKKIHTRKKPYKCEECGKAFIWSSTLTRHKRMHTGEKPYKCEECGKAFSQSSTLTTHKIIHTGEKRYKCLECGKAFKQLSTLTTHKIIHVGEKLYKCEECGKGFNRSSNLTTHKIIHTGEKPYKCEECGKAFIWSSTLTKHKRIHTREKPYKCEECGKAFIWSSTLTRHKRMHTGEKPYKCEECGKSFSQSSTLTTHKIIHTGEKPYKCEECGKAFNWSSTLTKHKIIHTEEKPYKCEKCGKAFKQSSILTNHKRIHTGEKPYKCEECGKSFNRSSTFTKHKVIHTGVKPYKCEECGKAFFWSSTLTKHKRIHTGEQPYKWEKFGKAFNRSSHLTTDKITHWREILQV

SEQ ID NO: 99462 - protein, 586 aa, Homo sapiens
  Payload ID: 19832
  Gene Name: zinc finger protein 254
  ENSP ID: ENSP00000483222
MKRHEMVDEPPGMCPHFAQDLWPEQGMEDSFQKAILRRYGKYGHENLQLRKGCKSVDEYKVNKEGYNGLNQCFTTAQSKVFQCDKYLKVFYKFLNSNRPKIRHTEKKSFKCKKRVKLFCMLSHKTQHKSIYHREKSYKCKECGKTFNWSSTLTNHRKIYTEEKPYKCEEYNKSPKQLSTLTTHEIIHAGEKLYKCEECGEAFNRSSNLTTHKIIHTGEKPYKCEECGKAFIWSSTLTEHKKIHTRKKPYKCEECGKAFIWSSTLTRHKRMHTGEKPYKCEECGKAFSQSSTLTTHKIIHTGEKRYKCLECGKAFKQLSTLTTHKIIHVGEKLYKCEECGKGFNRSSNLTTHKIIHTGEKPYKCEECGKAFIWSSTLTKHKRIHTREKPYKCEECGKAFIWSSTLTRHKRMHTGEKPYKCEECGKSFSQSSTLTTHKIIHTGEKPYKCEECGKAFNWSSTLTKHKIIHTEEKPYKCEKCGKAFKQSSILTNHKRIHTGEKPYKCEECGKSFNRSSTFTKHKVIHTGVKPYKCEECGKAFFWSSTLTKHKRIHTGEQPYKWEKFGKAFNRSSHLTTDKITHWREILQV

SEQ ID NO: 99463 - protein, 574 aa, Homo sapiens; identical to SEQ ID NO: 99458
  Payload ID: 19832
  Gene Name: zinc finger protein 254
  ENSP ID: ENSP00000484930

SEQ ID NO: 99464 - protein, 627 aa, Homo sapiens
  Payload ID: 19833
  Gene Name: zinc finger protein 256
  Uniprot ID: Q9Y2P7
  ENSP ID: ENSP00000282308
MAAAELTAPAQGIVTFEDVAVYFSWKEWGLLDEAQKCLYHDVMLENLTLTTSLGGSGAGDEEAPYQQSTSPQRVSQVRIPKALPSPQKTNPCEICGPVLRQILHLVEHQGTHHGQKLYTDGACRKQLQFTAYLHQHQKQHVGQKHFRSNGGRDMFLSSCTFEVSGKPFTCKEVGKDFLVRSRFLQQQAAHTRKKSNRTKSAVAFHSVKNHYNWGECVKAFSYKHVRVQHQGDLIRERSYMCSECGKSFSTSCSLSDHLRVHTSEKPYTCGECGKSYRQSSSLITHRRIHTGVRPHQCDECGKLFNRKYDLLIHQRVHTGERPYKCSECGKSFSHSSSLITHQRIHTGMRPYECSECGKSFIHSSSLITHQRVHTGTRPYMCSECGKSFSQSCHLIKHRRLHIGEGPYECSECGKLFTYRSRFFQHQRVHTGVRSHECHECGKLFSRKFDLIVHERVHTGERPYECSECGKSFTCKSYLISHWKVHTGARPYECGECGKSFTHSSTLLQHQRVHTGERPYECNECGKFFSQSSSLIRHRRSHTGERPYECSECWKSFSNHSSLVKHRRVHTGERPYECSECGKSFSQSSNLTNHQRIHSGERPYECSDCGKFFTFNSNLLKHQNVHKG

SEQ ID NO: 99465 - protein, 56 aa, Homo sapiens
  Payload ID: 19833
  Gene Name: zinc finger protein 256
  ENSP ID: ENSP00000472858
MAAAELTAPAQVVLEQGMRRHLISRALLHSGCHRLGFLRPFLLPRRPTPVRYVAQS

SEQ ID NO: 99466 - protein, 35 aa, Homo sapiens
  Payload ID: 19834
  Gene Name: zinc finger protein 257
  ENSP ID: ENSP00000406147
MMESCSVVRLECSGMISALCNLRLPGSSNSPASAS

SEQ ID NO: 99467 - protein, 136 aa, Homo sapiens
  Payload ID: 19834
  Gene Name: zinc finger protein 257
  ENSP ID: ENSP00000469454
MGPLTIRDVTVEFSLEEWHCLDTAQQNLYRDVMLENYRNLVFLGIAVSKPDLITCLEQGKEPCNMKRHEMVAKPPDGGSLFLPRLKCNGAVSAHRKLLLPGSSDSLASAFQVAGITGTRHHAWLIFVFLVDMGFHH

SEQ ID NO: 99468 - protein, 82 aa, Homo sapiens
  Payload ID: 19834
  Gene Name: zinc finger protein 257
  ENSP ID: ENSP00000469703
MGPLTIRDVTVEFSLEEWHCLDTAQQNLYRDVMLENYRNLVFLGIAVSKPDLITCLEQGKEPCNMKRHEMVAKPPAFYLMGE

SEQ ID NO: 99469 - protein, 563 aa, Homo sapiens
  Payload ID: 19834
  Gene Name: zinc finger protein 257
  Uniprot ID: Q9Y2Q1
  ENSP ID: ENSP00000470209
MGPLTIRDVTVEFSLEEWHCLDTAQQNLYRDVMLENYRNLVFLGIAVSKPDLITCLEQGKEPCNMKRHEMVAKPPVMCSHIAEDLCPERDIKYFFQKVILRRYDKCEHENLQLRKGCKSVDECKVCKGGYNGLNQCLITTQSKMYQCDKYVKVFYKFSNSDRHKIRHTEKKTCKCKECGKSFCMLSQLTRHKRIHIRENSHKCEECGKAFNQSSALTRHKMTHTGEKPYKCEECGKAFNRSSHLTQHKVIHTREKPYKCEECGKAFNRSSHITQHKRIHNREKPFKYDECCKAFKWSSALTTLTQHKRIHTGEKPYKCEECGKAFNQSSALTRHKMIHTGEKPFQCEECGKAFNRSSHLTQHKIIHTKEKPYKCEECGKAFNRSSHLTKHKRIHTREKAYKCDEYCKAFNWSSALTTLTQHKIIHTGEKPYKCEECGKAFNRSSYLIRHKIIHTGEKPYKCEECGKAFNQSSHLTQHKIIHTGEKPYKCEECGKAFNRSSHLSQHKIIHTGEKPYKCEECGKPFNRFSYLTVHKRIHAGENPNKYEECGKACNHSSNLTKHNS

SEQ ID NO: 99470 - protein, 132 aa, Homo sapiens
  Payload ID: 19834
  Gene Name: zinc finger protein 257
  ENSP ID: ENSP00000471334
MCSHIAEDLCPERDIKYFFQKVILRRYDKCEHENLQLRKGCKSVDECKVCKGGYNGLNQCLITTQSKMYQCDKYVKVFYKFSNSDRHKIRHTEKKTCKCKECGKSFCMLSQLTRHKRIHIRENSHKCEECGK

SEQ ID NO: 99471 - protein, 35 aa, Homo sapiens; identical to SEQ ID NO: 99466
  Payload ID: 19834
  Gene Name: zinc finger protein 257
  ENSP ID: ENSP00000472944

SEQ ID NO: 99472 - protein, 533 aa, Homo sapiens
  Payload ID: 19835
  Gene Name: zinc finger protein 26
  Uniprot ID: P17031
  ENSP ID: ENSP00000333725
MATSFRTASCWGLLSFKDISMEFTWDEWQLLDSTQKYLYRDVILENYHNLISVGYHGTKPDLIFKLEQGEDPWIINAKISRQSCPDGWEEWYQNNQDELESIERSYACSVLGRLNLSKTHDSSRQRLYNTRGKSLTQNSAPSRSYLRKNPDKFHGYEEPYFLKHQRAHSIEKNCVCSECGKAFRCKSQLIVHLRIHTGERPYECSKCERAFSAKSNLNAHQRVHTGEKPYSCSECEKVFSFRSQLIVHQEIHTGGKPYGCSECGKAYSWKSQLLLHQRSHTGVKPYECSECGKAFSLKSPFVVHQRTHTGVKPHKCSECGKAFRSKSYLLVHIRMHTGEKPYQCSDCGKAFNMKTQLIVHQGVHTGNNPYQCGECGKAFGRKEQLTAHLRAHAGEKPYGCSECGKAFSSKSYLVIHRRTHTGERPYECSLCERAFCGKSQLIIHQRTHSTEKPYECNECEKAYPRKASLQIHQKTHSGEKPFKCSECGKAFTQKSSLSEHQRVHTGEKPWKCSECGKSFCWNSGLRIHRKTHK

SEQ ID NO: 99473 - protein, 513 aa, Homo sapiens
  Payload ID: 19835
  Gene Name: zinc finger protein 26
  ENSP ID: ENSP00000437420
MEFTWDEWQLLDSTQKYLYRDVILENYHNLISVGYHGTKPDLIFKLEQGEDPWIINAKISRQSCPDGWEEWYQNNQDELESIERSYACSVLGRLNLSKTHDSSRQRLYNTRGKSLTQNSAPSRSYLRKNPDKFHGYEEPYFLKHQRAHSIEKNCVCSECGKAFRCKSQLIVHLRIHTGERPYECSKCERAFSAKSNLNAHQRVHTGEKPYSCSECEKVFSFRSQLIVHQEIHTGGKPYGCSECGKAYSWKSQLLLHQRSHTGVKPYECSECGKAFSLKSPFVVHQRTHTGVKPHKCSECGKAFRSKSYLLVHIRMHTGEKPYQCSDCGKAFNMKTQLIVHQGVHTGNNPYQCGECGKAFGRKEQLTAHLRAHAGEKPYGCSECGKAFSSKSYLVIHRRTHTGERPYECSLCERAFCGKSQLIIHQRTHSTEKPYECNECEKAYPRKASLQIHQKTHSGEKPFKCSECGKAFTQKSSLSEHQRVHTGEKPWKCSECGKSFCWNSGLRIHRKTHK

SEQ ID NO: 99474 - protein, 80 aa, Homo sapiens
  Payload ID: 19835
  Gene Name: zinc finger protein 26
  ENSP ID: ENSP00000443888
MATSFRTASCWGLLSFKDISMEFTWDEWQLLDSTQKYLYRDVILENYHNLISVDGWEEWYQNNQDELESIERSYACSVLG

SEQ ID NO: 99475 - protein, 153 aa, Homo sapiens
  Payload ID: 19835
  Gene Name: zinc finger protein 26
  ENSP ID: ENSP00000445494
MATSFRTASCWVVLLRRSLLMSSSVKFGNLLGVPWAQGNSALPEGLLSFKDISMEFTWDEWQLLDSTQKYLYRDVILENYHNLISVGYHGTKPDLIFKLEQGEDPWIINAKISRQSCPDGWEEWYQNNQDELESIERSYACSVLGRLNLSKTH

SEQ ID NO: 99476 - protein, 412 aa, Homo sapiens
  Payload ID: 19836
  Gene Name: zinc finger protein 260
  Uniprot ID: Q3ZCT1
  ENSP ID: ENSP00000429803
MIGMLESLQHESDLLQHDQIHTGEKPYECNECRKTFSLKQNLVEHKKMHTGEKSHECTECGKVCSRVSSLTLHLRSHTGKKAYKCNKCGKAFSQKENFLSHQKHHTGEKPYECEKVSIQMPTIIRHQKNHTGTKPYACKECGKAFNGKAYLTEHEKIHTGEKPFECNQCGRAFSQKQYLIKHQNIHTGKKPFKCSECGKAFSQKENLIIHQRIHTGEKPYECKGCGKAFIQKSSLIRHQRSHTGEKPYTCKECGKAFSGKSNLTEHEKIHIGEKPYKCNECGTIFRQKQYLIKHHNIHTGEKPYECNKCGKAFSRITSLIVHVRIHTGDKPYECKVCGKAFCQSSSLTVHMRSHTGEKPYGCNECGKAFSQFSTLALHMRIHTGEKPYQCSECGKAFSQKSHHIRHQRIHTH

SEQ ID NO: 99477 - protein, 412 aa, Homo sapiens; identical to SEQ ID NO: 99476
  Payload ID: 19836
  Gene Name: zinc finger protein 260
  Uniprot ID: Q3ZCT1
  ENSP ID: ENSP00000464964

SEQ ID NO: 99478 - protein, 412 aa, Homo sapiens; identical to SEQ ID NO: 99476
  Payload ID: 19836
  Gene Name: zinc finger protein 260
  Uniprot ID: Q3ZCT1
  ENSP ID: ENSP00000465834

SEQ ID NO: 99479 - protein, 412 aa, Homo sapiens; identical to SEQ ID NO: 99476
  Payload ID: 19836
  Gene Name: zinc finger protein 260
  Uniprot ID: Q3ZCT1
  ENSP ID: ENSP00000467219

SEQ ID NO: 99480 - protein, 683 aa, Homo sapiens
  Payload ID: 19837
  Gene Name: zinc finger protein 263
  Uniprot ID: O14978
  ENSP ID: ENSP00000219069
MASGPGSQEREGLLIVKLEEDCAWSQELPPPDPGPSPEASHLRFRRFRFQEAAGPREALSRLQELCHGWLRPEMRTKEQILELLVLEQFLTILPQEIQSRVQELHPESGEEAVTLVEDMQRELGRLRQQVTNHGRGTEVLLEEPLPLETARESPSFKLEPMETERSPGPRLQELLGPSPQRDPQAVKERALSAPWLSLFPPEGNMEDKEMTGPQLPESLEDVAMYISQEEWGHQDPSKRALSRDTVQESYENVDSLESHIPSQEVPGTQVGQGGKLWDPSVQSCKEGLSPRGPAPGEEKFENLEGVPSVCSENIHPQVLLPDQARGEVPWSPELGRPHDRSQGDWAPPPEGGMEQALAGASSGRELGRPKELQPKKLHLCPLCGKNFSNNSNLIRHQRIHAAERLCMGVDCTEIFGGNPRFLSLHRAHLGEEAHKCLECGKCFSQNTHLTRHQRTHTGEKPYQCNICGKCFSCNSNLHRHQRTHTGEKPYKCPECGEIFAHSSNLLRHQRIHTGERPYKCPECGKSFSRSSHLVIHERTHERERLYPFSECGEAVSDSTPFLTNHGAHKAEKKLFECLTCGKSFRQGMHLTRHQRTHTGEKPYKCTLCGENFSHRSNLIRHQRIHTGEKPYTCHECGDSFSHSSNRIRHLRTHTGERPYKCSECGESFSRSSRLMSHQRTHTG

SEQ ID NO: 99481 - protein, 331 aa, Homo sapiens
  Payload ID: 19837
  Gene Name: zinc finger protein 263
  ENSP ID: ENSP00000444497
MEQALAGASSGRELGRPKELQPKKLHLCPLCGKNFSNNSNLIRHQRIHAAERLCMGVDCTEIFGGNPRFLSLHRAHLGEEAHKCLECGKCFSQNTHLTRHQRTHTGEKPYQCNICGKCFSCNSNLHRHQRTHTGEKPYKCPECGEIFAHSSNLLRHQRIHTGERPYKCPECGKSFSRSSHLVIHERTHERERLYPFSECGEAVSDSTPFLTNHGAHKAEKKLFECLTCGKSFRQGMHLTRHQRTHTGEKPYKCTLCGENFSHRSNLIRHQRIHTGEKPYTCHECGDSFSHSSNRIRHLRTHTGERPYKCSECGESFSRSSRLMSHQRTHTG

SEQ ID NO: 99482 - protein, 115 aa, Homo sapiens
  Payload ID: 19837
  Gene Name: zinc finger protein 263
  ENSP ID: ENSP00000458214
  MOD_RES (1)..(1): Any amino acid
XFRFQEAAGPREALSRLQELCHGWLRPEMRTKEQILELLVLEQFLTILPQEIQSRVQELHPESGEEAVTLVEDMQRELGRLRQQSLTFPVRRSQAPRWDKEESYGIPVSRAARRA

SEQ ID NO: 99483 - protein, 226 aa, Homo sapiens
  Payload ID: 19837
  Gene Name: zinc finger protein 263
  ENSP ID: ENSP00000459998
MASGPGSQEREGLLIVKLEEDCAWSQELPPPDPGPSPEASHLRFRRFRFQEAAGPREALSRLQELCHGWLRPEMRTKEQILELLVLEQFLTILPQEIQSRVQELHPESGEEAVTLVEDMQRELGRLRQQEKRNLRTWKVFRLYALRTSTLRCCFLTRPEGRCPGVLSWEDLMTGRKGIGRLPQRVEWSRPWQEPQVAENWGDRRNCSQRNSIYVPCVAKISLTTQT

SEQ ID NO: 99484 - protein, 149 aa, Homo sapiens
  Payload ID: 19837
  Gene Name: zinc finger protein 263
  ENSP ID: ENSP00000460278
MASGPGSQEREGLLIVKLEEDCAWSQELPPPDPGPSPEASHLRFRRFRFQEAAGPREALSRLQELCHGWLRPEMRTKEQILELLVLEQFLTILPQEIQSRVQELHPESGEEAVTLVEDMQRELGRLRQQHYLLPGFLFFLLKGTWKTRR

SEQ ID NO: 99485 - protein, 115 aa, Homo sapiens
  Payload ID: 19837
  Gene Name: zinc finger protein 263
  ENSP ID: ENSP00000461146
  MOD_RES (1)..(1): Any amino acid
XAEKKLFECLTCGKSFRQGMHLTRHQRTHTGEKPYKCTLCGENFSHRSNLIRHQRIHTGEKPYTCHECGDSFSHSSNRIRHLRTHTGERPYKCSECGESFSRSSRLMSHQRTHTV

SEQ ID NO: 99486 - protein, 51 aa, Homo sapiens
  Payload ID: 19837
  Gene Name: zinc finger protein 263
  ENSP ID: ENSP00000461755
CHECGDSFSHSSNRIRHLRTHTGERPYKCSECGESFSRSSRLMSHQRTHTV

SEQ ID NO: 99487 - protein, 141 aa, Homo sapiens
  Payload ID: 19837
  Gene Name: zinc finger protein 263
  ENSP ID: ENSP00000461861
MASGPGSQEREGLLIVKLEEDCAWSQELPPPDPGPSPEASHLRFRRFRFQEAAGPREALSRLQELCHGWLRPEMRTKEQILELLVLEQFLTILPQEIQSRVQELHPESGEEAVTLVEDMQRELGRLRQQLPESLEDVAMYI

SEQ ID NO: 99488 - protein, 627 aa, Homo sapiens
  Payload ID: 19838
  Gene Name: zinc finger protein 264
  Uniprot ID: O43296
  ENSP ID: ENSP00000263095
MAAAVLTDRAQVSVTFDDVAVTFTKEEWGQLDLAQRTLYQEVMLENCGLLVSLGCPVPKAELICHLEHGQEPWTRKEDLSQDTCPGDKGKPKTTEPTTCEPALSEGISLQGQVTQGNSVDSQLGQAEDQDGLSEMQEGHFRPGIDPQEKSPGKMSPECDGLGTADGVCSRIGQEQVSPGDRVRSHNSCESGKDPMIQEEENNFKCSECGKVFNKKHLLAGHEKIHSGVKPYECTECGKTFIKSTHLLQHHMIHTGERPYECMECGKAFNRKSYLTQHQRIHSGEKPYKCNECGKAFTHRSNFVLHNRRHTGEKSFVCTECGQVFRHRPGFLRHYVVHSGENPYECLECGKVFKHRSYLMWHQQTHTGEKPYECSECGKVFLESAALIHHYVIHTGEKPFECLECGKAFNHRSYLKRHQRIHTGEKPFVCSECGKAFTHCSTFILHKRAHTGEKPFECKECGKAFSNRKDLIRHFSIHTGEKPYECVECGKAFTRMSGLTRHKRIHSGEKPYECVECGKSFCWSTNLIRHAIIHTGEKPYKCSECGKAFSRSSSLTQHQRMHTGKNPISVTDVGRPFTSGQTSVTLRELLLGKDFLNVTTEANILPEETSSSASDQPYQRETPQVSSL

SEQ ID NO: 99489 - protein, 627 aa, Homo sapiens; identical to SEQ ID NO: 99488
  Payload ID: 19838
  Gene Name: zinc finger protein 264
  Uniprot ID: O43296
  ENSP ID: ENSP00000440376

SEQ ID NO: 99490 - protein, 39 aa, Homo sapiens
  Payload ID: 19838
  Gene Name: zinc finger protein 264
  ENSP ID: ENSP00000469130
MAAAVLTDRAQVSVTFDDVAVTFTKEEWGQLDLAQRTLY

SEQ ID NO: 99491 - protein, 96 aa, Homo sapiens
  Payload ID: 19838
  Gene Name: zinc finger protein 264
  ENSP ID: ENSP00000470587
MAAAVLTDRAQVSVTFDDVAVTFTKEEWGQLDLAQRTLYQEVMLENCGLLVSLGDKGKPKTTEPTTCEPALSEGISLQGQVTQGNSVDSQLGQAED

SEQ ID NO: 99492 - protein, 84 aa, Homo sapiens
  Payload ID: 19838
  Gene Name: zinc finger protein 264
  ENSP ID: ENSP00000470759
MAAAVLTDRAQVSVTFDDVAVTFTKEEWGQLDLAQRTLYQEVMLENCGLLVSLAPLQTHPGSIRCILQSNQVDTLIKIPEHTEH

SEQ ID NO: 99493 - protein, 64 aa, Homo sapiens
  Payload ID: 19838
  Gene Name: zinc finger protein 264
  ENSP ID: ENSP00000471630
MAAAVLTDRAQVSVTFDDVAVTFTKEEWGQLDLAQRTLYQEVMLENCGLLVSLGKAFLPPPPCR

SEQ ID NO: 99494 - protein, 549 aa, Homo sapiens
  Payload ID: 19839
  Gene Name: zinc finger protein 266
  Uniprot ID: Q14584
  ENSP ID: ENSP00000466714
MLENYKNLATVGYQLFKPSLISWLEQEESRTVQRGDFQASEWKVQLKTKELALQQDVLGEPTSSGIQMIGSHNGGEVSDVKQCGDVSSEHSCLKTHVRTQNSENTFECYLYGVDFLTLHKKTSTGEQRSVFSQCGKAFSLNPDVVCQRTCTGEKAFDCSDSGKSFINHSHLQGHLRTHNGESLHEWKECGRGFIHSTDLAVRIQTHRSEKPYKCKECGKGFRYSAYLNIHMGTHTGDNPYECKECGKAFTRSCQLTQHRKTHTGEKPYKCKDCGRAFTVSSCLSQHMKIHVGEKPYECKECGIAFTRSSQLTEHLKTHTAKDPFECKICGKSFRNSSCLSDHFRIHTGIKPYKCKDCGKAFTQNSDLTKHARTHSGERPYECKECGKAFARSSRLSEHTRTHTGEKPFECVKCGKAFAISSNLSGHLRIHTGEKPFECLECGKAFTHSSSLNNHMRTHSAKKPFTCMECGKAFKFPTCVNLHMRIHTGEKPYKCKQCGKSFSYSNSFQLHERTHTGEKPYECKECGKAFSSSSSFRNHERRHADERLSA

SEQ ID NO: 99495 - protein, 549 aa, Homo sapiens; identical to SEQ ID NO: 99494
  Payload ID: 19839
  Gene Name: zinc finger protein 266
  Uniprot ID: Q14584
  ENSP ID: ENSP00000467151

SEQ ID NO: 99496 - protein, 549 aa, Homo sapiens; identical to SEQ ID NO: 99494
  Payload ID: 19839
  Gene Name: zinc finger protein 266
  Uniprot ID: Q14584
  ENSP ID: ENSP00000467315

SEQ ID NO: 99497 - protein, 549 aa, Homo sapiens; identical to SEQ ID NO: 99494
  Payload ID: 19839
  Gene Name: zinc finger protein 266
  Uniprot ID: Q14584
  ENSP ID: ENSP00000467403

SEQ ID NO: 99498 - protein, 72 aa, Homo sapiens
  Payload ID: 19839
  Gene Name: zinc finger protein 266
  ENSP ID: ENSP00000467923
MLENYKNLATVGYQLFKPSLISWLEQEESRTVQRGDFQASEWKVQLKTKELALQQDVLGEPTSSGIQMIGSH

SEQ ID NO: 99499 - protein, 549 aa, Homo sapiens; identical to SEQ ID NO: 99494
  Payload ID: 19839
  Gene Name: zinc finger protein 266
  Uniprot ID: Q14584
  ENSP ID: ENSP00000468491

SEQ ID NO: 99500 - protein, 743 aa, Homo sapiens
  Payload ID: 19840
  Gene Name: zinc finger protein 267
  Uniprot ID: Q14586
  ENSP ID: ENSP00000300870
MGLLTFRDVAVEFSLEEWEHLEPAQKNLYQDVMLENYRNLVSLGLVVSKPDLITFLEQRKEPWNVKSEETVAIQPDVFSHYNKDLLTEHCTEASFQKVISRRHGSCDLENLHLRKRWKREECEGHNGCYDEKTFKYDQFDESSVESLFHQQILSSCAKSYNFDQYRKVFTHSSLLNQQEEIDIWGKHHIYDKTSVLFRQVSTLNSYRNVFIGEKNYHCNNSEKTLNQSSSPKNHQENYFLEKQYKCKEFEEVFLQSMHGQEKQEQSYKCNKCVEVCTQSLKHIQHQTIHIRENSYSYNKYDKDLSQSSNLRKQIIHNEEKPYKCEKCGDSLNHSLHLTQHQIIPTEEKPCKWKECGKVFNLNCSLYLTKQQQIDTGENLYKCKACSKSFTRSSNLIVHQRIHTGEKPYKCKECGKAFRCSSYLTKHKRIHTGEKPYKCKECGKAFNRSSCLTQHQTTHTGEKLYKCKVCSKSYARSSNLIMHQRVHTGEKPYKCKECGKVFSRSSCLTQHRKIHTGENLYKCKVCAKPFTCFSNLIVHERIHTGEKPYKCKECGKAFPYSSHLIRHHRIHTGEKPYKCKACSKSFSDSSGLTVHRRTHTGEKPYTCKECGKAFSYSSDVIQHRRIHTGQRPYKCEECGKAFNYRSYLTTHQRSHTGERPYKCEECGKAFNSRSYLTTHRRRHTGERPYKCDECGKAFSYRSYLTTHRRSHSGERPYKCEECGKAFNSRSYLIAHQRSHTREKL

SEQ ID NO: 99501 - protein, 49 aa, Homo sapiens
  Payload ID: 19840
  Gene Name: zinc finger protein 267
  ENSP ID: ENSP00000454369
  MOD_RES (1)..(1): Any amino acid
XLRVFRSGRPRRLRVLRINRTSVALRLAGTGRFVAKTPGHPGSWEMGPV

SEQ ID NO: 99502 - protein, 51 aa, Homo sapiens
  Payload ID: 19840
  Gene Name: zinc finger protein 267
  ENSP ID: ENSP00000454753
  MOD_RES (1)..(1): Any amino acid
XQLRVFRSGRPRRLRVLRINRTSVALRLAGTGRFVAKTPGHPGSWEMNCLG

SEQ ID NO: 99503 - protein, 91 aa, Homo sapiens
  Payload ID: 19840
  Gene Name: zinc finger protein 267
  ENSP ID: ENSP00000455493
MLENYRNLVSLGLVVSKPDLITFLEQRKEPWNVKSEETVAIQPDVFSHYNKDLLTEHCTEASFQKVISRRHGSCDLENLHLRKRWKREECE

SEQ ID NO: 99504 - protein, 77 aa, Homo sapiens
  Payload ID: 19840
  Gene Name: zinc finger protein 267
  ENSP ID: ENSP00000461286
MGLLTFRDVAVEFSLEEWEHLEPAQKNLYQDVMLENYRNLVSLGLVVSKPDLITFLEQRKEPWNVKSEETVAIQPGH

SEQ ID NO: 99505 - protein, 947 aa, Homo sapiens
  Payload ID: 19841
  Gene Name: zinc finger protein 268
  Uniprot ID: Q14587
  ENSP ID: ENSP00000228289
MATRVRTASIWVPPLQERNSSWDRIRKLQGQESILGQGTPGLQPLPGTPRQKQKSRRIEKVLEWLFISQEQPKITKSWGPLSFMDVFVDFTWEEWQLLDPAQKCLYRSVMLENYSNLVSLGYQHTKPDIIFKLEQGEELCMVQAQVPNQTCPNTVWKIDDLMDWHQENKDKLGSTAKSFECTTFGKLCLLSTKYLSRQKPHKCGTHGKSLKYIDFTSDYARNNPNGFQVHGKSFFHSKHEQTVIGIKYCESIESGKTVNKKSQLMCQQMYMGEKPFGCSCCEKAFSSKSYLLVHQQTHAEEKPYGCNECGKDFSSKSYLIVHQRIHTGEKLHECSECRKTFSFHSQLVIHQRIHTGENPYECCECGKVFSRKDQLVSHQKTHSGQKPYVCNECGKAFGLKSQLIIHERIHTGEKPYECNECQKAFNTKSNLMVHQRTHTGEKPYVCSDCGKAFTFKSQLIVHQGIHTGVKPYGCIQCGKGFSLKSQLIVHQRSHTGMKPYVCNECGKAFRSKSYLIIHTRTHTGEKLHECNNCGKAFSFKSQLIIHQRIHTGENPYECHECGKAFSRKYQLISHQRTHAGEKPYECTDCGKAFGLKSQLIIHQRTHTGEKPFECSECQKAFNTKSNLIVHQRTHTGEKPYSCNECGKAFTFKSQLIVHKGVHTGVKPYGCSQCAKTFSLKSQLIVHQRSHTGVKPYGCSECGKAFRSKSYLIIHMRTHTGEKPHECRECGKSFSFNSQLIVHQRIHTGENPYECSECGKAFNRKDQLISHQRTHAGEKPYGCSECGKAFSSKSYLIIHMRTHSGEKPYECNECGKAFIWKSLLIVHERTHAGVNPYKCSQCEKSFSGKLRLLVHQRMHTREKPYECSECGKAFIRNSQLIVHQRTHSGEKPYGCNECGKTFSQKSILSAHQRTHTGEKPCKCTECGKAFCWKSQLIMHQRTHVDDKH

SEQ ID NO: 99506 - protein, 188 aa, Homo sapiens
  Payload ID: 19841
  Gene Name: zinc finger protein 268
  ENSP ID: ENSP00000409295
MATRVRTASIWVPPLQERNSSWDRIRKLQGQESILGQGTPGLQPLPGTPRQKQKSRRIEKVLEWLFISQEQPKITKSWGPLSFMDVFVDFTWEEWQLLDPAQKCLYRSVMLENYSNLVSLGYQHTKPDIIFKLEQGEELCMVQAQVPNQTCPILKAGKSKAKVLAGLVSGEGLLCASKMTPCCCILWR

SEQ ID NO: 99507 - protein, 38 aa, Homo sapiens
  Payload ID: 19841
  Gene Name: zinc finger protein 268
  ENSP ID: ENSP00000437410
MATRVRTASIWAGVQWLSLLTTTSASRVQVVLLPQPPE

SEQ ID NO: 99508 - protein, 100 aa, Homo sapiens
  Payload ID: 19841
  Gene Name: zinc finger protein 268
  ENSP ID: ENSP00000437858
MATRVRTASIWGTNTPNLISSSSWNKEKSCVWCRPKFQIRPVQTQSGKLMILWIGIRKIKTSWEVRQKALNALHLENYVFLVQSIFQDKNLINVARMERV

SEQ ID NO: 99509 - protein, 68 aa, Homo sapiens
  Payload ID: 19841
  Gene Name: zinc finger protein 268
  ENSP ID: ENSP00000438941
MATRVRTASIWTQSGKLMILWIGIRKIKTSWEVRQKALNALHLENYVFLVQSIFQDKNLINVARMERV

SEQ ID NO: 99510 - protein, 193 aa, Homo sapiens
  Payload ID: 19841
  Gene Name: zinc finger protein 268
  ENSP ID: ENSP00000439539
MATRVRTASIWVPPLQERNSSWDRIRKLQGQESILGQGTPGLQPLPGTPRQKQKSRRIEKVLEWLFISQEQPKITKSWGPLSFMDVFVDFTWEEWQLLDPAQKCLYRSVMLENYSNLVSLGYQHTKPDIIFKLEQGEELCMVQAQVPNQTCPILKAGKSKAKVLAGLVSGEGLLCASKMTPCCCILWRHSLEN

SEQ ID NO: 99511 - protein, 167 aa, Homo sapiens
  Payload ID: 19841
  Gene Name: zinc finger protein 268
  ENSP ID: ENSP00000442446
MATRVRTASIWVPPLQERNSSWDRIRKLQGQESILGQGTPGLQPLPGTPRQKQKSRRIEKVLEWLFISQEQPKITKSWGTNTPNLISSSSWNKEKSCVWCRPKFQIRPVQTQSGKLMILWIGIRKIKTSWEVRQKALNALHLENYVFLVQSIFQDKNLINVARMERV

SEQ ID NO: 99512 - protein, 178 aa, Homo sapiens
  Payload ID: 19841
  Gene Name: zinc finger protein 268
  ENSP ID: ENSP00000443721
MATRVRTASIWVPPLQERNSSWDRIRKLQGQESILGQGTPGLQPLPGTPRQKQKSRRIEKVLEWLFISQEQPKITKSWEWQLLDPAQKCLYRSVMLENYSNLVSLGYQHTKPDIIFKLEQGEELCMVQAQVPNQTCPILKAGKSKAKVLAGLVSGEGLLCASKMTPCCCILWRHSLEN

SEQ ID NO: 99513 - protein, 947 aa, Homo sapiens; identical to SEQ ID NO: 99505
  Payload ID: 19841
  Gene Name: zinc finger protein 268
  Uniprot ID: Q14587
  ENSP ID: ENSP00000444412

SEQ ID NO: 99514 - protein, 35 aa, Homo sapiens
  Payload ID: 19841
  Gene Name: zinc finger protein 268
  ENSP ID: ENSP00000446153
MDVFVDFTWEEWQLLDPAQKCLYRSVMLENYSNLV

SEQ ID NO: 99515 - protein, 111 aa, Homo sapiens
  Payload ID: 19841
  Gene Name: zinc finger protein 268
  ENSP ID: ENSP00000464721
  MOD_RES (1)..(1): Any amino acid
XSFMDVFVDFTWEEWQLLDPAQKCLYRSVMLENYSNLVSLGYQHTKPDIIFKLEQGEELCMVQAQVPNQTCPILKAGKSKAKVLAGLVSGEGLLCASKMTPCCCILWSLEN

SEQ ID NO: 99516 - protein, 44 aa, Homo sapiens
  Payload ID: 19841
  Gene Name: zinc finger protein 268
  Uniprot ID: Q14587
  ENSP ID: ENSP00000466622
MATRVRTASIWGTNTPNLISSSSWNKEKSCVWCRPKFQIRPVQF

SEQ ID NO: 99517 - protein, 94 aa, Homo sapiens
  Payload ID: 19841
  Gene Name: zinc finger protein 268
  ENSP ID: ENSP00000466629
MDVFVDFTWEEWQLLDPAQKCLYRSVMLENYSNLVSLGYQHTKPDIIFKLEQGEELCMVQAQVPNQTCPNTVWKIDDLMDWHQENKDKLGSTAK

SEQ ID NO: 99518 - protein, 135 aa, Homo sapiens
  Payload ID: 19841
  Gene Name: zinc finger protein 268
  Uniprot ID: Q14587
  ENSP ID: ENSP00000467781
MATRVRTASIWVPPLQERNSSWDRIRKLQGQESILGQGTPGLQPLPGTPRQKQKSRRIEKVLEWLFISQEQPKITKSWTQSGKLMILWIGIRKIKTSWEVRQKALNALHLENYVFLVQSIFQDKNLINVARMERV

SEQ ID NO: 99519 - protein, 126 aa, Homo sapiens
  Payload ID: 19841
  Gene Name: zinc finger protein 268
  ENSP ID: ENSP00000467922
MATRVRTASIWGPLSFMDVFVDFTWEEWQLLDPAQKCLYRSVMLENYSNLVSLGYQHTKPDIIFKLEQGEELCMVQAQVPNQTCPILKAGKSKAKVLAGLVSGEGLLCASKMTPCCCILWRHSLEN

SEQ ID NO: 99520 - protein, 121 aa, Homo sapiens
  Payload ID: 19841
  Gene Name: zinc finger protein 268
  ENSP ID: ENSP00000479191
MATRVRTASIWGPLSFMDVFVDFTWEEWQLLDPAQKCLYRSVMLENYSNLVSLGYQHTKPDIIFKLEQGEELCMVQAQVPNQTCPILKAGKSKAKVLAGLVSGEGLLCASKMTPCCCILWR

SEQ ID NO: 99521 - protein, 569 aa, Homo sapiens
  Payload ID: 19842
  Gene Name: zinc finger protein 273
  Uniprot ID: Q14593
  ENSP ID: ENSP00000418719
MSSAPRGPPSVAPLPAGIGRSTAKTPGLPGSLEMGPLTFRDVAIEFSLEEWQCLDTSQQNLYRNVMLDNYRNLVFLGIAVSKPDLITCLEQGKEPCNMKRHAMVAKPPVVCSHFAQDLWPKQGLKDSFQKVILRRYGKYGHENLQLRKGCKSADEHKVHKRGYNGLNQCLTTTQSKIFQCDKYVKVLHKFSNSNIHKKRQTGKKPFKCKECGKSCCILSQLTQHKKTATRVNFYKCKTCGKAFNQFSNLTKHKIIHPEVNPYKCEECGKAFNQSLTLTKHKKIHTEEKPYKCEDCGKVFSVFSVLTKHKIIHTGTKPYNCEECGKGFSIFSTLTKHKIIHTGEKPYKCNECGKAFNWSSTLTKHKRIHTGEKPYKCEECGKAFNQSSTLTRHKIVHTGEKPYKCEECGKAFKRSTTLTKHKRIYTKEKPYKCEECGKAFSVFSTLTKHKIIHTGAKPYKCEECGSAFRAFSTLTEHKRVHTGEKPYKCNECGKAFNWSSTLTKHKRIHTGEKPYKCEECGKAFNRSSNLTRHKKIHTGEKPYKPKRCDSAFDNTPNFSRHKRNHMGEKS

SEQ ID NO: 99522 - protein, 66 aa, Homo sapiens
  Payload ID: 19842
  Gene Name: zinc finger protein 273
  ENSP ID: ENSP00000433382
MSSAPRGPPSVAPLPAGIGRSTAKTPGLPGSLEMARKTGKITGSSTYWMFDKIFFLGQKHWHYWDH

SEQ ID NO: 99523 - protein, 621 aa, Homo sapiens
  Payload ID: 19843
  Gene Name: zinc finger protein 274
  Uniprot ID: Q96GC6
  ENSP ID: ENSP00000321187
MASRLPTAWSCEPVTFEDVTLGFTPEEWGLLDLKQKSLYREVMLENYRNLVSVEYPELQLDPKLDPLPAESPLMNIEVVEVLTLNQEVAGPRNAQIQALYAEDGSLSADAPSEQVQQQGKHPGDPEAARQRFRQFRYKDMTGPREALDQLRELCHQWLQPKARSKEQILELLVLEQFLGALPVKLRTWVESQHPENCQEVVALVEGVTWMSEEEVLPAGQPAEGTTCCLEVTAQQEEKQEDAAICPVTVLPEEPVTFQDVAVDFSREEWGLLGPTQRTEYRDVMLETFGHLVSVGWETTLENKELAPNSDIPEEEPAPSLKVQESSRDCALSSTLEDTLQGGVQEVQDTVLKQMESAQEKDLPQKKHFDNRESQANSGALDTNQVSLQKIDNPESQANSGALDTNQVLLHKIPPRKRLRKRDSQVKSMKHNSRVKIHQKSCERQKAKEGNGCRKTFSRSTKQITFIRIHKGSQVCRCSECGKIFRNPRYFSVHKKIHTGERPYVCQDCGKGFVQSSSLTQHQRVHSGERPFECQECGRTFNDRSAISQHLRTHTGAKPYKCQDCGKAFRQSSHLIRHQRTHTGERPYACNKCGKAFTQSSHLIGHQRTHNRTKRKKKQPTS

SEQ ID NO: 99524 - protein, 611 aa, Homo sapiens
  Payload ID: 19843
  Gene Name: zinc finger protein 274
  ENSP ID: ENSP00000321209
MLENYRNLVSVEHQLSKPDVVSQLEEAEDFWPVERGIPQDTIPEYPELQLDPKLDPLPAESPLMNIEVVEVLTLNQEVAGPRNAQIQALYAEDGSLSADAPSEQVQQQGKHPGDPEAARQRFRQFRYKDMTGPREALDQLRELCHQWLQPKARSKEQILELLVLEQFLGALPVKLRTWVESQHPENCQEVVALVEGVTWMSEEEVLPAGQPAEGTTCCLEVTAQQEEKQEDAAICPVTVLPEEPVTFQDVAVDFSREEWGLLGPTQRTEYRDVMLETFGHLVSVGWETTLENKELAPNSDIPEEEPAPSLKVQESSRDCALSSTLEDTLQGGVQEVQDTVLKQMESAQEKDLPQKKHFDNRESQANSGALDTNQVSLQKIDNPESQANSGALDTNQVLLHKIPPRKRLRKRDSQVKSMKHNSRVKIHQKSCERQKAKEGNGCRKTFSRSTKQITFIRIHKGSQVCRCSECGKIFRNPRYFSVHKKIHTGERPYVCQDCGKGFVQSSSLTQHQRVHSGERPFECQECGRTFNDRSAISQHLRTHTGAKPYKCQDCGKAFRQSSHLIRHQRTHTGERPYACNKCGKAFTQSSHLIGHQRTHNRTKRKKKQPTS

SEQ ID NO: 99525 - protein, 548 aa, Homo sapiens
  Payload ID: 19843
  Gene Name: zinc finger protein 274
  Uniprot ID: Q96GC6
  ENSP ID: ENSP00000409872
MNIEVVEVLTLNQEVAGPRNAQIQALYAEDGSLSADAPSEQVQQQGKHPGDPEAARQRFRQFRYKDMTGPREALDQLRELCHQWLQPKARSKEQILELLVLEQFLGALPVKLRTWVESQHPENCQEVVALVEGVTWMSEEEVLPAGQPAEGTTCCLEVTAQQEEKQEDAAICPVTVLPEEPVTFQDVAVDFSREEWGLLGPTQRTEYRDVMLETFGHLVSVGWETTLENKELAPNSDIPEEEPAPSLKVQESSRDCALSSTLEDTLQGGVQEVQDTVLKQMESAQEKDLPQKKHFDNRESQANSGALDTNQVSLQKIDNPESQANSGALDTNQVLLHKIPPRKRLRKRDSQVKSMKHNSRVKIHQKSCERQKAKEGNGCRKTFSRSTKQITFIRIHKGSQVCRCSECGKIFRNPRYFSVHKKIHTGERPYVCQDCGKGFVQSSSLTQHQRVHSGERPFECQECGRTFNDRSAISQHLRTHTGAKPYKCQDCGKAFRQSSHLIRHQRTHTGERPYACNKCGKAFTQSSHLIGHQRTHNRTKRKKKQPTS

SEQ ID NO: 99526 - protein, 103 aa, Homo sapiens
  Payload ID: 19843
  Gene Name: zinc finger protein 274
  ENSP ID: ENSP00000469427
MNIEVVEVLTLNQEVAGPRNAQIQALYAEDGSLSADAPSEQVQQQGKHPGDPEAARQRFRQFRYKDMTGPREALDQLRELCHQWLQPKARSKEQILELLVLEQ

SEQ ID NO: 99527 - protein, 79 aa, Homo sapiens
  Payload ID: 19843
  Gene Name: zinc finger protein 274
  ENSP ID: ENSP00000469546
MASRLPTAWSCEPVTFEDVTLGFTPEEWGLLDLKQKSLYREVMLENYRNLVSVEHQLSKPDVVSQLEEAEDFWPVERGI

SEQ ID NO: 99528 - protein, 653 aa, Homo sapiens
  Payload ID: 19843
  Gene Name: zinc finger protein 274
  Uniprot ID: Q96GC6
  ENSP ID: ENSP00000478533
MASRLPTAWSCEPVTFEDVTLGFTPEEWGLLDLKQKSLYREVMLENYRNLVSVEHQLSKPDVVSQLEEAEDFWPVERGIPQDTIPEYPELQLDPKLDPLPAESPLMNIEVVEVLTLNQEVAGPRNAQIQALYAEDGSLSADAPSEQVQQQGKHPGDPEAARQRFRQFRYKDMTGPREALDQLRELCHQWLQPKARSKEQILELLVLEQFLGALPVKLRTWVESQHPENCQEVVALVEGVTWMSEEEVLPAGQPAEGTTCCLEVTAQQEEKQEDAAICPVTVLPEEPVTFQDVAVDFSREEWGLLGPTQRTEYRDVMLETFGHLVSVGWETTLENKELAPNSDIPEEEPAPSLKVQESSRDCALSSTLEDTLQGGVQEVQDTVLKQMESAQEKDLPQKKHFDNRESQANSGALDTNQVSLQKIDNPESQANSGALDTNQVLLHKIPPRKRLRKRDSQVKSMKHNSRVKIHQKSCERQKAKEGNGCRKTFSRSTKQITFIRIHKGSQVCRCSECGKIFRNPRYFSVHKKIHTGERPYVCQDCGKGFVQSSSLTQHQRVHSGERPFECQECGRTFNDRSAISQHLRTHTGAKPYKCQDCGKAFRQSSHLIRHQRTHTGERPYACNKCGKAFTQSSHLIGHQRTHNRTKRKKKQPTS

SEQ ID NO: 99529 - protein, 653 aa, Homo sapiens; identical to SEQ ID NO: 99528
  Payload ID: 19843
  Gene Name: zinc finger protein 274
  Uniprot ID: Q96GC6
  ENSP ID: ENSP00000484810

SEQ ID NO: 99530 - protein, 376 aa, Homo sapiens
  Payload ID: 19844
  Gene Name: zinc finger protein 275
  Uniprot ID: Q9NSD4
  ENSP ID: ENSP00000359269
MKGEDAQPQEMASTSFPRASGPSPEFRQHGDSDGKRGSPQNLPIEHHFACKECGDTFRLKVLLVQHQRVHSEEKGWECGDCGKVFRGVAEFNEHRKSHVAAEPQPGPSRALENAAEKREQMEREAKPFECEECGKRFKKNAGLSQHLRVHSREKPFDCEECGRSFKVNTHLFRHQKLHTSEKPFACKACSRDFLDRQELLKHQRMHTGHLPFDCDDCGKSFRGVNGLAEHQRIHSGAKPYGCPHCGKLFRRSSELTKHRRIHTGEKPYACGQCGKAFRQSSSLLEHARIHSGERPYACGECGKAFRGPSDLIKHRRIHSGLKPYECDKCGKAFRRSSGLSRHRRIHSGARRCECSQCGRVFKRRSALQKHQPTHHE

SEQ ID NO: 99531 - protein, 329 aa, Homo sapiens
  Payload ID: 19844
  Gene Name: zinc finger protein 275
  ENSP ID: ENSP00000359271
MMSHPCVSLLGVPVLNPALVPHLAQGQVLLVSDPSPNTDPAKYSESTSATRHQMKGEDAQPQEMASTSFPRASGPSPEFRQHGDSDGKRGSPQNLPIEHHFACKECGDTFRLKVLLVQHQRVHSEEKGWECGDCGKVFRGVAEFNEHRKSHVAAEPQPGPSRALENAAEKREQMEREAKPFECEECGKRFKKNAGLSQHLRVHSREKPFDCEECGRSFKVNTHLFRHQKLHTSEKPFACKACSRDFLDRQELLKHQRMHTGHLPFDCDDCGKSFRGVNGLAEHQRIHSGAKPYGCPHCGKLFRRSSELTKHRRIHTGEKPYACGLPWAL

SEQ ID NO: 99532 - protein, 539 aa, Homo sapiens
  Payload ID: 19845
  Gene Name: zinc finger protein 276
  Uniprot ID: Q8N554
  ENSP ID: ENSP00000289816
MGHCRLCHGKFSSRSLRSISERAPGASMERPSAEERVLVRDFQRLLGVAVRQDPTLSPFVCKSCHAQFYQCHSLLKSFLQRVNASPAGRRKPCAKVGAQPPTGAEEGACLVDLITSSPQCLHGLVGWVHGHAASCGALPHLQRTLSSEYCGVIQVVWGCDQGHDYTMDTSSSCKAFLLDSALAVKWPWDKETAPRLPQHRGWNPGDAPQTSQGRGTGTPVGAETKTLPSTDVAQPPSDSDAVGPRSGFPPQPSLPLCRAPGQLGEKQLPSSTSDDRVKDEFSDLSEGDVLSEDENDKKQNAQSSDESFEPYPERKVSGKKSESKEAKKSEEPRIRKKPGPKPGWKKKLRCEREELPTIYKCPYQGCTAVYRGADGMKKHIKEHHEEVRERPCPHPGCNKVFMIDRYLQRHVKLIHTEVRNYICDECGQTFKQRKHLLVHQMRHSGAKPLQCEVCGFQCRQRASLKYHMTKHKAETELDFACDQCGRRFEKAHNLNVHMSMVHPLTQTQDKALPLEAEPPPGPPSPSVTTEGQAVKPEPT

SEQ ID NO: 99533 - protein, 614 aa, Homo sapiens
  Payload ID: 19845
  Gene Name: zinc finger protein 276
  Uniprot ID: Q8N554
  ENSP ID: ENSP00000415836
MKRDRLGRFLSPGSSRQCGASDGGGGVSRTRGRPSLSGGPRVDGATARRAWGPVGSCGDAGEDGADEAGAGRALAMGHCRLCHGKFSSRSLRSISERAPGASMERPSAEERVLVRDFQRLLGVAVRQDPTLSPFVCKSCHAQFYQCHSLLKSFLQRVNASPAGRRKPCAKVGAQPPTGAEEGACLVDLITSSPQCLHGLVGWVHGHAASCGALPHLQRTLSSEYCGVIQVVWGCDQGHDYTMDTSSSCKAFLLDSALAVKWPWDKETAPRLPQHRGWNPGDAPQTSQGRGTGTPVGAETKTLPSTDVAQPPSDSDAVGPRSGFPPQPSLPLCRAPGQLGEKQLPSSTSDDRVKDEFSDLSEGDVLSEDENDKKQNAQSSDESFEPYPERKVSGKKSESKEAKKSEEPRIRKKPGPKPGWKKKLRCEREELPTIYKCPYQGCTAVYRGADGMKKHIKEHHEEVRERPCPHPGCNKVFMIDRYLQRHVKLIHTEVRNYICDECGQTFKQRKHLLVHQMRHSGAKPLQCEVCGFQCRQRASLKYHMTKHKAETELDFACDQCGRRFEKAHNLNVHMSMVHPLTQTQDKALPLEAEPPPGPPSPSVTTEGQAVKPEPT

SEQ ID NO: 99534 - protein, 94 aa, Homo sapiens
  Payload ID: 19845
  Gene Name: zinc finger protein 276
  ENSP ID: ENSP00000455345
  MOD_RES (1)..(1): Any amino acid
XWDKETAPRLPQHRGWNPGDAPQTSQGRGTGTPVGAETKTLPSTDVAQPPSDSDAVGPRSGFPPQPSLPLCRAPGQLGEKQLPSSTSDDRRRLE

SEQ ID NO: 99535 - protein, 280 aa, Homo sapiens
  Payload ID: 19845
  Gene Name: zinc finger protein 276
  ENSP ID: ENSP00000455466
MGHCRLCHGKFSSRSLRSISERAPGASMERPSAEERVLVRDFQRLLGVAVRQDPTLSPFVCKSCHAQFYQCHSLLKSFLQRVNASPAGRRKPCAKVGAQPPTGAEEGACLVDLITSSPQCLHGLVGWVHGHAASCGALPHLQRTLSSEYCGVIQVVWGCDQGHDYTMDTSSSCKAFLLDSALAVKWPWDKETAPRLPQHRGWNPGDAPQTSQGRGTGTPVGAETKTLPSTDVAQPPSDSDAVGPRSGFPPQPSLPLCRAPGQLGEKQLPSSTSDDRRRLE

SEQ ID NO: 99536 - protein, 433 aa, Homo sapiens
  Payload ID: 19845
  Gene Name: zinc finger protein 276
  ENSP ID: ENSP00000457210
MGHCRLCHGKFSSRSLRSISERAPGASMERPSAEERVLVRDFQRLLGVAVRQDPTLSPFVCKSCHAQFYQCHSLLKSFLQRVNASPAGRRKPCAKVGAQPPTGAEEGACLAPSACTAWWGGCMDMRPAAGPCPTFRGHCPPSTAASSRSCGAATRATTTPWIPAPAARPSCWTVRWQSSGHGTKRRRHGCPSTEGGTLGMPLRPPRVEGQGPQLGLRPRPCPARMWPSLLRTATRWGPGRASHLSQACPFAGPQGSWVRSSFHLQPRMIGDVLSEDENDKKQNAQSSDESFEPYPERKVSGKKSESKEAKKSEEPRIRKKPGPKPGWKKKLRCEREELPTIYKCPYQGCTAVYRGADGMKKHIKEHHEEVRERPCPHPGCNKVFMIDRYLQRHVKLIHTEVRNYICDECGQTFKQRKHLLVHQMRHSGAKPLQ

SEQ ID NO: 99537 - protein, 355 aa, Homo sapiens
  Payload ID: 19845
  Gene Name: zinc finger protein 276
  ENSP ID: ENSP00000457313
MKRDRLGRFLSPGSSRQCGASDGGGGVSRTRGRPSLSGGPRVDGATARRAWGPVGSCGDAGEDGADEAGAGRALAMGHCRLCHGKFSSRSLRSISERAPGASMERPSAEERVLVRDFQRLLGVAVRQDPTLSPFVCKSCHAQFYQCHSLLKSFLQRVNASPAGRRKPCAKVGAQPPTGAEEGACLVDLITSSPQCLHGLVGWVHGHAASCGALPHLQRTLSSEYCGVIQVVWGCDQGHDYTMDTSSSCKAFLLDSALAVKWPWDKETAPRLPQHRGWNPGDAPQTSQGRGTGTPVGAETKTLPSTDVAQPPSDSDAVGPRSGFPPQPSLPLCRAPGQLGEKQLPSSTSDDRRRLE

SEQ ID NO: 99538 - protein, 450 aa, Homo sapiens
  Payload ID: 19846
  Gene Name: zinc finger protein 277
  Uniprot ID: Q9NRM2
  ENSP ID: ENSP00000354501
MAASKTQGAVARMQEDRDGSCSTVGGVGYGDSKDCILEPLSLPESPGGTTTLEGSPSVPCIFCEEHFPVAEQDKLLKHMIIEHKIVIADVKLVADFQRYILYWRKRFTEQPITDFCSVIRINSTAPFEEQENYFLLCDVLPEDRILREELQKQRLREILEQQQQERNDTNFHGVCMFCNEEFLGNRSVILNHMAREHAFNIGLPDNIVNCNEFLCTLQKKLDNLQCLYCEKTFRDKNTLKDHMRKKQHRKINPKNREYDRFYVINYLELGKSWEEVQLEDDRELLDHQEDDWSDWEEHPASAVCLFCEKQAETIEKLYVHMEDAHEFDLLKIKSELGLNFYQQVKLVNFIRRQVHQCRCYGCHVKFKSKADLRTHMEETKHTSLLPDRKTWDQLEYYFPTYENDTLLCTLSDSESDLTAQEQNENVPIISEDTSKLYALKQSSILNQLLL

SEQ ID NO: 99539 - protein, 50 aa, Homo sapiens
  Payload ID: 19846
  Gene Name: zinc finger protein 277
  ENSP ID: ENSP00000355043
MAASKTQGAVARMQEDRDGSCSTVGGVGYGVRIVSWSRFPCQKVQVAPPL

SEQ ID NO: 99540 - protein, 199 aa, Homo sapiens
  Payload ID: 19846
  Gene Name: zinc finger protein 277
  ENSP ID: ENSP00000390359
MAASKTQGAVARMQEDRDGSCSTVGGVGYGDSKDCILEPLSLPESPGGTTTLEGSPSVPCIFCEEHFPVAEQDKLLKHMIIEHKIVIADVKLVADFQRSVILNHMAREHAFNIGLPDNIVNCNEFLCTLQKKLDNLQCLYCEKTFRDKNTLKDHMRKKQHRKINPKNREYDRFYVINYLELGKSWEEVQLEDDRELLDH

SEQ ID NO: 99541 - protein, 290 aa, Homo sapiens
  Payload ID: 19846
  Gene Name: zinc finger protein 277
  ENSP ID: ENSP00000402292
MAASKTQGAVARMQEDRDGSCSTVGGVGYGDSKDCILEPLSLPESPGGTTTLEGSPSVPCIFCEEHFPVAEQDKLLKHMIIEHKIVIADVKLVADFQRYILYWRKRFTEQPITDFCSVIRINSTAPFEEQENYFLLCDVLPEDRILREELQKQRLREILEQQQQERNDTNFHGVCMFCNEEFLGNRSVILNHMAREHAFNIGLPDNIVNCNEFLCTLQKKLDNLQCLYCEKTFRDKNTLKDHMRKKQHRKINPKNREYDRFYVINYLVRLSFHNLKFDCSTANKIFLRTN

SEQ ID NO: 99542 - protein, 107 aa, Homo sapiens
  Payload ID: 19846
  Gene Name: zinc finger protein 277
  ENSP ID: ENSP00000402846
MAASKTQGAVARMQEDRDGSCSTVGGVGYGDSKDCILEPLSLPESPGGTTTLEGSPSVPCIFCEEHFPVAEQDKLLKHMIIEHKIVIADVKLVADFQRRTRELFFVM

SEQ ID NO: 99543 - protein, 98 aa, Homo sapiens
  Payload ID: 19846
  Gene Name: zinc finger protein 277
  ENSP ID: ENSP00000410538
MAASKTQGAVARMQEDRDGSCSTVGGVGYGDSKDCILEPLSLPESPGGTTTLEGSPSVPCIFCEEHFPVAEQDKLLKHMIIEHKIVIADVKLVADFQR

SEQ ID NO: 99544 - protein, 118 aa, Homo sapiens
  Payload ID: 19846
  Gene Name: zinc finger protein 277
  ENSP ID: ENSP00000415735
SDWSDWEEHPASAVCLFCEKQAETIEKLYVHMEDAHEFDLLKIKSELGLNFYQQVKLVNFIRRYYFPTYENDTLLCTLSDSESDLTAQEQNENVPIISEDTSKLYALKQSSILNQLLL

SEQ ID NO: 99545 - protein, 79 aa, Homo sapiens
  Payload ID: 19847
  Gene Name: zinc finger protein 28
  ENSP ID: ENSP00000344777
MLENYRNLVSLDFRSVTQAKVQWCHLGSLQPPLPRFKQFSCLSLPSSWDYRARQYRSVPHRDIAKTSKSSHWRFLLPEN

SEQ ID NO: 99546 - protein, 546 aa, Homo sapiens
  Payload ID: 19847
  Gene Name: zinc finger protein 28
  ENSP ID: ENSP00000375661
MMKTFFSTGQGNTEAFHTGTLQRQASHHIGDFCFQKIEKDIHGFQFQWKEDETNDHAAPMTEIKELTGSTGQHDQRHAGNKHIKDQLGLSFHSHLPELHIFQPEGKIGNQVEKSINNASSVSTSQRICCRPKTHISNKYGNNSLHSSLLTQKRNVHMREKSFQCIESGKSFNCSSLLKKHQITHLEEKQCKCDVYGKVFNQKRYLACHRRSHIDEKPYKCNECGKIFGHNTSLFLHKALHTADKPYECEECDKVFSRKSHLETHKIIYTGGKPYKCKVCDKAFTCNSYLAKHTIIHTGEKPYKCNECGKVFNRLSTLARHRRLHTGEKPYECEECEKVFSRKSHLERHKRIHTGEKPYKCKVCDKAFAYNSYLAKHSIIHTGEKPYKCNECGKVFNQQSTLARHHRLHTAEKPYKCEECDKVFRCKSHLERHRRIHTGEKPYKCKVCDKAFRSDSCLTEHQRVHTGEKPYMCNECGKVFSTKANLACHHKLHTAEKPYKCEECEKVFSRKSHMERHRRIHTGEKPYKCKVCDKAFRRDSHLAQHQR

SEQ ID NO: 99547 - protein, 718 aa, Homo sapiens
  Payload ID: 19847
  Gene Name: zinc finger protein 28
  Uniprot ID: P17035
  ENSP ID: ENSP00000397693
MALPQGLLTFRDVAIEFSQEEWKCLDPAQRTLYRDVMLENYRNLVSLDISSKCMMKTFFSTGQGNTEAFHTGTLQRQASHHIGDFCFQKIEKDIHGFQFQWKEDETNDHAAPMTEIKELTGSTGQHDQRHAGNKHIKDQLGLSFHSHLPELHIFQPEGKIGNQVEKSINNASSVSTSQRICCRPKTHISNKYGNNSLHSSLLTQKRNVHMREKSFQCIESGKSFNCSSLLKKHQITHLEEKQCKCDVYGKVFNQKRYLACHRRSHIDEKPYKCNECGKIFGHNTSLFLHKALHTADKPYECEECDKVFSRKSHLETHKIIYTGGKPYKCKVCDKAFTCNSYLAKHTIIHTGEKPYKCNECGKVFNRLSTLARHRRLHTGEKPYECEECEKVFSRKSHLERHKRIHTGEKPYKCKVCDKAFAYNSYLAKHSIIHTGEKPYKCNECGKVFNQQSTLARHHRLHTAEKPYKCEECDKVFRCKSHLERHRRIHTGEKPYKCKVCDKAFRSDSCLTEHQRVHTGEKPYMCNECGKVFSTKANLACHHKLHTAEKPYKCEECEKVFSRKSHMERHRRIHTGEKPYKCKVCDKAFRRDSHLAQHQRVHTGEKPYKCNECGKTFRQTSSLIIHRRLHTGEKPYKCNECGKTFSQMSSLVYHHRLHSGEKPYKCNECGKVFNQQAHLAQHQRVHTGEKPYKCNECGKTFSQMSNLVYHHRLHSGEKP

SEQ ID NO: 99548 - protein, 665 aa, Homo sapiens
  Payload ID: 19847
  Gene Name: zinc finger protein 28
  Uniprot ID: P17035
  ENSP ID: ENSP00000412143
MMKTFFSTGQGNTEAFHTGTLQRQASHHIGDFCFQKIEKDIHGFQFQWKEDETNDHAAPMTEIKELTGSTGQHDQRHAGNKHIKDQLGLSFHSHLPELHIFQPEGKIGNQVEKSINNASSVSTSQRICCRPKTHISNKYGNNSLHSSLLTQKRNVHMREKSFQCIESGKSFNCSSLLKKHQITHLEEKQCKCDVYGKVFNQKRYLACHRRSHIDEKPYKCNECGKIFGHNTSLFLHKALHTADKPYECEECDKVFSRKSHLETHKIIYTGGKPYKCKVCDKAFTCNSYLAKHTIIHTGEKPYKCNECGKVFNRLSTLARHRRLHTGEKPYECEECEKVFSRKSHLERHKRIHTGEKPYKCKVCDKAFAYNSYLAKHSIIHTGEKPYKCNECGKVFNQQSTLARHHRLHTAEKPYKCEECDKVFRCKSHLERHRRIHTGEKPYKCKVCDKAFRSDSCLTEHQRVHTGEKPYMCNECGKVFSTKANLACHHKLHTAEKPYKCEECEKVFSRKSHMERHRRIHTGEKPYKCKVCDKAFRRDSHLAQHQRVHTGEKPYKCNECGKTFRQTSSLIIHRRLHTGEKPYKCNECGKTFSQMSSLVYHHRLHSGEKPYKCNECGKVFNQQAHLAQHQRVHTGEKPYKCNECGKTFSQMSNLVYHHRLHSGEKP

SEQ ID NO: 99549 - protein, 129 aa, Homo sapiens
  Payload ID: 19847
  Gene Name: zinc finger protein 28
  ENSP ID: ENSP00000469381
MALPQGLLTFRDVAIEFSQEEWKCLDPAQRTLYRDVMLENYRNLVSLDFRSVTQAKVQWCHLGSLQPPLPRFKQFSCLSLPSSWDYRYLFQMHDEDILLNRARQYRSVPHRDIAKTSKSSHWRFLLPEN

SEQ ID NO: 99550 - protein, 175 aa, Homo sapiens
  Payload ID: 19847
  Gene Name: zinc finger protein 28
  ENSP ID: ENSP00000471448
MALPQIFGLSPRLKCSGVTSAHCNLHFPGSSNSPASAFQVAGTTDISSKCMMKTFFSTGQGNTEAFHTGTLQRQASHHIGDFCFQKIEKDIHGFQFQWKEDETNDHAAPMTEIKELTGSTGQHDQRHAGNKHIKDQLGLSFHSHLPELHIFQPEGKIGNQVEKSINNASSVSTSQ

SEQ ID NO: 99551 - protein, 542 aa, Homo sapiens
  Payload ID: 19848
  Gene Name: zinc finger protein 280A
  Uniprot ID: P59817
  ENSP ID: ENSP00000302855
MGDIFLCKKVESPKKNLRESKQREEDDEDPDLIYVGVEHVHRDAEVLFVGMISNSKPVVSNILNRVTPGSNSRRKKGHFRQYPAHVSQPANHVTSMAKAIMPVSLSEGRSTDSPVTMKSSSEPGYKMSSPQVVSPSSSDSLPPGTQCLVGAMVSGGGRNESSPDSKRLSTSDINSRDSKRVKLRDGIPGVPSLAVVPSDMSSTISTNTPSQGICNSSNHVQNGVTFPWPDANGKAHFNLTDPERASESALAMTDISSLASQNKTFDPKKENPIVLLSDFYYGQHKGDGQPEQKTHTTFKCLSCVKVLKNIKFMNHMKHHLEFEKQRNDSWEDHTTCQHCHRQFPTPFQLQCHIDSVHIAMGPSAVCKICELSFETDQVLLQHMKDHHKPGEMPYVCQVCHYRSSVFADVETHFRTCHENTKNLLCLFCLKLFKTAIPYMNHCWRHSRRRVLQCSKCRLQFLTLKEEIEHKTKDHQTFKKPEQLQGLPSETKVIIQTSVQPGSSGMASVIVSNTDPQSSPVKTKKKTAMNTRDSRLPCSKDSS

SEQ ID NO: 99552 - protein, 542 aa, Homo sapiens; identical to SEQ ID NO: 99551
  Payload ID: 19848
  Gene Name: zinc finger protein 280A
  ENSP ID: ENSP00000480861

SEQ ID NO: 99553 - protein, 543 aa, Homo sapiens
  Payload ID: 19849
  Gene Name: zinc finger protein 280B
  ENSP ID: ENSP00000478801
MEQSCEEEKEPEPQKNIQETKQVDDEDAELIFVGVEHVNEDAELIFVGVTSNSKPVVSNILNRVTPGSWSRRKKYDHLRKDTARKLQPKSHETVTSEAVTVLPASQLESRSTDSPIIIEPLSKPDYRNSSPQVVPNNSSELPSPLITFTDSLHHPVSTALSVGGINESPRVSKQLSTFEVNSINPKRAKLRDGIIEGNSSASFPSDTFHTMNTQQSTPSNNVHTSLSHVQNGAPFPAAFPKDNIHFKPINTNLDRANELAKTDILSLTSQNKTFDPKKENPIVLLSDFYYGQHKGEGQPEQKTHTTFKCLSCVKVLKNVKFMNHVKHHLEFEKQRNDSWENHTTCQHCHRQFPTPFQLQCHIENVHTAQEPSTVCKICELSFETDQVLLQHMKDHHKPGEMPYVCQVCHYRSSVFADVETHFRTCHENTKNLLCPFCLKIFKTATPYMCHYRGHWGKSAHQCSKCRLQFLTFKEKMEHKTQCHQMFKKPKQLEGLPPETKVTIQVSLEPLQPGSVDVASITVSTSDSEPSLPRSKSKISKKSH

SEQ ID NO: 99554 - protein, 543 aa, Homo sapiens; identical to SEQ ID NO: 99553
  Payload ID: 19849
  Gene Name: zinc finger protein 280B
  Uniprot ID: Q86YH2
  ENSP ID: ENSP00000480958

SEQ ID NO: 99555 - protein, 543 aa, Homo sapiens; identical to SEQ ID NO: 99553
  Payload ID: 19849
  Gene Name: zinc finger protein 280B
  Uniprot ID: Q86YH2
  ENSP ID: ENSP00000481008

SEQ ID NO: 99556 - protein, 543 aa, Homo sapiens; identical to SEQ ID NO: 99553
  Payload ID: 19849
  Gene Name: zinc finger protein 280B
  ENSP ID: ENSP00000485750

SEQ ID NO: 99557 - protein, 543 aa, Homo sapiens; identical to SEQ ID NO: 99553
  Payload ID: 19849
  Gene Name: zinc finger protein 280B
  ENSP ID: ENSP00000486772

SEQ ID NO: 99558 - protein, 543 aa, Homo sapiens; identical to SEQ ID NO: 99553
  Payload ID: 19849
  Gene Name: zinc finger protein 280B
  ENSP ID: ENSP00000486860

SEQ ID NO: 99559 - protein, 737 aa, Homo sapiens
  Payload ID: 19850
  Gene Name: zinc finger protein 280C
  Uniprot ID: Q8ND82
  ENSP ID: ENSP00000360017
MDDDKPFQPKNISKMAELFMECEEEELEPWQKKVEETQDEDDDELIFVGEISSSKPAISNILNRGHSSSSSKGIKSEPHSPGIPEIFRTASQRCRDPPSNPVAASPRFHLVSKSSQSSVTVENASKPDFTKNSQVGSDNSSILLFDSTQESLPPSQDIPAIFREGMKNTSYVLKHPSTSKVNSVTPKKPKTSEDVPQINPSTSLPLIGSPPVTSSQVMLSKGTNTSSPYDAGADYLRACPKCNVQFNLLDPLKYHMKHCCPDMITKFLGVIVKSERPCDEDKTDSETGKLIMLVNEFYYGRHEGVTEKEPKTYTTFKCFSCSKVLKNNIRFMNHMKHHLELEKQNNESWENHTTCQHCYRQYPTPFQLQCHIESTHTPHEFSTICKICELSFETEHILLQHMKDTHKPGEMPYVCQVCQFRSSTFSDVEAHFRAAHENTKNLLCPFCLKVSKMATPYMNHYMKHQKKGVHRCPKCRLQFLTSKEKAEHKAQHRTFIKPKELEGLPPGAKVTIRASLGPLQSKLPTAPFGCAPGTSFLQVTPPTSQNTTARNPRKSNASRSKTSKLHATTSTASKVNTSKPRGRIAKSKAKPSYKQKRQRNRKNKMSLALKNIRCRRGIHKCIECHSKIKDFASHFSIYIHCSFCKYNTNCNKAFVNHMMSSHSNHPGKRFCIFKKHSGTLRGITLVCLKCDFLADSSGLDRMAKHLSQRKTHTCQVIIENVSKSTSTSEPTTGCSLK

SEQ ID NO: 99560 - protein, 610 aa, Homo sapiens
  Payload ID: 19850
  Gene Name: zinc finger protein 280C
  ENSP ID: ENSP00000408521
MDDDKPFQPKNISKMAELFMECEEEELEPWQKKVEETQDEDDDELIFVGEISSSKPAISNILNRGHSSSSSKGIKSEPHSPGIPEIFRTASQRCRDPPSNPVAASPRFHLVSKSSQSSVTVENASKPDFTKNSQVGSDNSSILLFDSTQESLPPSQDIPAIFREGMKNTSYVLKHPSTSKVNSVTPKKPKTSEDVPQINPSTSLPLIGSPPVTSSQVMLSKGTNTSSPYDAGADYLRACPKCNVQFNLLDPLKYHMKHCCPDMITKFLGVIVKSERPCDEDKTDSETGKLIMLVNEFYYGRHEGVTEKEPKTYTTFKCFSCSKVLKNNIRFMNHMKHHLELEKQNNESWENHTTCQHCYRQYPTPFQLQCHIESTHTPHEFSTICKICELSFETEHILLQHMKDTHKPGEMPYVCQKKGVHRCPKCRLQFLTSKEKAEHKAQHRTFIKPKELEGLPPGAKVTIRASLGPLQSKLPTAPFGCAPGTSFLQVTPPTSQNTTARNPRKSNASRSKTSKLHATTSTASKVNTSKPRGRIAKSKAKPSYKQKRQRNRKNKMSLALKNIRCRRGIHKCIECHSKIKDFASHFSIYIHCSFCKYNTNCNKAFVNHMM

SEQ ID NO: 99561 - protein, 979 aa, Homo sapiens
  Payload ID: 19851
  Gene Name: zinc finger protein 280D
  Uniprot ID: Q6N043
  ENSP ID: ENSP00000267807
MGDNPFQPKSNSKMAELFMECEEEELEPWQKKVKEVEDDDDDEPIFVGEISSSKPAISNILNRVNPSSYSRGLKNGALSRGITAAFKPTSQHYTNPTSNPVPASPINFHPESRSSDSSVIVQPFSKPGYITNSSRVVSNKSSELLFDLTQDTGLSHYQGGPTLSMAGMSESSFLSKRPSTSEVNNVNPKKPKPSESVSGANSSAVLPSVKSPSVTSSQAMLAKGTNTSSNQSKNGTPFPRACPKCNIHFNLLDPLKNHMKYCCPDMINNFLGLAKTEFSSTVNKNTTIDSEKGKLIMLVNDFYYGKHEGDVQEEQKTHTTFKCFSCLKILKNNIRFMNHMKHHLELEKQSSESWENHTTCQHCYRQFPTPFQLQCHIESTHTPHEFSTICKICELSFETEHVLLQHMKDNHKPGEMPYVCQVCNYRSSSFSDVETHFRTSHENTKNLLCPFCLKVIKIATPYMHHYMKHQKKGIHRCTKCRLQFLTCKEKMDHKTQHHRTFIKPKQLEGLPPGTKVTIRASVGPLQSGASPTPSISASASTLQLSPPRTKNITAKNPAKSNTSKPNTVKSNASKPNTSKPNGSKSKYKPKISNMQKKQSTLASSNKKSKVNTALRNLRYRRGIHKCIECCSEIKDFANHFPTYVHCSFCRYNTSCSKAYVNHMMSFHSNRPSKRFCIFKKHSENLRGITLVCLNCDFLSDVSGLDNMATHLSQHKTHTCQVVMQKVSVCIPTSEHLSELKKEAPAKEQEPVSKEIARPNMAERETETSNSESKQDKAASSKEKNGCNANSFEGSSTTKSEESITVSDKENETCLADQETGSKNIVSCDSNIGADKVEKKKQIQHVCQEMELKMCQSSENIILSDQIKDHNSSEARFSSKNIKDLRLASDNVSIDQFLRKRHEPESVSSDVSEQGSIHLEPLTPSEVLEYEATEILQKGSGDPSAKTDEVVSDQTDDIPGGNNPSTTEATVDLEDEKERS

SEQ ID NO: 99562 - protein, 747 aa, Homo sapiens
  Payload ID: 19851
  Gene Name: zinc finger protein 280D
  ENSP ID: ENSP00000453045
MAELFMECEEEELEPWQKKVKEVEDDDDDEPIFVGEISSSKPAISNILNRVNPSSYSRGLKNGALSRGITAAFKPTSQHYTNPTSNPVPASPINFHPESRSSDSSVIVQPFSKPGYITNSSRVVSNKSSELLFDLTQDTGLSHYQGGPTLSMAGMSESSFLSKRPSTSEVNNVNPKKPKPSESVSGANSSAVLPSVKSPSVTSSQAMLAKGTNTSSNQSKNGTPFPRACPKCNIHFNLLDPLKNHMKYCCPDMINNFLGLAKTEFSSTVNKNTTIDSEKGKLIMLVNDFYYGKHEGDVQEEQKTHTTFKCFSCLKILKNNIRFMNHMKHHLELEKQSSESWENHTTCQHCYRQFPTPFQLQCHIESTHTPHEFSTICKICELSFETEHVLLQHMKDNHKPGEMPYVCQVCNYRSSSFSDVETHFRTSHENTKNLLCPFCLKVIKIATPYMHHYMKHQKKGIHRCTKCRLQFLTCKEKMDHKTQHHRTFIKPKQLEGLPPGTKVTIRASVGPLQSGASPTPSISASASTLQLSPPRTKNITAKNPAKSNTSKPNTVKSNASKPNTSKPNGSKSKYKPKISNMQKKQSTLASSNKKSKVNTALRNLRYRRGIHKCIECCSEIKDFANHFPTYVHCSFCRYNTSCSKAYVNHMMSFHSNRPSKRFCIFKKHSENLRGITLVCLNCDFLSDVSGLDNMATHLSQHKTHTCQVVMQKDAEAAQRFQKISRVYLDSVPLRWTQLMPVLSFQGM

SEQ ID NO: 99563 - protein, 535 aa, Homo sapiens
  Payload ID: 19851
  Gene Name: zinc finger protein 280D
  ENSP ID: ENSP00000453124
MGDNPFQPKSNSKMAELFMECEEEELEPWQKKVKEVEDDDDDEPIFVGEISSSKPAISNILNRVNPSSYSRGLKNGALSRGITAAFKPTSQHYTNPTSNPVPASPINFHPESRSSDSSVIVQPFSKPGYITNSSRVVSNKSSELLFDLTQDTGLSHYQGGPTLSMAGMSESSFLSKRPSTSEVNNVNPKKPKPSESVSGANSSAVLPSVKSPSVTSSQAMLAKGTNTSSNQSKNGTPFPRACPKCNIHFNLLDPLKNHMKYCCPDMINNFLGLAKTEFSSTVNKNTTIDSEKGKLIMLVNDFYYGKHEGDVQEEQKTHTTFKCFSCLKILKNNIRFMNHMKHHLELEKQSSESWENHTTCQHCYRQFPTPFQLQCHIESTHTPHEFSTICKICELSFETEHVLLQHMKDNHKPGEMPYVCQVCNYRSSSFSDVETHFRTSHENTKNLLCPFCLKVIKIATPYMHHYMKHQKKGIHRCTKCRLQFLTCKEKMDHKTQHHRTFIKPKQLEGLPPGTKSALEYLLQWRETEAWIIQSE
